United States Patent 10,870,889 (IMMUNOGLOBULIN EXPRESSION LEVELS AS BIOMARKER FOR PROTEASOME INHIBITOR RESPONSE) - sequence listing, part 7

SEQ ID NO: 583 - DNA, 39144 bp, Homo sapiens
aattcactaatgcattctgctctttttgagagcacagcttctcagatgtgctccttggagctggtgtgcagtgtcctgactgtaagatcaagtccaaacctgttttggaattgaggaaacttctcttttgatctcagcccttggtggtccaggtcttcatgctgctgtgggtgatattactggtcctgggtgagtaaaagggctcaccatgggccctgggtgggatcgggacagcttctctctccaccgcaggcctggtcctttcttggggctcagcccctgctgagagactctctcctacattaggagactgtatttttgaactttactctgtagctcagggctttctcttgaggctgaagaaaatggccacagctggaaggaattttcaatcttacagagtaggaaaccacaataaccacaacaattaaaatttcatttatttttttctttaaaaagtacttcttaaagtccagagaatgtttcatgtttgtttgttcatattgtcttactcatagaagagcccactctcctctctgcagaggagatgtatttattccttgtatgacaaggccagatcctggtccccagcataagaggcaaggtttctaacgggaaagacaggtctttctcttgtacataattgcaaaccactgcagcaattggctgattaagaacatggggtggaggaggtcgcagaggcgtaggtggacaaagcaaggataaatctaaagcatatgactttctctttgtccctgtgggtgtacgtaagtctctatcaactcatatgtgcgaactggttgatttttactaaaggttaaatattataattaaatatgtttatttatttgttcagcaaatgtgtttagtaatatctatgcacaggtgctgagcaattagagtccataggagacactacgtctatgttctggaaagtcatgacatagaagggctcccagcaaggccaatgtactttcaagcagctatgcaacaagctcccagttaaataattgtccaggcaaagttaccaatgaatgctgtaggcagataataaactgtattcaaaatagctagtaaagacttcatgaaacttagaggtgagtaggagctagaggagcagaaatggagcaggcgtgatataagaaaagaggacctcacagttggaaggtgcatggactataattcctgaagtaggaatacatctcagtgtggccccacacaatgtgggtaatggccaggtcctgagcatgagagggcaaagtttataacatgggctctggggtcaaacaggatctaggttcaaacttcatcttgccacctactggctaccagattcctggtctacaaaatgcagttaatcctagtgcttacctcacaggattattgacatggttatatgaaataacctacgtaaatgcagaccatatagaaaccactcacaaaaatattagcttcatttaaaacaatgcaaagatgaaggaagccaaaatattcaggtgaatggtgaataatttgttgttctcagtaaaacacttaagtttggataagtctccaatagcctcatgtggacagggatgatttgtctctcacacactcctggatttctattgccttgctctggagtatgattggcattccaaaaatctgttgaataaataaatcaacccatatgcagaatacctactcaattgataaacctgccagttttgtgtcctctctctcttcattacccatttctcaaatctctatccttctattcctatattattaacctagttctttaattaattcattatacaacacaaatatatttagtgaacattaaaggaatatcttttatatgccattcaccgttataggtcctggaggatatatggtgaacataaggaaagtcctaggtctcatagagcttgcattatagagaagggaaaataaacaagcagataatgaagataatttggataaatactctgacaaaaattacacattaccatctcttgggctgagcatcaggtctaaataatctgagcatcagttgattgtttaaaaattaggcatgatgataatgagcccttggattcaatgatctcatgaaaagagtatagcctggagtctggtgcccaagggaggcttaattcatgtccatttccttgccctgccttctaatcagtctccctgcttcatattgtcccattaaattctgtccactgacagagtgctccatcaaagtctgaaattctaaccttgtcaatctcctccttgaaaccattccatgactccttatcacttttataataaaattagaaccacttactcaggccctgcatgcttctctggtcttatttcccccaacactcccagttcctgagcaccaatgtcatttctccacttctgtgccctttctaccttgaaaggtagaaatcgcctcttaccacacacaaatgctaacatccacctgcagactcatgttctcactcacagttttgtgaagtatcatctccttcaggtaccttcaaggatccacccatcctgttcaacacatgtacacacaaacacacactctacacacacacatatatcctacacactgggctagtggcccttctgcccccaacataccccatgtgtatttctgttattgcacttacaccctgtgttatattattttaaatcgtgtttctgtttttccactagtcaacttcttgatggcagataccatttttaaaattcattgtagaagtccaaataccatgccatatatatatgtatatatatgtatatttatgtgtatatatatacatttgatgaataattattagagtttttaaatgaattttttaaagggacaagtaatacatgcatgggtaaaaaagggaattatcttcttaaaacaaaataatcatggttctgtgctcatctctggctcttatttttttgcagctcctgtcagtggacagtttggtgagttctcctgtctttggctcttcagcgtctctggttaagagtgtctcttcctaataaatagaaaacatttgtgatggctgcctgagatctccaatatctcctgttttctttccttttttttattatactttaagttttagggtacatgtgcacaacgtgcaggtttgttatatatgtatacatgtgccatgttggtgcgctgcacccactaactcgtcatttaacattaggtatatctcctaatgctatccctcccccctccccccaccccacaacaggccctggagtgtgatgttccccttcctgtgtccaagtgttctcattgttcaattcccacctatgagtgagaacatgcggtgtttggttttttgtccttgcaatagtttgctgagaatgacagtttccagcttcatccatgtccctacaaaggacatgaactcatcattttttatggctgcatagtattccatggtgtatatgtgccacatttccttgatccagtctatcattgttggacatttgggttggttccaagtctttgctactgtgaatagtgccgcagtaaacatacgtgtgcatgtgcctttatagcagcatgatttgtagtccattggttatatacctggtaatgggatggctgggtcaaatggtatttctgcttctagatccctgaggaatcgccacactgacttccacaatggttgaactagtttacactcccaccaacagtgtaaaagtgttcctatttctccacatcctctccagcacctgttgtttcctgactttttaataattgccattctaactggtgtgatatggtatctcattgtggttttgatttgcatttctctgatggccagtgatgatgagcattttctcatgtgtcttttggctgcataaatgtcttcttttgagaagtgtctgttcatatccttcacccactttttgatggggttgtttgaatttttcttgtaaatttgtttgagttcattgtagattctggatattagccctttgtcaaatgagtagattgcaaaacttttctcccattctgtaggttgcctgttcactctgatggtagtttcttttgctgtgcagaagttctttagtttaattagatcccatttgtcaattttggcttttgttgccattgcttttggtgttttagacatgaagtccttgcccatgcctatgtcctgaatggtattgcctaggttttcttaaagacttaaatgttagacctaaaacaatatctcctgttttcttgctgaggtcagcagggatttcaaagtgatgcctggttttttggcatcgtccaagggccaggatagcttcatggtcaccctctgaccctccctgggggaaggggtgaatgcccaagcagctcccagcctttgctaagccctgcatttactattattgccaacagaccccatttagccaggcaggacatcttcaactccatggcaagtatattgactcaggataggatcctctcaatcagcgagccagaaaaataccctgaaaatatcccactgtgctgatgccagcaggaatgctgcattctctacactttggagtaaaatcctccaggacatccaataactgggtccttacaaaaaagaaaggcacagaaaggggagatggggagaagacaagttatctgcatcccacatttaattagttctggctcttactgccattcctttggctctgagtggataattgagaacccatgaacagcaacaaccctctacaacccctctccttgtccaaatcagtggccccagctgtaactttgtcctggtcacctctggatgtcagtgagtgacttgtcccttccttgctctgccacaattagctgtgatgggattcttctgggcacttgaatcatcatctacaaaatgaagatattaggtaagttgagctctcaaggttttctcagggacaaatcttaagataatatgatttattctcttagggaaagtgcaaaattgtgattttaacataacctttggagtttcttatgagtgtatgaacatgatgaaatggcagcgcagcattgattttctctgggacccacttccatgtaaggctacctaactgtgatatttgatggcgaatcctgctggtgtcaccctcctgaaatcattttgctcattgccatcccctgggcaatttctcccttgggtgaggtgagggccactggctgacagggagctttgagctatcagtgaccctcccagaggacctctttcagatcctccaaacccaggtccttcaggctatgcagcaggaggccctgaggctgggtctgcaggcgcctccacctcagactccttttctctttcctcttcagcaaggacacccaggcccattattttcctccagcctccatggaccacagtcttccaaggagagagagtgaccctcacttgcaagggatttcgcttctactcaccacagaaaacaaaatggtaccatcggtaccttgggaaagaaatactaagagaaaccccagacaatatccttgaggttcaggaatctggagagtacagatgccaggcccagggctcccctctcagtagccctgtgcacttggatttttcttcaggtgagagagcgtgaaagacgcaccaactttagaaatcaattcagcccatgtttctctctagctgttattactgtttacctcagacccttcatgagtggacaattttatttcacactgtggtaagacaaggagagagtaaaaagctcagaatacaaccagacagggaatggggttagctgcttaattttaaacattaaaataaatagaatttttacttgagtggattaatgtctctaaacctgtggttcttaaagtttgatttgagtcagaaagcctgggcagcttatcaaccatacagatactcaggacctacctatgcttattcaatagaaacctgtagaagtggggtccagcaatttatattttttacaagcctctccggtaccagaaagtctgaggattaatttatttgagtggttcctgaatctatgtatagctttttggtttggtttggtttggtttggtttggtttggtttggtttggtttggttttttgagatggagtctcgctctgtcacccaggctggagtgcagtggcgttatctcggctcactgcaacttctgtctcccgggttcaagcaattctcccacctcggtatccctagtaagtaggactacaagagcccgccatcacacctggctaatttttgtattcttagcagagatgggatttcctcatgctgcccaggctaatgttgaactcctgggctcaagtgatctgctcacctaggcctctcaaagcgctgggattacaggtatgagccactgcacccggcctctatgtatagttttaagtcacattatttacttggaataataagtggcaggagaattgttcatacttatgggtagataatgcataggtagataaatatacagagaaagaaagataaaggaagagacatttccttccttgtcctaaagccacctgttttgaagttgaagttacatcattttttaatgtagtggaagcagtgtactagcaaggaataaacaaaaatgtttatactctttgacttaacaatccgtctcttaagaatttgcctactgaaacaatcacagatgtccatccctgaaaatggcagaccttaacatggtttagaaaaagaatacctggccaggcgcggtggcttacgcctgtaatcccagcactttggaaggccaaggcgggtggatcacgaggtcaggagattgagaccatcctggctaacactatgaaaccccgtctctactaaaaatacaaaaaattagccgggcttggtggcgggtgcctgtagtcccagctactcgggaggctgaggcaggagaatggcatgaacccgggagatggagcttgcagtgagccgagatagcaccactgcagtcctgcctgggtgaaagagtgagactccgtctcaaaaaaaaaaaaaaaaaaaaaaaactcattaaagaaattacattactgccagtgaaggaaaaccgcaaacattaaaaatcaggttcaataatgatactaatgatgtaggaaagtgttcatagcatagtaagtgaaaggaaagttatcaaatctacaaatattaatattattccataaaagaaatacgcatgagctccaagtacttgaaagtggaagagaaaactggaaaaacatatgccaaaacatgggtggtgagatggtaggtgattttacctacatttctgcttttcaacttttcttaaggtgtatgtgttcatttttaaatcagaaaaaaagaaatgataattattttaagagttctttttcccaacccatttttttaaaataaaatctacttggaaaaacaatgaaaagaaaggggaaacagtaggatgaaccaaataactctattgtgtttctcatagcttcgctgatcctgcaagctccactttctgtgtttgaaggagactctgtggttctgaggtgccgggcaaaggcggaagtaacactgaataatactatttacaagaatgataatgtcctggcattccttaataaaagaactgacttccatattcctcatgcatgtctcaaggacaatggtgcatatcgctgtactggatataaggaaagttgttgccctgtttcttccaatacagtcaaaatccaagtccaaggtaaagccttcattattttgtgaagtgagttggtcaaaaggagattccttggggtcatagagatagaacaggaggaaaagggtggactggaataccactaaaccacaggacacattcctgcaaggagcagaggaagtatagtagtgttttgggctgaaggaagctagggatcaatggcattcctttctttgcctgcttttggatgtgctgctgcttgaagtgtgcttttctccaaagcagttccagcctcattgctctgggactgttgtgattcttctctctagagccatttacacgtccagtgctgagagccagctccttccagcccatcagcgggaacccagtgaccctgacctgtgagacccagctctctctagagaggtcagatgtcccgctccggttccgcttcttcagagatgaccagaccctgggattaggctggagtctctccccgaatttccagattactgccatgtggagtaaagattcagggttctactggtgtaaggcagcaacaatgccttacagcgtcatatctgacagcccgagatcctggatacaggtgcagagtaagtgttggtggaacctgagatttgctgcagagagggctggaaaagtgggacagggctgcatatcagcgtgggtcaccagtctctgtagaaaaaactcgtacctgtgagaatgggagttgtgcaagcaaagagacctctactcttgtgaacatcttagaagagcttagacccaggaaaatccaagaaaagaaaggtctaattttttttctttcaatgccattaaatacaattctttcttttctctcgcagggttctcttccctgacatcatttttttttcttctaggcccatagggataagccatgggctgtggcatagctctctgactctggtgtacagaggtatctgttgtcccaattaacattacttattgacaataaccaaagtgaaaatttctgtaggatacaaagacaggttgcaacattatagttactccaaatatgtgactctggaggtttaccattccctagttatgagtacaaatatgcaccccagattacatcacctcccttactagtatacagcaccatccttccttcaaagctattatggtagttacagtgatgagggaaaaacagcttctgtagagccctgtgtcatccctccactcatggcaaactccgggctcacttataaggaggcaatgtgatcatcaccagactaggagtcaggacaccaactctggccctggctggccctgaaaacagcctacacaggcaggtctcctagtctctccttgactcagttttctcacctgtaaataaagaaggtcagtctgggccaagggagagagtaggagcagaagaaaaagctctagaagactatgctaatctttaaggaaaaactagcaatggcaaataaatccctgaggccaatgcaagtgaaggagaaataaacagggataggaaagaagactcagaataattgggcacttcaggtgcaacattccatagtcatagggcagaaggaaggagcaagaagcaggtgcaggtaagggtgtgtggttctgatggcagcaagttaagggtggagactggagactgggcatttgcactggccatgccttgtaatctacagtaagaggcaaaagcaattcttgactaattttttctcttgctcagtccctgcatctcatcctgtcctcactctcagccctgaaaaggctctgaattttgagggaaccaaggtgacacttcactgtgaaacccaggaagattctctgcgcactttgtacaggttttatcatgagggtgtccccctgaggcacaagtcagtccgctgtgaaaggggagcatccatcagcttctcactgactacagagaattcagggaactactactgcacagctgacaatggccttggcgccaagcccagtaaggctgtgagcctctcagtcactggtaagccctgcattcctgccaatcacccacccctggccaagagtcctgcctcaccctgcccttcggaagtcagcatataccttccagtatcctcagtttctttcttgggaaaacctaatgtcctcctccactctccggctcactgaaccagctgtctgcctcttgagtctcgttgcattgcagtctaggtgcccttatacccctgcctgatggtgcagtggctttctatcccctggttcccaatttctgagaagccaagtgcttttcttgtgctttccacttgtcctgtggctccccagatgactgattttcattcactatattattctcagtagacacagactcaatttccaggagcacagaggtatctcctgttctgttaatatcagacattaatcaataaaccaaaggcaaagacatgtaagacacaaagacaagtcgctggatcatagttaacccagcatgtccttcttgctcaagccttttttagagttgatgggcagtaggtaagaaaggcacgggcaatggtgggctgggggcaggccaggagatagcttcacctctacttgcttggcttaatgccctcagagctattcaggtagctgccaaatagttatgacatcaaaaaggtttcctttgagctttggatctcagtttcgaaccatccatgcatggctgaatgccaggtccaatgttgaaggagacagtgtgatttgggtctatactggtgacagagagtccagtcttggttggtcctggaagcggcatcagtttcctttcctgtaaaacaataataccagcttggaagacaagcaagaatccagtccctcccacatggatgtgtgagattataaaggagaggaccagggaacccagcgggagacatcaaatgacgtagaaagagaacagtgtccctgacattcagtggcccaaagaaagtggagacagtgacatcatgatcaaacatgctcagagatgtttaaagtcctattcaatgactcacttcttcacctaataaatgctgattgcatatattccatggaccagactgtactgacatctaaagatgcatctacgactacactaacctggccttccccacacagttcgtaggggctaatagcaaatgcagtcaagtaagagattaaacatcaacctgaggatagaagcacctggtggctgcaggagcagatggaaaggcatgccaatctgagttgggaagtgagaaaaaatttcttggaagaactcatgtgtgagttgagacctgaggatgagtgggaacatttcaggagaagaggattgtggtgagggagggaaggcatgttccaggaactggaggggcagtcggttcttgacgactgcagcacagactgaacagtggagaaaggtaggataaggttggagaggaaggtatgtttagaccatatttagaagcagagtaagggcttgggccatattttgcagggcaatctgggctccatgaatgctttaaatcttggggaaaaccactccagcagcacagtgagaaatgagtcatagagcagccagtttggggggcagccaggagtaaaagagagggttcatcaagagagcgtccagttggagcaaaccccaggccagtcccagtagaggagttgggacttgagaaggaaggactccggttgaagcaagaggcactgtgagagtgtgccccactgtcaccaagggcagaatgtgttctaagcagaagagagggagctggtttggataaggcaaagctaagagatgatgacagataaaaactgagtcacatccagtgaatttagccacaaagtactctttggcagaagacagactagaatcagaatacctgggtttgactgctgcctcttcacttactagctgtgtgactcacccactcggggcctcagcatgttcatctgtgaaagaggggcaacaataatacccacctcaatgaattgcttagatgattaaattagagtctctctatatatcgatatttacaaattacatccaacaaatatacaaacaccagaacttacttaaagacactatagtgtcattataacaaacatctattttattatttttatctttatcatcataattatattcagaaacatgaaaatccactttagtagattgttggggattaaaaccaagttgtaatggacaaaacatgcatatgagatatgagataaagaagtagagatgttaaaggtaggtcacttcttccagaagactgactacagaaaggcggagaaaccgactgtgaggaactgcaaatgcaaatagggttgtttttctattgtctgatggttttttttttttttaaacatggagagggttaaacacatgcaaatggtgtttgcaagaagccagtagaggtaaaaaccttttatctaggacagaggcaggtgagcacaggatgaaaagacagaagaaaatccccccaggcaggccaaggagggctcctccatagcctcagggcccaggtcagagtgaggagctgatgcaggtaagggtgtggttctgctggtggaaagacaagggaattctttgagagcaacatctctgcacaacagaggcaggtcctacaacaaggggagctgggagaggagaaaagacaagaggtctggtggaaaaggaaaagacagggaatgactaggatggaggacaggagagctggtgagagtagcctgggaagtggctgggtcaccctgcaggtgggtagagcctgtggactggagactgaacaactgcactggtgaaacattgaatctgtgaaccaaaaactatctgagacaggtctcaatcaatttggatagtatattttgccatggctaaagacatgtgccccagattcagctccctgccttctccaaagatgattttgagggtttcaatatttaaaggtgaaagggaagatatggagaaaaaggaagaaatttttttaaaagtatgtgtaaataacagacaaacagttgcattcttttgagtctttgatcaacctttagcagaatacacaatttacatgtgagagaggggcagaggaatagtcacttctgtcttcctttagcccagtgagtctgcatttttaagtcagggaaataatcagatatgcatttgtctcctgtaagcagcaatgacttaaagttctgtcttttgtcctgcacttgtgaaaatcagctatcaatttacactgttagggtaaaacagaaccatttaaaacagaaccattttagggtaaagatcttggggcccacaaataatatttcagtggacaaattttgagggaggtatgtagcttttagaaaagtctttgaagttatcttattaaggaataaaataaaaagcaggtttgcctgaaatagttcccagcttgacttttccctttggcttagtgatttggggttcccaagatttattttccttttatgaaaactacagcaggaggcagaaacaaatcttgactaattttttctctctctcagttcccgtgtctcatcctgtcctcaacctcagctctcctgaggacctgatttttgagggagccaaggtgacacttcactgtgaagcccagagaggttcactccccatcctgtaccagtttcatcatgagggtgctgccctggagcgtaggtcggccaactctgcaggaggagtggccatcagcttctctctgactgcagagcattcagggaactactactgcacagctgacaatggctttggcccccagcgcagtaaggcggtgagcctctccgtcactggtaagccctgggttcctgccaatcacccacccctggccaagagtcctctcttacccaacccttcagaagtcagcgtgtaccttctagtatcctctgtttctttcttgaaacaacctaatatcctcctccactctctagctcactgaaccagctgtctgccccttgagcctcatcccattgcagtctgggtgccttcccacccctgcctaatgatgtagcagctttcttttccctgctcctcaaattctgagcagccaattgcttttcttgtgctctccacttgtcctgtagatctgccagatgcctgatttttgtttactaaattattcttagtagatatagactcagactcagttctcaggagcacagaaatgtcccctgtccagttaacatcagacatcaatgaataaccagatgcaaagtcatgtaagacacaaagacaagtcgctggatcacagttaacccaacatgtctcccttgctcaagccttttttagggttgattgggcagtaggtaagaaaggcacagacagcagtgggctgagggcaggtcaggagacagcttaacctctacttgcttggcttaatgccctcacggctactcaggtaactgtcaaatagttatgacatcaaaaaggtttcctttgagctttggatctcagttttgaaccatccatgtgtggctaaatggccaggttcaatgttgaaggagacagtgtgatttgggcctatactggagacagagagtccagtcttggttggtcccggaagcggcctcagtttcctttcctgtaaaacaataataccaccttggaagacaagcaagaatccagtccctcccacatggatgtgtgtgattataaaggagagggccagggaacccagggggagtcatcaaatgatgtagaaaaagaacagtactcctaacattcagaggcccaaggaaagtggagacagggacatcatgatcaaacacactcagagatgtttaaagtcctattaaatgacccacttcttcacctactaaatgctgattctatatatacacctagatgtagtgacatctaaggatgcatctaagactacactaacctggccctgcccacacagttcacaggggctaatagcaaatgcagtcaagtaatagagaaaacatcaacctaagtttagaagtacctggtggctgcaggagcagatgaaaggcatgccaatctgagttggaaagtgagaaaacaattcttggaatttgagatgatatcgggggaaattcacccccaatattttacataggttcttttctattttccctaagtgtcagctggtctcagaaataaagggacagagtacaaaagagaacaattttaaagctgggtgtccgggggcgacatcacatgtcggcaggttccatgatgccccttaagccataaaaccagcaagtttttattagtgattttcaaaagtggagggagtgtactaatagggtgtggctcacagagatcacatgcttcacaaagtaataaaatatcacaaggcaaatggaggcagggtgagctcacaggaccacaggaccggggcgaaattaaaattgctaatgaagcttcgggcacgcattgtcattgataacatcttatcaggagacagggttttgagagcagacaaccagtctgaccaaaatttattaggcaggaatttcctcgtcctaataagcctgggagcactacaggagaccagagcttatttcatccctcagcaacgatcataaaagacagccatccccaaagcggccatttcagaggcctccccttagggacatattctctttctcagggatgttccttgctgagaaaaagaattcagtgatatctctcctatttgatttagaaagaagaaaaatatgactctgttccacccagctcacaggcagccagagtttaaggttatctcccttgttccctgaacattgctgttatcctgttcttttttcaaggtgcccagatttcatattgtttaaacaatttgtgcagttaacacaattatcacagggtcctgaggtgacattcatcctcagtttacaaaaatgatgggattaagagattaaagtaaagacaggcataggaaatcacaagggtattgactgtggaagtgataagtgtccatgaaatcttcacaatttatgttcagagattgcagtaaagacaggcataagaaattataaaagtattaatttggggaactaataaatgtccatgaaatcttcaaaatttatgttcttctgccatggcttcagttggtccctccattcggggtccctgacttcccgcaacaagatgagacctgatggagaagaggattgtggtgagggagggaggacactttcaaggaactggagagtggtcagttcttgatgactgaaccatagacagaacagtggagaaccacaagataaggttggggaagacaacatcattagaacctacttagaagcagagtaagggcttgggccatattctgcagggcaatctgggctccatgaaggttttaaatgttggggaaaaccactccagcagtacagtggggatcaggtcatagagcaacctgtttgaggagcagccaggcgtgaaggagggagcccaacaagggagtgtccagttggacagaacccccagtctagtcccagtagaggaaatgggacatgagaaggaaggactctggccaagggaaaaggcactcactgtgagagtgtgccccactgtcaccaagggtagaacatgttctaagcagatgatagtgagccagtttggataaggcaaagctaagagatgatgaaagataaaaactgagtcatggccaggagaggtggctcatgcctgtaattccagcactttgggaggctgaggcaggtggatcacctgaggtcaggagtttgagaccagcctggccaacatagtgaaatcctgtgtctactaaaaatacaaaaattagccaggtgtggtggcggtcgcctgtaacgccagctactcaggaggctgatgcaggagaattgcttgaattcgggaggcaaagtttgcagtgagctgagatcatgccactgaattccaggctgggtgacacagtgagactccatctcaaaaaaaaaaaaaaaactgagtcacatccagtgaatttagccacaaagtaccctttggcagaagaacacagactagaaccagaatacctgggtttgactgctgcctcttcacttactagctgtgtgactcaaccactcggggcctcagtattttcatctgtgacatagggacaacaataatacctacctcattgaattgttttgatgattaacttagtgtctttatacatatagatattcacaaattacatctgacaaatatacacacaccagaacttaaaggcactataatctcattataacaaatatcttttttatatttatcattatcatcattactacattcataaacatgaaaaatcagctttagtagattattgggggtaaaaactgagttgtaatggacagaatatgcatatgagatatgagataaagaagtagagatgataaatgtaggtcacttcttccagaagtctgtccacagaaaagtggaggaaccaactgtgaggaacttcaaatacaaataaagttgtttttgaattgtctgatagtttttcttatatggagatagttaaacacaccaaaatgtagtttggaagaagccaaaagaggtaaggactttatgtctaggacagaggcagatgtgcacaaggtcaagagacataggaaaatcccccttgggcaggccaggcatggctcttccatggttgcagggaagcctgcatggttgcaggaagaagtgaggagcggtgcaagtgagtctggtggtggcaagacaaggaattttttccttgaaagcatcatctcctctgcaaaaaggaggcaggtcacactacaagaggagccatgagagaagaagagagtattggtctcctggaaagatgaacagatagggaaagaccagcatggagggctggtcacagaaacctgagaagttgcttggctgccctccaggtaggtgaagtctagagatcctgtactggagactgggcatctgcactggccaagtgttgaaatctacagtaagaggcaaaagcaactcttgattcaatctttctcttcctcagtccctgtgtctcatcctgtcctcaccctcagctctgctgaggccctgacttttgaaggagccactgtgacacttcactgtgaagtccagagaggttccccacaaatcctataccagttttatcatgaggacatgcccctgtggagcagctcaacaccctctgtgggaagagtgtccttcagcttctctctgactgaaggacattcagggaattactactgcacagctgacaatggctttggtccccagcgcagtgaagtggtgagcctttttgtcactggtaagtgctgggttcttgccagtcacccacccctggctgagttctctctcacccattcctttaaaaatctgtttgcactgtccagtttcctcccctaatcaacttaatccccttcttggcttcctcctcaactaactagctggggttttccgtactcataagtcctggctcagccagacccctaaaacagctcagtagattccccagcttttaccaaatgaatttatttattgtattttctcctcattccttgtatgttccaacagtacgccaatttttcttgatgcacggagcgtgtcctacttctctactgacatttacatattaacttagctacaagcacagtcttatagataaatattggtcaagaccttaaattctccaaaggatttccaatcttatggtagatttggagaaagctgctggtgaacaaagggggaaatggctccctaggaaccaactcctcaaacttctggagtttttatgatcccttgttttctaacctgctaaaatcagtatcattttattgtattattttaaaaaaactattgttgaagtatgacatacattcaagaaacgtgtgcaaattgtatgtgtacgatttggtgtctttttaggagctaagttgcttctgtttttacttgaatctttgtttatagaaactgggggaaagtttactttcttttcagagaagccaaatggtatgatagaaaaatcttgagcctgatgtgtcagacatgcccctagcataacttgttgagtaaagaggttatttttaaaatgtgaatgttctgagactactccaaagtcagagccaaatctactaggaagcttctagacttcactcattctgcatcccattactatctttttatccatgttttactttcttctcatattcagcagcatcttaagcctctttattttctgtttcttgactgtcacccttaatgccagtagaatgtaagcttcatgagaacagaactgcatccatcttggtcttcacaacatccctgtgcctactcagtgtttggcacacagtaggtcctcagtcaacatttgtaatttagtggacagatgatatgacaagatgataagaggggatttaaaaaaatcatctagcaaagcccaagaggaaaaaaaacaaagctattttagaaatgaaataccaatttgaagcagtaagaatagattggatatctttgaaaaccattaattgaatgaagaaccaatttgagaaaacaatacagaatgcaaagtagaaagatacagaaataaaggcaaaaattataatatggaaatcagacaatggatttgtctgtatccagttatgtggataattaaaatggagaccctcagaaaattgaaccgaagagtaaaatgaaactcaaaaatgtagtagaaattgttgggaagtaaagaaaacttgaatatgtagatcagaacatatatgttgatgacgttattgactttgaggttaaaaatatatatatgtgcctatgattatggggaaaaaagcagtcgtctcagaaagaaaaacatcaagttagtcttagactttgcagtgcactcaataccaaagagagaggaggtccagacttggacctgcgagggaagaataataaccgaaaattttatatcaattcaaaaagacattgtcaaaaatacagggattcaggaaactgagaatgcactaagccttctggaaaaaacacctaatgacaaaatctagcccaacaagatgtaaatgaatataaaggactcataatgaggaaaccgcattatgactggctctcaaccctggctgcatattagactcgtcaaagacctttgtaaaaggtcacacattgactcgtcaaagcccctctccagactaattcaattcagaatctcacagatggggccacagaatcagtattttttgacacaacctcaagtgagaatattgtgtagacaagattggaaaccactgatttagatatagaaacaaaggctaatcaactgtgagaattatggtcacagaatagaaagtaactattatgaacactgaaaatgtaaaaaaaatgtaacaaagaaaaatagttagaggaaggagaggaagtaaaggaacaatcattttctcatgattattattatttcagagtaaattgtgagttatttcacaattcaaaaagaatggactgttttaaaaaattagtaatagatttcaaaatgtccattttgtaaatcgtttctgaatactttgtcaacagttactcatcattaatggcttatacttcactaaaattccatggaaaaccaactagtagcctgtagagtcacataggagagaacaagtgaattctttgggtggcgcaagcatagatgttaggactgacaaaaaaaaaataataaaaataaacctgtgcattgatatgatcacaaatgatcagggaaagaggaaacagaaactctcatacgccattattacaagcgtaaattggttcaaccttttcgtcttaattgacacattgtaattgtatatatttatggaagcacagtttgatattttgatatacatacatggtatataacgatcaaattaggatatttaatgtacccatcatctcatgcatttatcatttctttggaataaaaacattcaaaagcctctcttctagcttttttgtaatatattataactgaccattaaccatcatcaccaatagaacagaatttattcctcctgtcaaattataactttatacccattgaccaacttctccctatcctcctcttccctctcccctccccagtctctgataaccacagttctattctctgcttctatagtatcaactttgtatttttttagattcaaaatatgagtgaaatcatgcagtatcagtctctctgtgcctggataatttcattaaatatgatatcctccaggtctttttatattgctgcaaatcacaggatttcattattttttatggctgaatactattccattgtgcatatattccacattttatttatctattcatctgctgggggacacttagattgcttctatatcttggctattgtgaacagggctgcaataaacttgagagtgcagatatctctttaacatagcgactttatttcctttgaatatccacccagcagtgaaattgatagataatatggtagctctatttttattttattgagaaacttccatgctgtttcttgtggtggctgtactaatttacaatgccaccagcaatgtaagggttccttcctctccacaacttaaccagcacttgttttcttctgactttttgataacagtcattctaactggagtgaggttatacttcattggcgttttaattgtatttccccaataattagtgatattgaccatttttttcatgtacctgttgtccatttttatgtcttctttagagaaatgtctgttaaagtcttttgcccattttttaatcagcttgtttggttttttcctgttaagctctttatatattctggatgttaacaccttgtcagacataaactttgcaaatattttctcccattctataagttgtctttttactctgttaattgtttcctttgctgtgcaaattcttttcagcttgatgtaatcccatttgtctaatatttgcttttgttgcctgtacttttgtattttaaaaggtccagtcttttagaagaacaatttgacattatatgttattacttaaaatgtttgtatacttcatcccagaaattccatgtctaagaatttatcctaagaaatgcatgtgtaaatatacaaaaatatatctacagaattacttaatgcagcatcacttgacatttaagaaacaacaacatcccaaacatccattaatgggaaaatgcttaaatgtattatagcatatctatacaatggaatactttgtcattgttaagaataatcaggtaagtggggcatggtggctctcgcctgtaatcccagcactttgggaggccgaggcgggcagatcacctgaggttgggagttcaagaccagcctgatggagaaaccctgtctctactgaaaatacaaaattagccgggtatggtcgtgcatgcctgtaatcccagctattcaggaggctgaggcaggagaatcgcttcaacccggatggcggaggttgtgctgagccaagatcgcgccattgcactccagcctgggcaacaagagtgaaactctgactcaaaataaaataaaataaaatcaggtaatatatttccaaaattatcaagttgtaaatgtaaaagttatactttattgtgtgtaaattatgctttaataaagatgagttttaaaagttagtgatgtagatttttaagtaataccacagaaagatgcccataatatatagctaaggggaaaaagcaggttgtagaccagtatgttattgtgatcccatgcacgtgtgtgattttaatgtatttatttatgtgtctatgagtgtacttatacatagaaaagatctagaaagtgtcaccaaatactcaacagaagtaatttctgaaaaaataaagaaaatggtaaaactttttatttttacttagataattctgtaaagtttgattttattaaatgaatagctgggtttttcatttttaaaaaaatttcagtagttttggggaccaggtggtgtttggttacatgagtaacttctttagtagtaatttccgagattttggtgcactcgttgccagagcagtgtacactgaacccagtgtgtagtactttatccatcaccccactctcactcttccactgaatccccagaatctattatattatgcttaggcctttgcgtcctcatagcttagctcccactgataagtgagaacatacaatgtttggttttccattcctgagttacttagaataatggtctccaactccatctaggttgctgtgaatgccattattttgttcctttttatggctgagtagtattccatagtgtacacacacacacacacacacatgcgtatgtatcacattttctttatccaccccttaattgatgggcatttgggctggttccatagttttgcaatcatgagttgtgctgctataaacacgtttgtgcaagtgtctttttcatataatgacttcttttcctctgggtagatacccagtagtgggattgctggatgaaatggtagttctacttttagttctttaaggaatctccatactgttttcatagtggttgtaatagtttacattcccaccagcagtgtaaaactgttccctttacaccacattcatgccaacatctattattttttgtttttttaattatgaccattcttgcaggagtaaggtggtatcgcattgtggttttgatttgaatttccttgatagtgatgagcacgtttacatgtttgctggcaatttgtgtatcttcttttgaaaatattctattcatgtcctttgcccactttttgatgtgattgttttttcctgatgatttgtttgagtactttgttgattctggatactggtcccatgtcagatgcatagtctgtgaatattttctcccactctgtgggttgtctgtttactctgctgattatttcttttgctgtgcagaagcttttaaatttaattcagacccatctatttattattgtttttgttgcatttgctttgggttcttggtcatgaactctgcctaagccaaccaatgtctagaagagttttttaaagtatattccagggtttatatggttttaggtctcagatttatgtctttgatccatcttgagttgatttttgtgtaaggtgagagatgaggatccagtttcattcttctacatgtggcttgtcaatgatgccagcaccatttgttgcatagggtgttctttcctcactttacatttttgtttcctttatcaaagatcagttggctgtaagtatttggctttatttctgtgttctctccttccattggtctacctgtctgtttttataccagtaccatgctgttctggtaactatagccttgtagtatcgttcaaagtcaggtaatgtgatgcctccagatttgttctttttgcttagtcttgctttggctatgtaggctcttttttttgttccatatgaatattaggattgttttttctagttctgtgaagaattatggtggtattttgatgggaattgcattgaagttatagattgcttttggtagatggccattttcacaatattgattctacccatccatgagaatgggatgtgtttccatttgattgtgtcatctgcgatttcttacaccagtgttttgtagtttttcttatagatatctttcatttacttgtgaaggtgtatttctaagtattttatttttgtaggtgtcataaacaagtttgaattttttatttgattctcagcttggtcactattggtgtatagcagtgttactgatttgtgtacattgattttgtatcctgaaactttactgaactcatttatcagatctaggagctttttggatgagtctttagggtttcctaggtatacaatcatgtcatcagtgaacagcaacaatttgacttcttcctctttaccaatttggatgtcctttatttctttctcttgtctgattgttctggctaggacaaagagctgtttctaattttaaaaatacatgtgtccctaactcattttctctctcagttccagtgtctcgccccatcctcaccctcagggttcccagggcccaggctgtggtgggggacctgctggagcttcactgtgaggccccgagaggctctcccccaatcctgtactggttttatcatgaggatgtcaccctggggagcagctcagccccctctggaggagaagcttctttcaacctctctctgactgcagaacattctggaaactactcatgtgaggccaacaatggcctagtggcccagcacagtgacacaatatcactcagtgttataggtaagttgacctaaccagcagcacaaaaataaaaagaccatctcccctaactttaccagtagccaagatcagaggtacagtttctagagtcatttgctgtgtgacatcctgtcaggcttggtgcctacacagcctccatctctaagttttgtatcctacacgttcaggaacttgcaccttcccttcccttgctgtacttttcctgctagcagcagtccagccatcacgaccaaaattcccctaacataggagtaaaggctttcaaaatacaaactatattctggccaacagtgatagtaagaaagaaagttataaagttctgtgtgcttcaccttggaagagatttagttgtggttttctctgtctgccaatcaataaaaaggccaacacaattctcttattggctcacacatttctctctagcctctcctgcccctgtcccagagtgggttgggttcccacccaagacccttgttagaagacataattcttctgcctccttacctgctcctgttccattcagcaacatcaagatcttccatgcatccttgtcacaggcagactcctagttatgcccactctcagtgaaggctttggcactgtactttcagtctttctccatactccataatctgccatcatttcatgactctcatggtcacatgtataatccccttaacaccatggcctgtcctctccacaccagtcagccactcccacatacatacactacttcatctccaaaaggacaattttaagcccttattatctgacaaccaccccctggccttctgcttgcgtcagctcctcctatcactattgttctcagacctcaacagaactcccaggtcattaatacctccactaattccctactccactagacaataaccccctccactcccaccaccaaattgagtgtctagctctgtatccacccaataactcatctgtccttttcctaaaatatagaggagaggacttccctccccataggtgaacatctccatctggtctccagatttcatcattttgtgcattctcagaagctatgtaactgattatccctttctcttctgtggcccccaacatctctgtctctgtaggatcctttgcactggcacgtaacatggtatatctctcccatatccaaggaaaaccctctcttggtcccacttatacctccatacactaccccttcatggctaaacttccaaaaacagtcagttacccagactgtctccatgtcctcactatccactaggctctaatctactaggtttttccaacctctccaccaaaatgtttctcacaaaggtcaccgatgaccttcaaggctttaaatccaatggccatttttcaatcctcatcttccttgacatctcagatatattacatgttgtttaccatttcttccttcttgaaaccctcccttcagtgaatctatcttcttctggctctcttctctccctggccacttcttctcagtcttctttactggctcctccttttatagaaaacctttaagcactggcatgttccagaactttgacttatgccctcttctcttatctaaatcctttgtctggatgatcctgggtatgtcatgtataaatggccttgtcatctataaataatgattcctaaacttctatctctaaaagggacctcccacttgagcatctgcacatgacataccttcactcaaatatctcaaaagcacatcaatctgagcatttctaaaactgaactgctgacattcccttcctctttcaagggttcctacctctgtgaaacacatctcttctcaacagatacacaaagcaggaacagaggagtcttcctcaacatttctcttcctcacccctcacagccagttaatcattaagtcctgttgatttgacttcctaaatatttcttgggtctctatctctaccacctctatctagacaagtccaccatcattttgactactgcagtgccactcatctatccctcaattccacttccattccaccacagtccatttcatgcacagaggtcaaaatggtcttttaaaagggacaaatttgatcatctcacagccctgcatagatagacttatagacttcccattgctctgtgaagaaggatcaaaatcctttcatggcttatgaagtccagcctagatctccagtctcctatttcttggtagtttgcagaatcttctcagtgtgatgctactttatttcaaaaattcaaatgtgccagtcttattcccaactcagggcgtttgcacatactgtttgcctgcctggtgcactctccacctccatcatcaactggttaatttcaatgttaatttcaaagatcattttgtggggaagctttccttgactaacacatacatttcatagtaccctgtcctttatcaattatcaaagttttaattgtaatttactgtatttttatttaattgctgcctctcatccttctagattgtaggctctatgagagcagtaactatgtctttctcatcactgattccctagcatgtcatgccattcttgggacttattaaatgctcaattaatttttatttttgctcaattttttaaaaaatttttgttcaattaatttttgatggataaatgaatgtaaaaatgagcaaataacttgacaatactcattctcttgtgggccctatttctgatgcagcccagatgcaattacatccctggtgatgtaagcagcaagtctctcctgttcttcattttctgttgaactgatttctcctctctccaactgtctttttacctctaagacacctgagtttcagtttaatctttgttttcacattcttcaaacacatttgagtttgtatattccactattccaagctgtttatagcactacacaaatgttgttctttctggagatctgaaaatattgctgagttttgagtaatgtcacaagggcattaaaaactgagaaaaacattcttccatttgaaatgtctttagcatgaaggaatatattttagcagaagcagctgatacataacgtttttcctccctcagttccagtatctcgtcccatcctcaccttcagggctcccagggcccaggctgtggtgggggacctgctggagcttcactgtgaggccctgagaggctcctccccaatcctgtactggttttatcatgaagatgtcaccctgggtaagatctcagccccctctggaggaggggcctccttcaacctctctctgactacagaacattctggaatctactcctgtgaggcagacaatggtctggaggcccagcgcagtgagatggtgacactgaaagttgcaggtgagtgggccctgcccaccagcagcacatctgagaactgactgtgcctgttctccctgcagctgaaaatggagccacagagctcctcagggctgtttgcttgtgtggcatcccagcacacttcctgcctgcagaacctccctgtgaaagtctcggatcctttgtggtatggttccaggaatctgatgtttcccagcagtcttcttgaagatgatcaaagcacctcactaaaaatgcaaataagacttttttagaacataaactatattctgaactgaaattattacatgaaaatgaaaccaaagaattctgagcatatgtttctctgccgtagaaaggattaagctgtttcttgtccggattcttctctcattgacttctaacaagcctctactcttgagtctctttcattactggggatgtaaatgttccttacatttccacattaaaaatcctatgttaacataagctatgtgtacagcccttcaggagacacactcagcgatctttaaagcaagggacacaggtgaccagggcagagagtggggagcaggatgacatggaatggaaatggacatccatcacccaaattcctctattctcgaagctgttctttgatctctttcaattaagtgtaataacccaaggaaagctgcttctagtgagctctgaatctttttggtgatgacctcctacaagccaaactttgaaacctctgtttagagagaactggtgtttagcaaaagtatgctaaggggtgttgagatgaatcttctagacttggatctgaagataactagctgtatgacattggccaagcacctcttcccatactgacctcaatttccacacccacaaagtgggaaaatcagactagatgaaaatcatgatcatcctttgtcctagaattctatgattttggtagacagggaatatggattatgcagacgtacaggttcctagaaggagatatgcaaaagtaaaagcaggttgtacctgcccctggaatatatcctggagaaacacgagaccatacaatggtatgcaatcaccattccagtcatgtaaagcaaaatatacactgatgctcttattccctttggcaaggtgcctgggtatcataaggaatagacagagtcacataagcaggttgatctgggcatgctaacccatgatccagcatctcacaaagtagccagtgcaaccatctcattgttatccaggaggtgatgacttcagatttgggttttcccattcagtcagctcgttcttcttcccccaccagcagcaccaacctcatccaattttcctgagatttgcaggggctctccccacacagtttacacacctatcccttagagccagcacacaggcatgtaccacggaccgagggctgctccatctttcctcacaatacagcaagccaacacatcatacctcctacattctatacttatgatttcatgattttctgctcatcctcactccctcatttctataattctctgtcgcaaatgcatgttatttctgctgctgttatcacagctaaagggtttcttgcccagcctgaatgaattgtgtctgaatcctgaaactaggacccaggtcatagagaccaggagctgccagaaaaggaaatattatttcttattatcatcataaccagtgtcatcatcatcaacactcactgagccttcaccaggttccaggctctgtgctaaatgtttaataggcaacatctcatttaattattaagataaacctgtgaggataaattttaagccatcgtatcccctatttgcggaaaagagactgaggtttagagaagtgaagtaactagcttgcagacacacagctagccagggtaaagccaggttgaagcacagtcctctctaactcttcacattagtctgatacatgatgacattttctcatccgttgtggccacttttaacacaacattttagtttttagtaatttgttattctgaaagaacacatgaatgtttgtgatgaaaaaaatcaaataatacaaaagggccaatattgaaaagtaaaggtctctttctacctgctcatatcacttcttacgcacatattctccagacataaccactgttaattgtttcatgtgtatgcttctagaaataatctacaaacctaaaggtagataatttttagaaagctagaataatattacacatatagttatgccagttgcattttttaacttaaaatacatcctgacttttgtttaagaaatgcatcttggatatcattcatgtttcattacccaatccagtaggttgtctctaatttttagctcttgtaaaaatgctacaatagaaattcttgtagaaatatattggcatattttatgtcagtatccctaaaggagatggccctagaagtaggacttgaactcctgggctcaagtaatcctcctgcctcatactcccaaatcgctgggattataggtgtgagccactacacctggcccactagaagcagatttgttgggtcaaagtttatgtgcactttaaattttgtagatattgccaagttgccattcaaggaagtgtgttaaatttgtattaccaccaagggcatatgtaggtgcctgtttatctacaagctaatcagtatgatcagtctatttaagctttgccaacctgaaaaatagaaaaaagaatagtattgtatggttgtctttgtgtttagttaattagtaatgaagatgagaatctctgtatatatttattgtctatttgaagttttcagtgatttatacactttttacagttttctattggatatttttgtacactgaaaactattagcaggtcaaagtaattagctttatcatctatgttttaatctactttccaagattgagatatgactttttacatttgtttatgataccttttgtttcttacaaatatgttagaagcagaaactgctgttgactttttgttctctttcagttccggtgtctcgcccggtcctcaccctcagggctcccgggacccatgctgcggtgggggacctgctggagcttcactgtgaggccctgagaggctctcccctgatcctgtaccggttttttcatgaggatgtcaccctaggaaataggtcgtccccctctggaggagcgtccttaaacctctctctgactgcagagcactctggaaactactcctgtgaggccgacaatggcctcggggcccagcgcagtgagacagtgacactttatatcacaggtaagtttcccgtgcccgggccacagatgcggacaaaatgtttcctccgcggaccctctgataaccctcacagtgcttgatcagaaaggcactcctcagggcgaagtaacacagctggcagctctctaaactgctatatttcctgaagtgcttctgaagtgatggcgttggggctgagagcgcgggttggcgggctgggcgcaagagcgccactgactttagaggtcctcacctggctgcctcctctctcactggccaccggccaccctgaccctggacacttgtctcaggcgcagagacggcttcctcacaaagacaggagccatcttctgtgccacaccagcccctgcttagctgccggggacctgctcacctaggttcaccgtcaggcccaggcagcagcttccgggagcgggcagttccagaccacagcctctcctctggctcacacacagggtctccccctcagggctgaccgcgaacagaagtggcccttttgccacaggagtcgccgggggcctgctcagcatagcaggccttgctgcgggggcactgctgctctactgctggctctcgagaaaagcaggtgggtgactctgggcacaccttggcttgagttcatgcccttcccagcaacgctcccttgggcttcatgctgcctttgtgaccatcccaggctcgcaagagctcatccgctctgtccctcaatcctcttcctttcccgctgggtcctcccgaattgcttttaccaaatgcacagtttccaaaacagacctataaggtgggagacgtcttgatgagatgtagtttatccaacatcataaactacagagtgtcttcctctcgacccttataagacccccccaacgaatgggaagaggaggagaaaaactcagagaaatagaaatgaaaatagaaaccagataggattcagtaattttccgattttttaaatgtacactatttttatagttgatcaagtctgttttcctgccttggagattatctttaaaatctccaggttaaaggattacggattgtggactcccgtttcacatcatagcaaacccctctggcagggtcagtagtttttgcccaatctgctacctccctggggcataacaaagaaggattcaaccttcagtgacagcaactcctggcagtttctaagtgagccttgcctgagctgtgccccactgagggtctcatcttcctgaatccaatgctcctctgctttcctttacagggagaaagcctgcctctgaccccgccaggtaagagctgagctgcattcctgtgtgattagtgaaatgtccacagggtggaaaaatggaattgaatctgatgattaccaagagcacagtttctgccaggtgctgctgagctggggtgtggccactacctgttgtacgtccctggggatatcttaaggcaattcccaggacctttgcacccacccccttagctgtataggctgttatctcatcaagtattaattgccttttcatttattaacccacatccttggaccattgttggcttggttgtctgaatgaccactatgaccaccaagtctttccatatcttgagatgaccttagctcagtcaacctagaaatctctggagatgctgatctcatcaacacctcttgtgataacaactgagaagatggagccgcacaacttggccacccagagaggtcactctgccagcaggaggtagtccctgtgaagaaggggccaccatcttgtatccctaaggctgactttaggagccacacaaaggctcacagctatccctgggcaagcccacgatagcagcatccaaacatgtagagcacctcggagccttctggtcactgatctctctgagcatgcagggttcggagccagctttgagccttggctcatcccctttctggttacatgatcttcataagtcacttattggagcctccgtttgtttcagctaaaacgaggatgaaatagaactaacaacgtattgctgtaagcatcagcaccatgcctgttacacactagatgaccagaaagcctggaaacatatataatatgattatgattcataatagaatgcccatggtcagtttgttatgtacttgttcatgtttccaggcctggcagccaccctgcagtaagaagtcactcactaggagtgatcattatagctactttgtctggattcctaagaaacattcacatttctctgtctcacaggagcccttcagactcggactcccaagagcccacctatcacaatgtaccagcctgggaagagctgcaaccagtgtacactaatggtgaggcccgaggatcctgcatttggcagaagctggagggctggtgtgggaaagcggtggggcaggagatggggagggactatgccgaggcctagagggctctagtccttccagaaaagagactctggctgggggaggaggaagtatctctaacaagaggcaagaacctcagcatcctctgaaacttcaacttttttctaagcaaatcctagaggagaaaatgtggtttactcagaagtacggatcatccaagagaaaaagaaacatgcaggtaagacccaaggatgtctctgttctggcccaccctcaacttagacagtatagctcagtttctacccactcagcagatctgagccagacaggcatagagccgcccctcccactgggtcatggggcttctttatgtgtgcctatgctgcttcaggtgaatccaagcctcccctgcactctcctttccctattctctgcagagggccccagtataacctgaataacaaaactatctttttgggcattcgcttaacctctcagaccttccatatccctatccataaactgtgactacttccctactgtcttagtcagttctggctcctgtaacagagtaccataaactaggtgacttaaagaactaatatctatttctcacaattctggaggctggaaatccaagatcaaggtgccagcatggtcaggttcttagtgagggccctattcccattttccagacagatgactccttgctgtatcccccacacagcagagagagagggagagatcatctttcatgtctcatcatgataatcatcatgacataattgtcacccaaaggctccacctccaaatgccatcacattggggattaggttttaacccatacatttggagagcaacacaaatatttagttgatagcacctacctacctgtactagtttctgattgctgctgtgacaaatgaccataaatttggggggatgaagcagtacaaatttatcatcttacagctctgtgggtcagaagtctgacgccggtctcactgggctaaaatcatggtgttggcagggctgtgttcctccctggaggcccatccactttcctgcacccatgtccccttcctttcccaaagccagcaaagtcacatttctctaatcattcttccatagacaggcctccttctgacctcacctgagaaaagtccttgggttttagagaatcatatgagtatattgggcccatctggataacccagaataatctccctatctcagggtctgtaatcctaatcacatctgaaaggtcctcttttccacttagggtaatatagtcacaggttgcagcaattagggcgtgacatctttgggggcacattattacagctaccatgctgtttcatggggtaactgtggggactaaatgagaaaataggtgtggaaatgctgtcgaaactgcagagggttgagcagctgtgacgatgactacatgctggaggtctggctatgtcatcaaccctcactcacagtcggtggtttgaaatgagggaatcccagcccggctgcctccttactcggagcaggaaagaggaacaaagtccttcacggcaggcttttctttctacctctgcttcataaaaagtgctgcgtgattttagccagtgtgcttccctctctggttttctaatttttcttatataaagtcaagtgaattgtgtttgtgcctcattcttggttctatagcacccctctgagacatgtgaactcattcactcttacaagcccctttgaggtatgcgctgttactactcccattttacagatgaggaaaccaaggcatagacaccttaaatgacttgcctgaaatcttatagtcaatcaccaaacagtcttctccagagtccaaactctagaccaaactctgcttcttcatgcaattccagggagtcctgatgctcattccaagccaaaagggcagagccttgtctggagaatgtcatatttctctccagtttgatgataatataacaataataatttataatatctatcatgtgctgaatagttcctattatgtgctgggtatagttctataagtgcgataaataaatacactatatttgtatggatagctcttagaactatacctgtagcacttatatagaactatggcatgcatacatatgataatagagagagagaaaatgtattgaatatagcaatcaggactgtacctgacacatagaaactgctcaatacatgacagatgatagaaataatatatgcacagacacacagatacatgtgctcacacatatgtgtaaactcatatagcttcaccacaaccttacaggcagaggatatttttattcccatcatatagatgaggcaactgaggcaagagatgttgagtgacttcccccaaccacggaggtgacaagacaggcggcaggctcagtttcaggtggtctagaccctgatggagtgtgctctctaaaacttgcacccaccacaccttcccagaacaataataccaattatgctcaaataactaacaagataaaagacaaatgactttctcttgagggcctctaggcagctcagagtgggccacaaagtgtgaaggggagttgaagagagggtctgtcagtgctgagaggctgagggagttgggaatggagagggactgggtgagcaccaactaagaggaatggctactcaccgcacagagggagagcgggcctccaggaggctcagggctggccccacagcgcaggcacaagggaagagccccatgccagtcttccacaactgaacactttcctctttccacagtggcctctgaccccaggcatctcaggaacaaggtgagtctccccttctgcatgccctcccccacccccaggcccaccctggtcctcacgcatgtgctcttgcctcctagggttcccctatcatctactctgaagttaaggtggcgtcaaccccggtttccggatccctgttcttggcttcctcagctcctcacagatgagtccacacgtctctccaactgctgtttcagcctctgcaccccaaagttccccttgggggagaagcagcattgaagtgggaagatttaggctgccccagaccatatctactggcctttgtttcacatgtcctcattctcagtctgaccagaatgcagggccctgctggactgtcacctgtttcccagttaaagccctgactggcaggttttttaatccagtggcaaggtgctcccactccagggcccagcacatctcctggattccttagtgggcttcagctgtggttgctgttctgagtactgctctcatcacacccccacagagggggtcttaccacacaaagggagagtgggccttcaggagatgccgggctggcctaacagctcaggtgctcctaaactccgacacagagttcctgctttgggtggatgcatttctcaattgtcatcagcctggtggggctactgcagtgtgctgccaaatgggacagcacacagcctgtgcacatgggacatgtgatgggtctccccacgggggctgcatttcacactcctccacctgtctcaaactctaaggtcggcacttgacaccaaggtaacttctctcctgctcatgtgtcagtgtctacctgcccaagtaagtggctttcatacaccaagtcccaagttcttcccatcctaacagaagtaacccagcaagtcaaggccaggaggaccaggggtgcagacagaacacatactggaacacaggaggtgctcaattactatttgactgactgactgaatgaatgaatgaatgaggaagaaaactgtgggtaatcaaactggcataaaatccagtgcactccctaggaaatccgggaggtattctggcttccctaagaaacaatggaagagaaggagcttggatgaggaaactgttcagcaagaggaagggcttctcacactttcatgtgcttgtggatcacctgaggatcctgtgaaaatacagatactgattcagtgggtctgcgtagagcctgagactgccattctaacatgttcccaggggatgctgatgctgctggccctgggactgcactgcatgcatgtgaagccctataggtctcagcagaggcccatggagagggaatgtgtggctctggctgcccagggcccaactcggttcacacggatcgtgctgctccctggccagcctttggccacagcaccaccagctgctgttgctgagagagcttcttctctgtgacatgttggctttcatcagccaccctgggaagcggaaagtagctgccactatctttgtttccccacctcaggcctcacactttcccatgaaaagggtgaatgtatataacctgagccctctccattcagagttgttctcccatctctgagcaatgggatgttctgttccgcttttatgatatccatcacatcttatcttgatctttgctcccagtggattgtacagtgatgacttttaagccccacggccctgaaataaaatccttccaagggcattggaagctcactccacctgaaccatggcttttcatgcttccaagtgtcagggccttgcccagatagacagggctggctctgctgccccaacctttcaaggaggaaaccagacacctgagacaggagcctgtatgcagcccagtgcagccttgcagaggacaaggctggaggcatttgtcatcactacagatatgcaactaaaatagacgtggagcaagagaaatgcattcccaccgaggccgcttttttaggcctagttgaaagtcaagaaggacagcagcaagcataggctcaggattaaagaaaaaaatctgctcacagtctgttctggaggtcacatcaccaacaaagctcacgccctatgcagttctgagaaggtggaggcaccaggctcaaaagaggaaatttagaatttctcattgggagagtaaggtacccccatcccagaatgataactgcacagtggcagaacaaactccaccctaatgtgggtggaccccgtccagtctgttgaaggcctgaatgtaacaaaagggcttattcttcctcaagtaagggggaactcctgctttgggctgggacataagtttttctgctttcagacgcaaactgaaaaatggctcttcttgggtcttgagcttgctggcatatggactgaaagaaactatgctattggatctcctggatctccagcttgctgactgcagatcttgagatatgtcagcctctacagtcacaagagctaattcattctaataaaccaatctttctgta

SEQ ID NO: 584 - DNA, 71824 bp, Homo sapiens
cgcggtttgtccgcgcctctgctaccccctgcgcaggcgctcaaggagctcttggactccaggttcccgcggctgggagaaaaggaggcggggatccgaagggggaaatgactctgaggcgcccggacgtcgctcggaagccaatcagagagcgtgacgtcagtttggcgcggagtttggcggccggggcttacagtggcgggagttggaggcgataacgatttgtgttgtgagaggcgcaagctgcgatttctgctgaacttggaggcatttctacgacttttctctcagctgaggcttttcctccgaccctgatgctcttcaattcggtgctccgccagccccagcttggcgtcctgagaaatggtgagtaacggtcccaaccgctgctcggagctggcggaattcatttcccccgaaacacacgccacctccgaccagggccgactccaattctgaactcagcttctgagttctcccatggcaagggtaaattagtgttagcagggactactaaagaaagctgtactttcatcccctcgggacacttgtaatcgtaatcgggcttttaaaatcgtaacgtaggcagggacgtcgaaataactgccttccaaggccccttacagcttacatctccattgcgcgttaacgggaaaatgcatgcatttgtgtgtatatgtttccttcaacggttatttgagatgctcaaaactcctaatcattgattaattcattcgtttgttgtagaatcttagtgagcccagctatgtgctataggtatataccagtgaatatgacccgctgttaaggaactcagtcaagcagagaagacaggatatctgcttctaacaggaacaaaatcttattttccccgtttactacacggtcataaaaatttaaattatagagtgaaagatgcctgtaaccacatccgccagagatgacccctgttaatagattgaagtatattattccagatgttttcgacgctagaggtaatacctattattttcagaaatcggatcaaaacgtccagttttttcactttaatggtataagttgaacgtattcccatgttaatacgtagaaatctaacttattttcttacgctaaaacattggcaataagagatttgaggttagatttggatgtcatcaacttaaactttttggtaagtttcagataagggagctaactacccagattaaccttggacagaaataaaatctcactcatgtgaaggtcgactatagccagaggttctttttccccttgaaactatgtggaaaacgaacctgagaagggaatttttatattcagcgatgagtctaggaaaataatattgagaaagagactgagaagtagtccctcaacttcctgctagcagtctgaaactttataccatccttatttatttccctcttagataatctttgtaattatacttaaatgctcctctttctgtctctcctgggaccttgtttgagtaacttctttgtcctctgtttaagagtgacagtacgcacagtggctaagaactctgtctttgaagttaaactgcctgggttttattatacttccacaccttactatatgtgtgttctgggggagctgttcagcctctattttgtgacagattttctcctaattctccatgtgtttacctttcccttccctctttcctattctcaagtactcattcgttgttacataatagtcactgaaattcattcgttattatatgaaatctatagaatcatctcctttcctcttcagtgttggtgttccatccttgaccccttttcttcttctacctactcctttggatgatcacagccacaaccagggcttcttccacttctacatacatacaaccttctgttacttatatagtaagtcctcacttaatgtctagataggctcttggaaactgtgactttagggaaaacagtgtataactaaactaactctaccataggctacttgatataaataagaattgtttcagtggcatattttggtcacacaaacaccaccgaacttctaaagaaagactcaaagtacttttaatattaaatgttgaaataattgtgtgctatacatatatttgagaaagattaataaaaacaggtgagataattatccaagttttggtgtatcagcgagtgacctcggtcatagtggtggtgggctaaatcaaggaataaatgtttgcaaagtgaaaattggaaggagcacctcctaccaccacccaggtcaaaaacaatcacaaatatggcagctcactgagccctttcataccaaatcgtttattgtcattcatttgtatgattattgtaaagtttacccatttttattttacaatgatttgtattcattcattttctgacacacttattccagctcagggctgtgggtgcccggagcctatcctggcagctcatggtacaaggtggaaaccagctctagaccagacactatttcatcacaggaagcactcacacacactcattgtctactgggaccatgtagacacaccagtgaacctaacatacacatctttggcatgtgggaggaaaccagagtacctggagaaaacccctatgaacatgggaagagcatgtacaaactccacacggccaatggcctcaaacaggaattgattttttcctcatgaacagtataacgaaatgacattgtacaaaattatgttattggaagacttcctgtacctgagattcatttctataaaagctgtgtgggttgattagcacctagacggtcaatcccacaagcatctcaaactcaaatacccaaaactgaactcagcttttcccccaaacctgcaatattaccaattttagagagtggcctcattatttaaacctgccagaaacctgagtaaattaaagacttcttcatcttcctcacagttacacattcaaaacatttcgttaaaatctcttgaatccatcctctcttctttatctgttatgattatgcatctttactgtatgctggatgtgttctatttttactattccatttccctaggttgggccctaatgccttcttgtctggattgtaagaagtctcccagatggcctcctagtttgtctgtcttcggtttattctccacattgctgctaatgatccttctaaaatggaaatctgattactcttctgtgtatttttaaattgatatctaaaagtttttattataaacttaaacaaatgcaaagaatataatttctgaccatattgggaatattgacattttaaaaataaaaatgctatatcactcctttaagtgtatctaatataatttaaatactatagtgatttgataatcacatcatccattttttagaaaaatacaaactcctctttatctgctggacattccatatagctgctttttcctcttgaatttatttccatttcatttctcctacagaatttctcctaatgtaatttaattttatgcttgaaaagctcttttactgatcactctgtcatacccttctgtgtcaaaaaatgtgtttaaattgctgttttctgtcataagcctccaagtattaaaacttctttatggattgaattttcaattcaattattagtactatatgattgattaaaacaatatagattaccaattttgataattattaaccaaaagtaaaattttattggaagtccatctttttaaagagatgaatttgggtgtttatggtccctttattgaaggaattatttaattatctcttagttaaggttccaccagtttatttgtttttatttaaaaatatttgatacccaaaagtttttattctttggatcagtgcaaggtttaagattggggcacgggaatgcctttcttttataaagtggaagaaaggaagtgatgaagggaaagggaaaaagtggtacctcaaccttctcagagacatcaggtttttcagacaggtgagttttagaaatgcgtatatagtcatccaattgcttataaatggagataacattttgagaaatgcatcattaggtgattttatcattgtgcaaacatcacagagtataaacacaaagctagatagtgtaactactacacacctaagctatatatttttcctaggctataaacctgtgtagcatattactgtattgaataccgtaggcaactgtaacacaatggtaagtatttgtgtatttaaacatagaaaaggttcagtaaaaataggatataaaagataaaaaatggtaacacctgtggagggtgcttactatgaatgggagcttgcaggactgggggttgctgtgagtgaatcagtgagtgagtagtcagtcagcacgaagacctgggacattatactactgtagactttataaacactctatacttaggctgcattaaattgattaaaaaatactttcttcaataataaattaaccttagcttactgtaacttttaaacttacaaacatcttaaattttttaactttttgacccttgtggtaacaggtagcataaagcacagacacattgtataattgtacaaaatattttatttcttcatattcttattctataagtttttttattttaaatgtttttcttttcttaacttttcaaaccttttgttaaaaactaagacacaataggaatttttaagctccattataatgttgtaagactaccattgtgtatgcggtctgtctttggccaaaatgccattacatggcatatgactgtatatcgtagttgagtacagtagtacctccttatccttgaaggatatgttccaagacccaaccctatgtatgctgtgttttttactatacagacacatacctatgattaagtttaggcacagtaagagattaacaataactaataataacatagaacaattataacgatattctgtaataaaagttatgtgaaggtggcctctcggaatatctcatggtgctatatacttgcccttctcatgatgatgtgagatgatataatacctacaacatgaagagatgaagtgagatgaatgacgtaggcaggcactgtgatataacattaggctactacttccaactatgtgacagacaaagcagcttctatgtgatataacattaggctactactcccaactatgtgacagacacagcagctaagtgactaaagagcaggtaacgtctatggcactgctactctggacacagggatgattcatatcctggacaggtcagggtaggacagtgtgaaattttcttgccactcaaaatggcacacaatttaaaacatgaattgtttatttctggaattttcagtttaatagtttcagaccgttgttgactataggcaactgaaaccacaaaaagcgaaaccacgggtgaggggtaactactgtatctggaaattgagtctctgaaaactctcatgttcttgtatactacttggaatatgtgcatgtaactccaggggcttaagttgtacaatgaggaaataatagctttttccaaatgtgttgtggaggaaagcattacagtttcatgttcataacacaataaggatccaaaagtagcttagggtggttcatcagtgaagtgtgtattgcagggattgcataagtagaggggtaggcaaggaccaatcactcaccattcattggtgtttggatgttaattataggcagtgaggcagagttaaagagtcattgtttaattgtaaaaaattgtaggttttttggagtgtatcatcttcatttcaaccaagttgttcaaaagtcccttttgagtttttattttgcagttgatttttttttttaattccaaaacgtgtatatttacataacctttgaacagaggcttttgtttttacacacttattccgtaggttaatacttgtgacctcaacataactattgcatttttggcgggggggtggggggtggggacggagtgtcgctgtgttgcccaggctggagtgcagtggcgaggtctcagctcgcggcacgctccgcctcccaggttcactctattctcctgcctcagcctccgagtagctgggactacaggcgcctgccaccacgcctggctaattttttttttatgtatttttagtagagacggggtttcaccgtgttagccaggatggtctcgatctcctgacctcgtggtccgcctgcctctgcctcccgaagtgctgggattacaggtgtgagagaccgcgcccggcctattgcattcttttagtggtctttaacagctcctttacaatgatatgtgatgctgaaattatgacgtgatggccccagaactaattaaatttggattaaatttctttggtgcccttctgttgattcattcagattatgtctatgaacatccaaatgtagatttgtctgaggttatgtcaggctaagatgtattctccacatagtacttttgatgaaaagtgaggattcagagtaccctaaaatgtgagtttgttaattatttaagatgctttcaatagattgtaaactcagtgtttcctccaatgcttattgaacatttggttttcagtaattacttgttgaatgaatgtttattttatatatttaaaatgtcttgatcacaaatcagtataataaaaacaaatctctgaagatgtctttactatgtaggagcatagtgcacattagacctctgacccaagcagaataaacttttcttctaccctgagtctcttgttctctgttctaaattcagtgaaaatttacccatctttcaagacctcctgtaaagactccctgacccactaccactagccagggctaattaaatgttttctaggggtaggtacataacacttcactttacaatttctctaatataatttaaggtactataattgctgctattgacattttagattcctacaatttcagcactaaaggaaaacagaagtaaatttggtgaatatgttactggctatagtagctgcattgacatattattttctttggctctttgaccattggattttgtatgatgttctggaataagaatttaattgaaggggatagcagttttaatggaatgcttttgtggttgtctctttggtaggagaagggggaagatctttcttaatatgcagaggcctcttgtttcttctaatctcaatgtactagtgagagtctccattttagatagtaagcccaaagctatacctccccagaagttggaagtgctctttcattttttccttaggactccttaatgaaataacagaaatggtgtcttccatagatattaatagtaagtggatctatgttaatatctaaagtttcttaaggacaaatatttacctctgaatttgttaaaaatgctgaaatgtgatgctgtattggaattctataaggaattatcttgttttaggatggtcttcacaataccctcttcaatcccttctgactggttatcagtgcagtggtaatgatgaacacacttcttatggagaaacaggagtcccagttcctccttttggatgtaccttctcttctggtaagagaattactatctaggcaaggcttggacagaaatgatctatttcacacttatagggaaaatatactagagtatttccctttcaaagaaaagtaaattaggtggatgttagagtttttgtaaaaactgttatcttctgatttataaaatagacttttcttaatctctatacatcattagcataactatatttcctctaaagcataggactattatagcactatttttaaaaaatcaatataaggaaggggttgcaaaggttcagctactatgaaaactgttttatccagtagatacataccctttgatctggttgaatgtatctttctgtgactcattggggaatatatgaacagaaatagaagtacttcagccaggctcagtggctcacacctaaaatcccagcactttaggacgccaaggtaggtctgggcacagtggctcacacttgtaatccccgaactttgggaggccaaggcgggtggatcacttgaggtcaggagttcaaggcagcctggccaacatggtgaaatcccatctctactaaaattgcaaaaaatcagctgggcgtggtggcgcacccctgtaatcccagctacttgggatgctgagacaagagactcacttgaacctgagaggcagaggttgcagtgagccaagatcgtgccattgcattctagcctgggtgacagtgagacttcatctccaaaaaaaaaaaaaaaaaagaaatagaagtatttgtctccacccataatagtttgagaggaaagaaaaagttgtgacaaggaaatttaaaactaatagactccttataaaaattagccgggcatggtggtgcatgcctgtagtcccagctactggggaggctgatgcaagagaatcgcttgaacctgggaggcggaagttgcagtgagctgagatcacgccactgcattcctgcctaggtgacatagcgagactgtctctcaaaaactaatagactattacatagtcatgattgtggtaaaaataagtaaataaaaatatggttaaaaaaactaatagactcagcctgctggcagcctacatcatcatatgcctttgtttgccattggccagtaccactcttgttttaagtactaccctcgatttagcccttctctaaataagagattatctgaagaaaattttggtggttttgagtaagcttaaaaatttttgtagctaggcatggtggctcacgcctgtaatcccagcactttgggaggctgaggtgggtggatcacttgaggtcaggagttcgagagcagcctgaccagcatggtgaaaccccatctctagtaaaaatacaaaattagctgggcgtggtggcgcatgcctgtaatcccacctacttgggatgctgaggcaggagaatcacttgaacccaggaggtggaggttgcagtgagccaaactgcactattgcactccagtctgggtgacagagcaagactccgtctgaaaaaaaaaaaaaaaattgtgttactctatatatttttttctttatttctgctttagctcccaatatggaacatgtactagcagttgccaatgaagaaggctttgttcgattgtataacacagaatcacaaagtttcagaaagaagtgcttcaaaggtaagtctaggtctacaatttttgttttaacatttaaaaaactttacacatcctcaagtatattattatttgaacacattctgttttagtctgtcttctgttgctataaaggaataactgagactgggtagtttatatagaaaaagtttacttggtgtgtgattctgctggctagaatagtagacatctggtgaaggcctcaggctgcccccactcctggcagaaggcaaagaggagcccatgaatacagaggtcacatggcaagagaagggtgtactaccaagctcttttttaacaatcagctctccagggaactaatagagtgagaactcactcatcttttcacctcttagggagggcgttaatctgttcatgagggatccacccccatgacccaaatgcctcccattaggtcccacttccaactttggggattaaattataacatgagatttgggaagggacaaacatctgtagtatatataacacattcccaatgatattaacttctgattaagtctttttagggaccagattagatgtgaatggtggactgcctatctgtcaataactgttaactgtgacaatgcctttactcaaagttaagaaaaatactttttaggattaaaaacaattcttcaaaaagttaaatctttaacacttaatgtgattagagaagtgttgctttaaaatacttatattaatcaagcatttttcatgtttaaagcaaagttctaaccttaagaagctgataatttggaacccataagtcaagtgttgaaataactgaaataaaacaaagactataaatgatgtagaagtagaaagaaaacacactggtgtcaaagagaaagctctcatgtagtaaagaaggctaggaaaacttacgaagcatggggcatttgagttggattatggtatttagaccagtggaaatggaagggggcactccaggtgacgggaaaagcattagcaaaggtctagagatagaaaagcataggatataataggaagtgaccaatttgtttggaataaggtatcgagaacagtgagagatgaggcttgcaaccaagataaagactaaagaatgcaaaatgttgaatgtcaaactaaagtattttacattccattcagagagcatcatgaagttctttttgtttttggttttgttgttgttgttgttgttgttgttgtatttttggtagagatggggtttcaccacattagccaggctggttaactcctggcctcaagtgatctgcctgtcttggcctcccaaagtgctgggattacaggtgttagccactgtgcccagccagtatcatgaagatttttgaactggaatatatttcagaaagattccattgtagagaatatattactagtgaactcatggaaaggaatttgacatcagatggtagtagttctcatgtggtaattaagggaatgtgtaatttctgtgagtccacaaattctctttgctcatgccaaagggtgctgactactgattttttatgtgtgcatctttatttttattattttaagttccagggtacatgtgcaggacatgcaggtttgttacgtaggtaaacatgtgccgtggtggtttgctgcacataccaacccatcacctaggtattaagcccagcatgcattagctatttttcctgatgttctccctctccatgctccccctcaagaggccccagtgtgtgttgttcccctccctgtgtccatgtgttctcgttgttcagctcccacttatgagtgagaacatacggtgtttggttttctgtttgtgcattagtttgctgaggataatgacttccagctccatccatgtccctgcaaaggacatgatctcattcctcttatggctgcattgtattccacagtgtatatgtaccacattttctttatccaatctatcattgatgggcatttgggttgattccatgtctttgccattgtgaataatgctgcagtgaacatatgcatgcatgtatctttataatagaatgatttatgttcctttgggtatatacccagtaatgggattgctgggtcaaatggtatttctggttctaggtctttgaggaagcgccacactgtcttccacaacggttgaattaatttacattcccaccaacagtgtaaaactgttgctatctctccgcagccttgccagcatctgttgtttcttgactttttaaataattgccattctgactgacgtgaaatgatatctcattgtggttttgatttgcatttctctaatgatcaactactgatctttttactactacagctttccaggcatttaaagttatattaatatgggtaccacagaatacaatttagacatttcacatttaccattttctttgtttagaatggatggctcactggaatgccgtctttgacctggcctgggttcctggtgaacttaaacttgtaagtgactttatttcattaggatctgggtaaatactgataagggagtgctttattaaattgtgtttaccttatttttgaaaggttacagcagcaggtgatcaaacagccaaattttgggacgtaaaagctggtgagctgattggaacatgcaaaggtcatcaatgcagcctcaagtcagttgccttttctaagtttgagaaaggtaggtttgtgcttatcttctttcatctccttaaccttctttgcagttgggagataagaacctgtaattgtttctaccctttcccctgtcaaagttactgctttacctacatagatgattaagattctttttttggagacagtttcgttctgttgcccaggctggagtgcagtggcgccatctcggctcactgctacctccgctgcctcccaggttcaagtgattctcctgcgtcagcctccggagtagctgggactacaggcgcacatcaccatgcccagctaatttttgtatttttagtagagacggggtttcaccatgttggccaggctggtctagaactcctgagctcaggcaatccacctgcctcagcctcccaaagtgctaggatcacaggcgtgagccgctgcacccagccaggtgattaagattctaacatgactgaaaaccttaataaaattaaattggttttaggcccactcttctggacattatctctagcttgtccctgaaagtcaagagtctttgataagtttttctgtaatcttgcacataaggtaaagatttataaacagctacaataccattgttcaaccttgattgttcattgaagttaaaaccttgtactgggcactcattaactatttgtaaaacagagttactttaactctgcttgtaaaatctaaatgagctataaggctgataaacaacataatttttttctacctaaaaatttatcatgtatttggtttaaatggcctgttttttgttttttgtttgtttgtttgttttttgagacggagtctctgtcacccaggctggagtgcagaggctcgatctcagctcactgcagcctccatcccccgggttcaagcaatcctctccctcagcgtcccaagtacctgggagggattacaggagcctgccaccacgcccagctaatttttgtgtttttagtagatctggggtttcaccatcttggcgaggctgatcttgaactcctgacctcgtgatccacctgcctcggcctcctaaagtgctgggattacaggcatgagccaccacacccggccaaatggcccaattttctattatgttttcaactattacttaaaattgattttcctatgtttatattgttataatggacaaggaagatttaagagttatataacacagcacagtactgtagcagctagggaaaaacttatcagtggtgtctgaataagctcttcatttctgtttttgtttgtttgttttctccttccatttgtttctcactaaataattttttttaaatggaccaacaaacatttctctcaaaggagtctctgaagtaatctgactttaatctctgaataatagtgacagacattacaatctcctttatcactaaaaaaaaaaaaagtactctgttttaaaaatcaaatgttttcatttattcacctgagccatttaggaggttaagctggtttggactggttttttgtttgtttgtttgtttgtttgtttgtttgttttttgagacaaagtctcactctgttgcccaggctggaatgcagtggcgtgatcttggctcactgcaacctccacctcccaggttcaagcaattctcatgcctcaacttcccaagtaactgggattacaggcgtgtaccaccacgcccagctaatttttgtatttttagtagagacagggtttcgccatgtcggccaggttggtctcgaactcctaacctcaagtgatctgcccgcattggcttcccaaagtgctgagattacaggcatgagccaccatgcccagcctggcttggacttttaagaaagtcggttttaatttactgtggttgcagttgaaactggaaccttgaaggggaaatatggcatgatttttcttatttctgcataactttattaacatatttaagtagttaggtatgcttgtgttctagttttctacactcttgtgtcatagttcactctgagtttgtaaacataattttaagataatgaaaatttacctaactaaagagtagtggaaaacatatcttttggtccttttgcttaatttttacaactctgcatgtgaatcagcctgtgacaatgagctgtagaagaaaaggcactgagttagagattggggcaggtggcttttttcatgattttcagtagttcataggtactctagtgtaaattagtctgatcggatactgctcccaagccctgtggtttgttttgttaaaacagaatagataatagctccactcactccatcagccataagccctcttgcagggcaaacctttgcaactaaacatggaagccctctgttttattctggcctcctgggcaaagtgattttaacctccttgggccttcattttctaattttatgagataaatacctagtctatttaggtcacaaaaatattgtagacataaaagtgaggtgaaatatgaatacttttttttttttaatctgagctcattatggtggctcatccctataatcccagcaacttgggaggctgagaaggattgcttgaggccaggagttcacgaccagcctgggtaacatagtgagaccctataagaaaacagaaaattagcttggtacagtggtatgcacctatagtccgagctacttgggaggctgaggtgggaggatcgcttgagcccaggagtttgcagctgtagtgagctgtgattgtgccatcatactctagcctgggcaatagagtgagacccagtctcaaaataaattaattaaatcaatcgatctatctataatcaatcagaggaccatataaatacttagtgttttgtgggggtttttgtaggtagtatggtagaaaacatctttggtccagttccttccaccctacataggtaggatacaaataatcctaactggacatagtcacactaatggaatttgccttccctaagtatctaccaactaaaagcaaagaaaatggactcagataagtgctttgtgtggcaaaagggcaggtattagaacttctagtggataattaaaattgattataaatttatttcctctcctacaaacttacctatatttacaccttctttctcattcttcattctcaagttttaattaaatgagaatctcttgcaagtgggccaggcatttattttttcaaagttcctcaagggatttcaatgtgtagctaaaattgagaaacattcttgatccttcccaagaccttccaccatcacatgtatccccactaccctgtatcttcaagttctccctctctattggctgtttctccttaggagaagatatttggcctattttcccaaatatcttaaccctgtgttctcttttagttgttactgtttcatattttccatctcctttaatttggtttaatctattttccacatctagccctcttcctgaaatcactcttgctaaggttattaattatctaattatcagaaagcacgaaacttttcaggtcttttcttctgcttgtataatatgttacacttttggtcttttatagaatttcaataaaagtctttgcttagaatctgtgatatcccactccctctggtactccttctgtccttctctttattctttcatagttgcttttacctaggttgaagtgttagcaaggcccaggatttggtgtttagcctttttttgctttcaacctataccttcttggacagtttcatctgtaccagttttgttttgtttttcatcctacttgtgttgacccagatctatattcctagccttaacctttctgcaagtacttcagattcaacatatcaaaaagtgaacccacaattcctccctgaactcatgatttctccctggcaatgccatctttttcctctcctctgatatcatttccttgaacaacgtatttaacttttcttatagtgtgagtctgatggtaataatttaccttagtttttctttacctgaaaatgtccttatttcatcatcattctcgaaggacatttttgttggatatgaaattcttttttttttttttttttttttttttttttttttttttttttttagcccagaggtcctttattttttttttttaacacctattatgccatgaattcatagggaataggttccagcagctcaggctccttcccattggttctcacaaagtgtgcttctctgggtggagcaggctggcgctttagttgaacccaggtacctttctctttggcttctttctttttctgatcattttccttcacacgtttcaggaagctatctcggctcttagaatgcttaatgtgctcaatacgcacattaattctcttggcaagaatcttgcccttaacttgtttgtttacaacaatgccaacagcatgctgggtaacattgtagactcttccagttttgccatggtaacacttgtggggcattcctttttgaacagtacccgttcccttgatgtctacaatatcacctttcttatagattcgcatatatgtggccaaaggaacaactccatgttttctaaaaggcctagagaacatatatcgggtgcctctcctctttccctttgtgtttgtcattttggcgaattactggaagatggcggttccggccgaaaagaagctggatatgaaattctgggtcaacagcttttttttcctttcattgctaaagttgttccactatcatctctgctttcattgagaactctgtggttgttaaaatcatttccctgtatataatatgctgtttttcctgactattttcaggattttttgtctttggtttctagcagtttgactgtggtatgtctagtcatggttcccttcacagttttcctgtttgaggcttgttttagctttttgtatttgtaaattcctttttactgaataggaatttttctatcatttcttgaaatactttttctgggccaggtgtggtggctcaggcctgtaatccaagcactttgagaggctgaggcaggcagatcacctgaagtcaggagttcaagaccagctaggccaacatgatgaaatcccatctttactaaaaatacaaaaattagccaggcgttgtggtgggcacctgtaatcccagctactcaggaggttgaggcaggagaatcgcttgaacctgggaggcggaggttgcagttagctgagatcgcaccactgcactccacactccagcctgggcaacagagcgagactctgcctcaaaaaaaaaaaaaaaagaaatattttttctgcctaatttattcatattctctctcctccctgcttcttctgttaccttaattacccatatatatatattttttttcaattactcatgtatttgacttttctaaattatcccatgcatccttgaggttttgttttttttcagttatcctaaacttaagataaaatgaacaagccataaaattcatccatttaaagtacacggtttagtggtttttagtttattcactaagtcgtgcagctatcaccacaatctaaatttagaatcttttcatcagtccaaaaagaaacttgaacgcattagcagtactttcacccattccttccaaccttatacaaccactatagtaatttcggtctctatagatttgcccattatacacatgcatacaaatggaatgatacaatatgtggtcttctgtgactggcttctttaatttagcctaatgttcagttctatttttctctctcttcttcaaattgaatgatttctattaatttgtcctaaagttcactttctctattttctccagcctgttcttaggcctatccagtgatttttttttttaatttcagatactggttttcagttctaaaattttcttatgttttttttaagacagggtctggcactgttgcccagattagagggcagtagcatgatcataggcacatgccaccatgcctggctaatttctttttgtattttttgtagagatggggtttcacccatggttggtcttgaacttctgggcccaagggatctgtcaaccccagcctcccaaaatgctgggattacaggcatgagccacagtggctgaccttcatttgtttgtttgtttgtttgtttcctgctgagatttatcatctttttattgattacaagtgtatatatttttttcttcctttttttgttttttgttgttgttgttgtttgagacagggtctcactctgtcacccagtttggagtgcagtggcgaaatctgctcactgcaacctctgcctcccgggctcaagtgatcctcccacctcagcctcccaagtagctgaggctataggtgcatgccaccacacccagctaatttttgtattttttgtagagatggggtttcgccatgttgcccaggctaagtgtacgtttctttaactcatttaacatggttatgtatcctttacaaccttatctgataaatcaatatctggattatcttgggattggcttccattgatttattttcccttgagaattattcgttttcctggctctttgtaagtcaagtaatttaagattatattcaggacattgcgagtggtatgttggattctagattctgttatattgcttagaaaagagttggtgttccttttttaacaggcaattcacttgtttggatccaaattgaagactgtcacacctacaggagggcagtggatcttatctcaattattttctttagtttaagcctcagctgcaaactgctttcagtttctcttgcccatatggtacaggggtcagccagagacttggactgagtttaaacacggaatcatgggttccctttctctagctgtctccaggttttccccatcccctcactctctgactgttcttgttgctcccagtctccttttccttgttcttctggcttgaaagatggcagattttttaatttgcattttagctgcctggtattaatgctgcaactttggctgtcctcaaggtaaaaccacacacacaaaaaaaaaaaaaacaccaaaaaacccagtaacttaatctcaggccaatcatttgctaaagatgttgactctcctccaaaaattgcatgtttaagaggaaagtgggccaggcacggtggctcatgcctgtaatcccagcactttgcaaggctgaggtgggctgatcacctgaggtcaggagttcgagaccagcctggccaagatggtgaaaccctgtctctaccaaaaatataaaaaattagccgggtgtggtgacacatgcctgtaatcccagctactcgggaggctgaggcgggagaagcgcttgaacctgggagacagaggttgcagtgagccaaaatcgtgccactgcactccagcctgggtgacaacgagacaccacctcaaaaaaaaaaaaaaaaaaaaaggaggaaagtggtaacttaaagggaggagtaaattttatccccaaacaacagtttctattttaggcggagtaaattccaacaaaaggggaaaaatgaacccgagtgacattctgtacaaccaaagctgttaaaaggaatgaatagtgcctgacacttaaaaagtgctgaattagatgaatggtttcaacatggctgactagatgcatctggtactcacctctttcacagagtggaaccaaaatagtgagatattatagtgacagtgagatcgtagataatcacccttcaaatagatcatctaagagagaacactgggattcaacagagaagtgataagaagctccggaagcaaggaaggagagaaaagtaaagcagcctgtttggctgggatcagctaggaatctggagaggcttcctatgcagggacagagtaagtgggagacccccagcagcccaaatacccactgtgaaccctaataatagccatgggagaccccttgatgctcacggaccctgagactaacatagggagctgcctggagacttcatgaaggcattgctccagagagatatcatactgggtcccacaaaccctcaagtcctaagcagctgtaacactgattttcagagcccagcccccaccagactgtgtcctgccctgccacccaggctgaattgggagccacacacagcgacctcattcccctgagtggaggggcagctgcacattttcacactccccaaggacaaattccacttcctgcaaccaccaccactctgggctgctgcagggcagaggtgtaagcaaaactcagtcgtttaactgcctgcctatgggtactcccagggaaagcaaccccactctgcatgtcagtactgcagcatagctgctgctgccccttacctgagcattccactggaagcctggggatcaccccacccctgccttccatagccagcacctgcatgcaccaccagggtcactgagggcagttccacctagcctggcttcatacacgccactacccaagcacaccctctgggaggcctgaggattgcccagttcagttcatcaccagtggtgcctgagcactcctcctagagtctaaacttgggcctactcaatctgctgctaccaccatagctggcaccaacctgtacatgcaacctgcaagtctagggactggcctgcccaacctgtcacagccaccgccaacactagtacggaacacttgggttccaggggattttttcatcactgctactgtcatcatccacaccactccacacctcctgcccaggggctcaagaatttgcccacccacctggcccactgctgccatttccaatacctgagtaagtcatctgaaggcccaagaatctacctgcctggatccattaacaccagtgccagcgtatgctgccttggggccaaaggacacacaggctcagaccactgctgccaccactggggcctgaagactggcccacctggtatttcaatttctggcaaaacttaaccagtctgcactaaaaaccacactctaatctaccaacgaaaccagataccaatgactctatggccaaaagaaatgatagagactatgctactgcttgcatccagaaccaaagccaagtgtcctctccaaccatcaccatagatacatcttcaggaaaatgttctccactacaaaccaaattcaaaaaattggaaaaagcaactgttacaccaggtgcacaaatatcaacataaaaacacagagaaatcaaaaagcaaggatatgtgacacatccaaaggaacacagtaattcttcagcaacaaatcccaatcaaaaaggaattctcaaaatcctggaaaaatgatccaacatactgatactaaggaagctcagtgagagaaaagagaattctgaaagacaatacaaagaaacagaaaaataattgaggaaatgaatgaggaatctaccaaagagataggtatcataaaatagagctaaattctggaactacagaattcatttaatgaaatacaaaatacctttgaaagcttcaacaatagactagatcaagcagaagaatcccagaacttgaagatgttttgaagatcttttaaaataacctactcagacaaaaatagagaaaaaataataaacatgaatgactaaagctttcatggcatatgggacactataaagtggccaaatatatgaattttcagtgtcccagaaggcaaagataaaatgaaagggttagaaagcctatttaacaaaataataggtgaaaacttcccaagtctagcaagggatttatatatccacatacaggaggctccaagatccccacatggatataattcaaaaaggttttttttccatggcacattgtagtcaaactcaaaagtcaaagacaaagtgaaaattctaaaagcagagaaaaaacatctagtcacctataaaagaaaccccatcagacctaacagcagatttctcagcagaaatcttatagttcaggagagaatgagatgatatattcaacatgcttaaagaaaaaaaaaaaaacctgccacccaagaatactacacccagtaaaattatccttcataaataaaagagaaataaagtctttcccaaacaagcaaaagctgaggaaattaatcaccagtagatgggccgtacagaaaatactaaaaggagtcttataccgggaagtgaagagcaatatttactgtcatgaaaacacaagaaaatataaaaactactggtaagcaaacacacaaacaagaaagaggaaaggctgaaatgttaccactaccgaataccatgaaaccataatgataaaaagtaccagagaaaggaaggaacaaaggatatacagaacaaccagaagtcaatcaataaagttaggaataagccttcacatatcaataacgttgaatgtaaacatgttaaactttccatttgaaaagtacagactgggcaaatagacaaatgtgacctaattatatgctgcctacaagaaacgcatctcacctgtgaagacaagtataaactgaaaataaaggaatgtaaaaagatactacatgcaaatggaaaccaaaagcaagcaagaatagctatacttacatcagataaaacagactttatgtcaaaagcagtaagaagaaacgaaggttattctatgatgataaatcagttcagccaaaggatatatcaattgtaaacatgtatatacctaacactggagcacacagatatataaagccaatactattagatctaaagggagagactccagtgcaataacagttgaggacttcagccaccccactcagcgttagacagatatctagaaagaaaattggatttaaactgcacattagaccaaatggacctaagagatatttacagaacatttcatccaacagctacagaatacacattcttctcatcagcaaacagaatattctccaagctagaccacatgttaagacacaaaacaagtctcaacacatttttaaaagttgaaataatatcaggaatcttctcagaccacaatggaataaaactagaaatcaacaacaaaaggaagtttggaaactacaaatacgtggaaattaggcagtatgattatgaatgacttgggtaaaggaagaaattaaggaaatttttacaattcttgaaacaaatgaaaattgaaacccaacataccaaaacccatgggatacaataaaagcagtactaagaggaaagtttatagcaatacacacctataccaaaaaagtagaaagactttaaaagaatctaacaatgtacctcaaggaactagaaaagcaagaacaaaccaaaccccaaattaatagagggaaataataaatagcagagcctaactaaatagagacttaaaaaaacaagaaaaagggtcaacaaaacaaaaggttggtttttggaaaagataaacaaaatcaataaggtacttgctagactaaccacgaaaaaaaagaaagatggtcttaaataaaatcagaaatgaaaaaggaaacattgcaactgataatacagaaatacaaaagatcatcagaaactattgtgtacaactatacactaactagaaaacctagaggaaatggatagattacaggacacatgcaacctaccaagactgaatcagaaagaactaggaaacctgatcaaatcaatagtaacaagatcaaagcaataataaaaagtcttccaacaaagaaaagttcaggaccagatggcttcactgctgaattctaccaaacttttaaagaactaacaccagttctcaaactattccaaaaattgaaaaggatgggaattctccctaactcattctacaaggccagcattattctgataccaaaaccagacaagcacaaggacacacacaaaaaaactacagaacatacggacatagatgcaaaaatcctcaacagaatactagcaaactgaattcaacagcacattaaaaaaaaaaaatacaccatgatcaagtgggatttatcccaggaatgcaagaatagctcaatatagacaaatcaataaacatgatacatacgtcatcaacagaatgaaggacaaaaaccatatgatcattttagtagatagagaaaaataattcgataaaattcagcatctcctccgaattaaaaaactcaaccaactaggcatggaaggaacatatctcaacataaaaaggctgtatatgacagactcacagttaacaccacactgaatcgaaaaaagctggaagcctttcccttgagaactggaacaagacaaggacgcacgcttttcaccactcctattcaacatggtactggaagttctacccagagcaatcaggccagagaaagaagtaaaaagtatccaaactggaaaagaagttgtattttccttggctgatgttatgatcttatatctagaaaaacttaaagactctacaaaaaaaaaaaaaaaaaaaaaaaacctcagatctgataaattcattaaaagttgcagaatacaaaatcaacatacaaaaaaaatagcatttctatacatcaataatgaattagctgagagagaaatcaggaaggcaatcccatttacaatagctacaaaaaaataaaacacttaggaataaatttagccaaagaggtgaaagacctctataaggaaaagtatgaaaccgatcaaagaaattgaagaggagacaaatggaaagagacctcatgctcatggatgggaaaaaattattatttttaaaatggccatactaccccaagcaatctacagattcagtgcaatccccatcaaaataccaacatcatttttcacagaagtagaaagaacaatcttaaaatttatgtggagccaaaaagaacccaaatgccaaagcaatcctaagcaaaaagaatatagctaatataataactaaaacagcatggcataaaaacagacacagagaccaatggaacagaatagagaattcagaaataaatccatatatttacagccaattgattttcaataaaggtgccaagaacctacaataaacggtgctgggaaaactgggtatccacatgcagaagaatgaaactgtacctctatctcactatattaaagaaaatcaagataggccagacatggggctcatgcctgtaatcctagcactttgggaggccaaggcaggtggattgcctgagctcaggagttcaagaccagcctgggcaacatggcaaaaccccacctctactaaaatacaaaaaattagcttgacgtggtaggcgcgcctgtagtcccagctgcttggaaggctgaggcatgagaatcgcttgagcacaggaggcagaaattgcaatgagccaagatagcaccactgcactccaccctggttgacacagtgagactcagtctcaaaaaaaaaaaaaaaaaatcaagatggagtataaagacttaaatgtaagacctgaaacaatagaactactagaagaaaacatagggaaaacacttcaggatattggtttaggcaaagattttatggctggccaagaactcaaaagcacagacaacaagaacaaatagataaactagactatactaaactaaaaagcttctgcatgccaaaactttttgaatgggaagtatttgcaaactatttatctgataagggaataatatgtagaatgtatacaaggaactcgaacaactcaacagtagaaaagacaaaatattaaaaagtaggcaaacacagactgggcaatgtgccaaaactgtctctacaaagaaatacaaaaaaattaactgggcatggtggtgtactactgtagtcccagctacttggtggggctgagatgagaggatcactgagccctgagcggtgattacatcgctgtactccagcctgagtgatagagtgagatcctgtctcaaaaaaaaaaaaaaagtaggcaaagaccatgaatagacatttcgcgaaagaagacatacaaatggccaacaggtatgtgaaaaactgctcaacatgactaataaccacagtgagatatcatcttaacccagttagaatggctattattaaacaaaacatgctggcaaggatgtggagaaaagagaactcttgtacactgttggtggaaatgtaaattagtccagtcactatggaaaacagtaagatttctcaaaaaaaaaaaaacaaatagaattaccattgatctagcagtctcattattgggtattgattcaaagacaaacagtatatcaaaggaataactgcagtcacattgttgcagcactattcacaatagccaagatatggaatcaacctgtctattaacgaacaaatagagtttttaaaaatgtagtatatacacaattgaatactatttggccataaggaaatgtcattcacatcaacattatgttaaacaagccaggcacaaaagataaatttcacatgttcccatttatatgtgggtgctaaaacagtatcatggaggtagagagtagaatgataaataaccagaggctggaaagtgagtgggtgtgaggggggaatgaagaaaggttgcttgatggatacaagcataaagttagatagaaggtgtaagttccattgttcgatacctgactattgtcaccttacaaattattgtatatttcaagcagctagaagagagaacttaaaatgttcccagcacatagaaatgatgaatacaaggtgatggataccccagataccctgacttgatcataacacattctatgcaggcatcaaaatatcacatataccccataaatatgtaaaatactatgtatcagtaagaaaaattgcatgttttcattcagtttccacagagccctcaggtagctgtttttgtgttttatcccatgtacaactaatgcaagtggattagtttaagtgctcactctttcacacaggaagcagggtttttttctggcttaattttaaagaataaaacattacagataaattgaagttctcctatagtgccttttccaatcccattgcatcccaggcaacctctttaacaaacttcatatggatctggtccatatttttatactgagccaatacagtttagaggtttggagtgtaagctctggattcatactgccaggaatacctttacaagttacttatcctctctgtgcctctcttggtacttacctaataaggttgatagcaaggattgagataatttttataaaacacgcgggatagtagctaacatttagaataagaagcactctgtattttgactcttgattgttattcttattacaactgtactatatattttatatgggttttaaaaaatttacagaggggtgattctatgaagttttggttcaacattagcatctcaagctcttcataatcctttttcctatttgttattgagccatatatttttaaatgtttgatctccagtgacagatacagtacctagcacataatagatagtctacaaaatgtaaactgaaatatatgtgtcattgactggttttgttaacctcttaataatctgtttatttccccacagctgtattctgtacgggtggaagagatggcaacattatggtctgggataccaggtgcaacaaaaaaggttatctagatctattttaattttgagagatttgggattaccctgtacttaattttgagtgaaagagttagtgatttcatctgattaccaccagggggcatgtactcataatttcccatttctgctcactgttccagatctcaggatcttcactgagtgtcctgagtgataaatacatgagtgtcactgttacaagtattacactcatgtatttatctcatattgtcttctgaattataatgccatttacccacattattgatggacttaaaaatattaatacgcagcctcactggtaaatgtctttattttggtttttaagaattttttttattttattattattattttttttttttttgagatggagtctctgtcacccaggctggagtgcagtggcgtgaacttggctcactgcactccccacccgctgggttccagcaattcctctagctcagcctcctgagtagctgggattacagccacccgccaccatgcctggctaatttttgtatttttttaatagaaatggggtttcactatgttggccaggctggtctcaaactcctgacctcaagtgatctgcccaccctggcctcccaaagtgctgaaattacaggcgtgagtcaccaggcccagcctgattttaaagaattagattgaattaaacataagctcatggttgtctcatgatgctattaagcagacgatgattatctcactgttcacttttagttaatttattaaaatttttttttgtgtctgcattttaaaaaattggtaacatagttctacatattttcaggggtatatgtgatatcttgatacatatatagaacatgaaatgatcaaatcaggataattgggatatccatcacctcaaacatttatcttttctttgtgttgggaacattacaattcttctcttctggttttttgtttcttgttttttttttttttggagacggagtctcactctgtcacccaggctggagtgcagtggcgtgatctcatctcgctgcaacctccgcctcctgggttcaagtaattctcctacctcagcctctcaagtagctgggattacaggtgcatgccaccactcccagctagttatgtatttttagtacagacaggatttcaccatgttggccaggctgatctggaactcctgacctcaggcaatctgcctgcctcagcctcccattcttctagctattttgaaataaataataaaattatttagaaaaattttaataaaccttattttgtagagcagttttaggttcacagcaaaactgagcagaaagtacagagagttcccatatagcccctgccctgcccacacacagacttccccactgacaacatcctgtgcctgagtggtacatttgttataatcagttaacctatgtcaacacatgctgtcactcagagtttataatttacatcagtgttatatattcttagtattacacattctgtggatattgacaaatgtgtaatgacgtgcgtccaccattgtagcatcatacacaatagtttcactactctagaaatcctctgtgctccagttattcatccctacctccctctaagccctggcaaccactgatcttattacttcccccagtcacatttcctccatgtcattttatggctttatcaagctcatttctttccagtgctgaataatattccattgtctggatgaaccaaagtttatccattcacctactgaaggacatcttggttgtttccaagttttggcaattattaaagctgttataaacatctctccctttttatacattatagtctcaccacaggagatgtagtgcagctggctctgctggcttctaatttcaccaacttggtcaaaaattacttaatattgaagttttatttacacatgttatattcagcatgtaagaatcctgaaacctaaatttccttggaatatctttcagatgggttttataggcaagtgaatcaaatcagtggagctcacaatacctcagacaagcaaaccccttcaaaacccaagaagaaacagaattcaaaaggacttgctccttctgtggtaaggttttacagatgtatacatgtgtgcagatcttatctgtaggatagaataaatgggaggctattgattaagtgaatgagaatcttcatgattctcatttgatatcagtggtttattgcttattcagtacctacatttgtggttctcaaattttaatttttggttcttctgaattataatgccatttacctatattattgatggaattaaaatatatgtagcctcgttgataaatatctttaaatttattttggttttaaagaattagattgaattaaacataagatgttgtctcatgccattaagcagaaagtggtttttttttttacaatttcaatatctacattttaaaaaattgataacataattttacatattttggggggtacactatgtataatgatcaaatcagggtaattgagatagccatcacttcaaatactgtgtgcatcagagttgcctgaggcacatgttgaaaattcaccttactcatccctaaaaatctctctacacacacagacacaaacacacacacacaaacacacccctatagtatagtggaattcattaggaaaagtgggggaggagtagtttgaagaagcatattaagtactgtgatgcagttttctaaggggaaagaatacctgttgttttcgtaatacaaactacagaaaaatatgttttttgttttgagacagagtctcgctctgtcacccaggctggagtgcagtggcgcaatcttggctcactgcaagcaccgcctcccaggttcacaccattctcctgcctcagcctcccaagtagctgggactacaggtgcccaccaccacgcccagctaattttttgtttttttagtagagacggggtttcaccgtgttagccaggatagcctcaatctcctgacctcgtgagcctcccaaagtgctgggattaccgatgtgagccaccacgcctggccagcttatttttaagcatttgacaaaatattgttaaatatattgagaaacacatgggtagaacatagtaccactctaataacttacagtcagagctcaaacaatgcccataatatatcctttttctttaaaaaattgccctttttctcactttaatgtaatttttttttcatattcctggtgtgtagggtacaagttaatattttgggggaagtatgactgctaagacattaagacttaaaactatacaccgtgaacaggacacaagcatgaatggaagcagatagtagaggccatatgaagttaaaacgagtagcatttcagacatttaatctggttctgagccaagataacttgttaagtaatagcaattaggaggtacgactccactgggcctctttttcagggcatgaaataatcttttattcataattcttttgatactcctatatgataatctaggtagacagcaacattttagagattaaactggcacaagaaagttaaataagtttcctaaggatacacacagcatattagtagggctgagtctaagtagatgcagtaggctcagacgagcaaaatcttttagtcaccagtttgttttttgagtataagttgaaatattaacactgtatactaaaacttaatgatccttgctaaaattacctcttggtcagcatatatatctgatcgagatcattagacaagacttcatctaagtcagtctggggagaaaagtcgttttttagcaccttgttcccttgatggtaaagattatgatgcccaagatagaatcttcttcttttcttgtgctatcaggatttccagcaaagtgttactgtggtcctctttcaagacgagaataccttagtctcagcaggagctgtggatgggtaagagtctatttcttttttcttccgacgagatcttttttatgagattgtgatgaggcagtcacatagtctcattataattgaatgtgtgtgctttcaactgtcaacatagcaagtaccccaactgaggaaaggagctatagatcacattggaaaatacctagttgaaggactcttgctggataattaaatgaaagaatacatgtgtcacgcttagcacattgtctagcacataagagcagtggtagctgctgttgctatcttagaaaagaagctggctgggtagcttgcttgccttatgcaatataatttagtcactaattctcattttgaagagtaaaatttctgttactttgggttttgtctttttcaggtttaagaatatcctaaaagaagaaatctgattctggggatgtaattgacatttctgggagtaatctaactagattgatgatagtaaggtctaatgactttcacatacctgtcatccatgattagtctgaattcttggcttccaaataagtctgctctgtgatgcttgttgattgtgttgtagaatattaattctatgcaaatggagactctttctttttaagtttccttcctattatatctctcaaggcatccttctcttaaaatttttaatttaaaagatgatggcttaccaaactaggatttccattgtgtcctctgggcactaaaaccctctgaaccaaattctcaggcaggaatgaaggattatctaaaggttattagttctgcttgtgaatgactgtgaaagcttgctctgtttgtttccaagaatactgtcatttcatagcaggtctgtgttttcaagttacctttatactagaagtagaggattaagacaattatctcaatagatgaaatgaaaaaatactttatttcacagaacaatttgtttagattatttaaagagttatgtatggagatataaccacagggacagaacttgctacttatgatatcaaaaatatatgcagaatattaaaggcttaggaagtgtattttctaaaaacaatggaacaattactatcggcactcaaccttcatcttccttttccgttctcttagagtaaactccagtaacccatcactgggtcaaatcacatctgtttccgttctgtcagaattataagcctgatattggagacaacagtataagatactttaatttgtttcccaatgaaatatccttactgtacctagttaatgtgccagaggagttagattaaaagtcatttcacatttagtgtagttgaagttgtttggggttggaagaaggtctacaaaatatttatttgccttggtttttaggataatcaaagtatgggatttacgtaagaattatactgcttatcgacaagaacccatagcatccaagtctttcctgtacccaggtagcagcactcgaaaacttggtaagcctttaataggtcttttgggggagataagagtttttgtttaaaaaaaaaaaaaaaggctaatttccagtaacattgatatgaaaaattctaatatgtgaagttcaaaagataaaaactcagaagaatgtttttggtttgtgtatattttggggacaaagaattctgatgatgattcttatgaaatgatctatttttgtctctacattttaacctcagatctactcaccatcatcaggacgtgctaacttaagtttcctttttccaggatattcaagtctgattttggattccactggctctactttatttgctaattgcacagacgataacatctacatgtttaatatgactgggttgaagacttctccaggtaagatattagtcattcaaattctcttaccaggaaagcattatgggctttttttggtaatgataatttaatgggctttcttctaaactgaacttattaagccatatgaggactttggcatctttgattacatccagtgataatttcataagtgtacattccttgtgatgatttcataagttagctgaattgtgctttacatggtgactttattttaatagagagtatctcctgaaattatgccctttggcctatatttagaattctctcaattttttatttaataagctgtggagtagataaagtgcttctgctcagcttttttcctctttaggggctgctggttaaaattagggggctgaaattttcatacccccaaaatagtttcagcctatctcagccttctccttaatgttagaggcccttttatttctagatgttttccccagcctcaccttttttttttcctcaaaactttaaaaatagaatctgatacttaaaactaataaataaatgatagttttaaaaagaaaacccaagtttctcaagcatgctttcctcttttttttaatcctctcccctccctcttccaaatcaccagcctcaggcatgctttaagagagttatttgggttacattatttttaagaacatcaatttcttaagcaacatcttagtagcctggttattcctcatctatagatctttcaaaaacactttgaattccataaccaatcctcagagttacccagtttccactaaagtaaaaagtgctgataaacaagaaatctcaagtacagaacttgttttattttatttatagatagatgtagatatagatataaatttttttttttttttgagacggagtttcactctgttgcccaggctggagtgcagtggttcgatctcggctcactgcaccctccgcctcctgggttcaagcaattctcctgcctcagcctcccaagtagctgggattacaggcgcccgccaccatgcctggctaatttttgtatttttagtaaaggcagggtttcaccttgttggtcaggctggtctcgaactcctgacctcatgatccacccacctcagcctcccaaagtgctgggattacaggcgtgagccaccatgcccggcccagaacttgtcattttagctgagatcttacagaattttccaaagatcaccccaagcaatcttattaggactttagtatcggtggcagcatcatagtctgcatttctgatactttgcactgggtctagttttctctaaacaggagcaatagtatttagaaaagggaagaggtgtttcttttgctattttccttaatggaatctgagcttggagagctgctaatttagttagtcaaataaaatagacttttcaacatctttccttgaaagataaagcgtgatcctgattatattatcagatgtacaagagctctttctatataatttttgctacagtgtggcactgaaaaggtccttgagtttagtgtcctgctgtccaacacttcgctaataatttagtaaaccttttctatgcttctatttaatttcatttgcgcagatggatagataggtagataggttaatagatcgatttattccttaaaaattgaatgacagctggccatggtggctcacacctataaacccaagccgaggctggcagatcacttgagcccaggagttcgagaccagcctgggcaacatggtgaaacctcatcttgacaaaaagatgcaaaaaattagctggatgtggtggcatgcacctgtagtcctgctacttggaaggctgaggtaggaggattgtttgagcctgggaggtttgagtcttcagtgagccatgatcttgccactgcactccagcctgggtgacagagtaagaccctgtctcaaaaaaaaaaaactgaatgacaactgtgtgtgtgtgtgtgtgtaacgtcttgtaattacttgtccttttcaaaacttctgaatcgatcttggattcgatacttgatctaccatgctttgtattatggtgtttatatgttcataaggatgacttggttggaagtacttgaaaagcccagatcaccaaagcaagattaaattgagctcattaaagccaacatacattttaggaggatttttagcaaggtttaaacatttacagtgcatatcataccagcctttcttagaccagcagagggcaataaatacttacaggtgtagtgggaaattcaggctagagttttccattcatagttgagagttgaggaagattaaaaattacagttttagaacaatgttcagaataaaggagcttgtttattttgcagtgataataggtgtatacaaattgattcatatcctgcctcactttcacagtaaaaatgtctgatgtgaggagtatttgctatgcctgcatagctttttcctttaaagctataaatacaaagttcttttccagctttattctagaaaatggaagagattcctgtgagcacttatgggaagctgttaagtcccctactaatacttttctctctggagtgtgattgttttttcctgcctaaaggtatccttaaattctccaataattgagatttttctcttgtatttcctagtagtgttctgatgtcagaggcctcaggttttgaccttcttaggatagaagaacctgttaagaacatatgctagattgggttacctgcccttttgccattgagagtgagaaggctaaacctaatctagtgccttacatataaacagtttactccactagctcttccaccattcagtctactcaaagtgctggattaaaatgattctcacatcccacataagctattagtaagttttaaccagaactcaaatgatacttttcactgattttttttttccttttcatggaacaaatgtttgaggatctactctgttcaaagcactataaagtctagtgaggaaaaagtaagatataaaatttatcctcaagaggcctgaagtctaaggggaaattagatgaatatattatgcagtggaaaaaatcctaccctgggctggagagagagggtcttataaaggcattttactgcaagttggacattggctggattctttttttaaggaatgttttccctccaatttttttctcttgatattgccattttcgtaccaagtactcagactgagttcatgagattggatctaatataaagcttccttctagggttttgtttttctgccaatgtctagttcccttgtatttgatggataaagctagatcatctgcttcaataggcaatacagtgataaaacttgttagaatatatatgctgtctatatccatttgaccactagaaataacaagagccaagtaatttggtttttttcctctggcagtggctattttcaatggacaccagaactctaccttttatgtaaaatccagccttagtccagatgaccagtttttagtcagtggctcaagtgatgaagctgcctacatatggaaggtaagttgctaaacttcacccacaagtgttagactgaagtattcttgcaaatatttgttctgtccaatatgagataagtttaatgtaaccacgtgctatactattcctgcatcagatatttagtaaaggttgctcttggctcttaatatagctgaaaccttactctactacagaatgtatgacactttcagggccatagcttgtcagaaattgacaatttgtatcctctgtttcaaaaattattaggaaattgagaattcagagggtgataagaaccttaactactttgtcctgcatcctggaaaacatgctatactgactttctgccctatgttttcaaactctcgttcagaatacagtattttgatccctaggatcctgtgcttgaatcacccatggagccttgcacaaaacagaaactcaaaaatatttttatgattaatttattctttattctctccttacaagtagctgatcttcaggccactaaagtagatatggctgctttatcagatttttatatatttaatagcattatttactaatcttttttttttttttttttattgagatggagtctcactctgtcgcacaggctggagtgcagtggcacgatcttggctcactgcaagctccgcctcccaggttcacgccattctcctgcctcagcctcccgaataactgggactacaggtgcctgccaccacgcccggctaatttcttttgtatttttagtagagacggggtttcaccatgttagccaggatggtctcgatctcctgacctcgtgatccgcccaacttggcctcccaaagtgctgggattacaggcatgagccaccatgcctggccaataatcttttaaataacttttttaataacagtagttctaaagtgtctactgtaagctaagaaatttaaagctgtccatttgaagtccagtggagaaaataaaaatgttagacaacaggtagcacttgcttattactgaaaaatgtctcttgaaggaataattaattatggaaatgttctgggaattcagagaatgatcattaaggcattgtttacccatgactaagaattaattatcttctagatttccctgtaacttcataaatgtctttgacattggtgaattgaatgattagagttcacatattttgggttttaaagtcataatgtctaaaacttcatagatcccatagttccgatagtatcaaatcccttctcaagagaaagttatatcattttttatcctgccaagctctagaaagtaatattgctaattttttttaggacaggggtaaaacctgtttagtatgaagcataattcttcagcttaatttcttccaatcctgagggaagtacaaaagaaaagtgatttctatataactggagttgtgaaaatgcaacactactttattaaaattttactaacaatatcctaaatagtcacagggtggaaatattgctctatccaagatgcttctatgttgggcctgcctttttctacaagcatatttctttcttttgttatatttttaaatgcctataaagtatatacttgactccatcacaagatggagtttcctctttataatattcttcttacttgagattttaagtttaacaatgttatgtcgctggcactaatgctctgtcttatatttaaaattttcagtttcaaatttggtcttaatgcttattttgctacctttttcctttcttctttgctcactgtcttgcctatgtttccttctccactttggctcccaacttaactagaggattttattcctaccacaggtctgtatcttttaaggtttgtttcttgttaaaaaaaaaatttttttttccaacatcacaaaaagcatataagaataattcaaaaaatacttatgtattgatcattcttgttaaattattaagttttaattatatgtacataattatgtatacaattacatgtgtgttgtatagtttcttgatagtttttaaattcttaataaatttttaaattatatatatacataattatgtgtataattatatattatgtgtatcttgtgtaaagttttcttgacaattgttaaagttccttcctcttctctagtgcaaaggcctttttaagattttgtttcagggaatgaaggttgtgggaatacttgcctttaaagatatacactaaatatagttggccattgtttctaagccattttcagacaaccaatcagtgtctaccacatacaagggttacccttttttaattcctaggctgggtcacatgtcagtgttgaatgacgtggttcagacgtgatgttcttctgcctgtccacacataactcggtgtacaggctctgatatttgagatcctggcaagcttgcacctcctaaatttgaatttgcctagtgaggtggctcagtttctcttttccatgattaaaaaaaggaggagtggtattttaagagcaattccattcaagctgagtatccaggctgttagattgctcttctacgtgttcaaaaagtcagaattctcttaagtattagaattttttctatgctaaaaagccaaaagcccatgggcacaagaaaacaaaatagaagggagttttgtatcttaagacagaagagaatggcctcttaatcctcactactgcccagcaaagaggaaatataatatattcgggctgatattgaggcccaagacttaaaaagatttaatattataccttttctttttaatttcctaactattgtctcacccccaccccatcctcttttctctggtttgtttctgatatagccactgaatagcatcgaagtggttataaataaactgatttggcatagtcattctaccactgactggtgaaacgttgagcctgacactttaggaagtgtaaatgatctcatggcagaaataaagattagacttggtttccaactgggcagagaagagattttgtgaggaaaagtgctgatattctttgtatgtttcagtacacaaaataactttatgacatctgtaagttagagccacttacttctagaggtaccttcttagttctaggagatttaactttgggattccttgtgccttgaattaaagtctttattttacaaaaagtagaatatgtaagagaggacagtcttctgtgtctgagcatctccaaaatgcatggatataaatgtctcttagacttaatagtcgccttcctacttaaaagggaaaggaagctttaaaaaatgaagttacgtaattatgatagtgttcttataataatgtagggacaataaataaaaatttatttgaataaaaatgaaggatttaaaagccacctgaatctcattagaaggaatgaatctttcttgaagtagtcatactataccctaggatagtcctaaactatcaaagcataaaagttcataaaaacgtgttagacattagtttctcattttaacccataacacgcccttcctcccatttttccttattcagatagaattcatataacatataattcaccattttagtcattttaaagtttacaatggagtagttactattgtaatcacagtgttgtaccaacatcaccactatctaattcccaaacatcatcacaccagaaaaaaacccgtgtcctttaacagtcactctctaatcccctcttcctccccaacacctgctaaactacattcagtctctatggatttgctattctagacatttcatataaatggaatcatacaaaatcagcattttgtgtgtgacgtcttttacttagcataatatcgaggttcatccatgttatagcatgtgtcagtacttactcctttttatgactgaataatatgccattgtgtggatagaccacattttgtttattcattcatcagttgatggacatttgagctgtttccattttttgacatgaataaagctgctgtgaacatttgtgtataagttcttgtttaacataggtttttaattctcctgggagtgtaggaacagaattcgattcctaagaatagaattgctgggtcatataattgtttaactttctgaggaaacttccccccacttttaatgctatgtaaagtgcctggcttagacttttactgtcgtcattgataccttgttaacgtattccaaaatgtttttctaatgggtctctttcttttttctctgaaaccctatagataaatgcaaaaatgtgcatatattctattggtgggtatttagggggttttttgaaacttattttaacccttggtgtacacatttaggttctcctaggtattataatacagaaactgagaaaggaccaatatcatgaaattaaaaagctataggcaataagcagggtgaatcaatggaagacaataatgtatttctaccagggatgctcagtaggacttgaggatttcctctcccttctaatttgctgctaccagacctgtttggaccttgggtgaagagaaacttaatcgactggggccatcccaaacagaggaggaaaggaaaatttctgtgactactgggatagttagagacgatcttcaaagtcttttctaaaatatgttacattgtgaaagaatgaattatctctgtgccattgtaggagtaggcagtaagtgagattcctgtagatgtggaaaaagcttcctttctgataaattttaattaactctgcaagacaagttagactctgctctttgtcttcttttgcttttttaattattgcatatgtaccatttaagccaagagaggagtattaatgattgagttgaataaccttatcagtcagtgtgtcagatctcttaaccataatctgggggaatctattaagtttacttagtcattctcacaaataatcattccagagtcacctccactttcttcatacaaatgagccatgattcagagcctcaggaaaatgaaaagagaataacttctctcagccccaacctccttgctcttttgaaacacacatgctaataatagttatgtgtgtttgtactcgttattgtgctgattaattcccatggcctatgaaagagattgacatctcttgaatgagtcagctgtatgatgctgtcaaatgtacataactggtggcatctgatgatggaaaaatatgattcttagtcacatgtacaggacagtacaatgtgacccttctttctgcattaaaatatattaaaatgcgagtgacacttacttgaaaattcaaaacttctctcagaaaattaactgaaatatagttttagaggaaaaaaatgtttttcagaaaggataccaaagtgccatgtaaaatatagtttataccccttcagaatgaaggttatccaactcaaaatgaaggagtataactttgggttttgtaaaagttagtgaccagctctgttgggacaagaggacggtcttcttttggaaggaagaccatcatcttgtccgaagagagctggtagcatgtttcagaaatcttcaggtttcacagttaatttagtgttcctagaagtagctgactagggatctgaagatatatatgctgtgtaaaaacaggactgagttgtcgagttgactacttaaggatggataacatccttccagaaagtttaccacctaaggaataagggacaatgccagtcttgaattttagtcaaaatatatatggctaggttgtcctgatatgaaataaggactatccttgtgtgtaagctcatgttatttacttattttgactgttttcattgtgttttctcagattagtaacagaaatatttcattgcccattggaaatctgttgttttttttttcctaactatagctaggcaggtctagtggcctttggtaacaatcctaaagctctctaagacacacttctgaattcaaaggcctctatctgggaaatctaatattgctttgctgacttgtttgtttttgattggactaggtctccacaccctggcaacctcctactgtgctcctgggtcattctcaagaggtcacgtctgtgtgctggtgtccatctgacttcacaaaggtttgtaaatgaatctctatagttggtttaaaatgtagatcacaggtttgtaggtttttctaaggtttgttttgagaatgatataaatttttatgtttaagttgagattttaaagacctaaaggccatccaggatctatattcacattactcaggcatattctgcttttctctacccataccataatggtattatgccctgtgaaataaggatagatttctggttccctacagttatttctttcctaaatgtaggattaagttgttaacttaattaaaattttctattaaaatctaagataaaaatacaatctaaggtgagaactagtcttttttactttttagatattatcaatgtagtatattaaaggtaacatcttgacagcccaatttgggttttcacatatggctaacaaaatggtaactgtgaagtcttaacatgttaggttatctattgcttaaactatgtaagtaggtctgaaatgttttagatactccagaaagaagacaatatgcccaccttttaatttttttatagtgacactttaagaaacaaaaaaaccctaaaatgtagaaaggccagaaacattaaaaactatgtatctattggaattgcatataatagtagctcaagttccagtcattctcccaaaccccattgcctctggtctttgagttattctgggttctacaggaaatcttatttctgtggaggtctcccctttcacgtatgacgttttgaggttttgttgcctattgttcccatctgttttttatcttccagaaacttctcatggtctggtctatttgtggcatccctgctagcttccagtattgctgtggatttctccttattgttaccatttctgtgctcaacttcatggcagaccttttctttttttttaagtcattactttaatcacccaaaattacatattaatgatattttttcctctgagattccatgtaatttcttttaacatggagggttgcatcttcatgggacttactaagttgaatgatttttgaattattcagttaattatgttatctttttttcaattgtcatatattatccttacccctatgcatctcaaacatcatatattaattatccttatttcctgtgctcaaaggaaatagcagggctgtttacctatactaatttattggctacttttttaagtcttaaaaataatttcatcccaagcctagaattaggaaagtaaaatatggtttgtgttgtttttgtgtttttaatgtctggcatttggaataggagaaagctgggtttaaattctagctcttccatttgattgtggttactttgggcaaataactttattcccattttgcatatgagattatttgagtacaaagcttttagagtgtgagaattaaataagataaagaatgtaaactaccagacacatagtaggtgctctgcaaataactattgttaataaactatagaagaactgtgagattccaaacatttcatattgaacagttaaatatgtgtatcttcttttggcctcccagtaaggaaaggaaaaagctgccagtctcttgggggccaagacttaagagaacatgtattctttttttctttctctttagtgactgaaatagagaaattatataaacaaatgctggggaacagctctggtaccagtggccatttgccacaagctcttcaagctggactttctctgccataaaaggcttgggaccaagatctagaatagtcagatatttttaaagggacaaaggttattttttaacttctttcagcctagggaacttgttgttttcccagattgctcctctacctatctgaaaaagaatctcaaaaggaatggtttccttctacttgtcacagcctactagagtcatgggccaagtctgatcttgcaaatggtgccattactttagcaatgtggcacaacatgcagaattcagaagaaagttgtagaaattgaatgttggtaacatatactgattgatcatttaacagaagagtaaaaagagtgtcttaactacatattttgtatttatacagaagatgataaagagccagaactttagattagataagaaatgaccagtaacaaaagacatactagtagaatgtatatgaagaataaactaaagagtcagctttgttggaaatctggaatgattcctgaaagcaagaaatggatgtacatgatctttaagatattattttctatatcctgtttattagacaaaataattatccagtcacaaggccttaagacacacctgttttttaatgtattttgaatcttgattgaaatttcttaattcccttcttggtactccctcttagattgctacctgttctgatgacaatacactaaaaatctggcgcttgaatagaggcttagaggagaaaccaggaggtgataaactttccacggtgggttgggcctctcagaagaaaaaagagtcaagacctggcctaggtaaggatatcatatactttccaagttttttatggtttgactagtttagtccgacagtacagagtaataagctagatttgatcttgctttggtatgtttttaaagaaaagcactatcttcttgccattcattctttttgataagtatttcccaagcactactatgtttatcatttacacaaggtactacagtggtggatttattcaacaaatatttcttgaacacccagtatgtgctgggccctgttcttagttgctagggattcagcaatgaacaaaagaataaaaaatcctgaagatgtaaatagagctaacatattagtgtgagaggcaataaacaagataaaaaagtaaaatatatactgtgtcaaataacaataagggcttaggaataaaggaaataggaaagggagaagggcaagggtgaaatatgctatcaaaattttatattaggtgaccaggggggcctcaatgaaaagatggcatttgagtaaagaaagtgaagtagtaagccatatagatattttaaagaagaatattccaggcagataaaagtacacaggccctaaagcaggagcatgcttggcatattttctcttcctcagagaggctagcatggctggcccctagggctgcagcaggcaaaggaaagggagggaatagtagtagaaaatgaaattctgtgagactttggcttttattttgatagacaaaagtccaccagagggtttggagcagaagagtatcataatttgacttttaacttgatcattcttgctcctgtgttgaggataaattgtaagggggtcagggtaaaagcaaaaagctacttttaaaaagccattgagataatccaggaagtgatgatggtgacttagaccagagtagtagcagaagctatggtgagaagtcatccaattttggatatatttacaagacagagccaacagaatatgttgagggatcagatgtggggctatatgggagagttatcaaggataacttcagagattttgcttaagaagctgaaaagatggagtgtcattaacctagataaatatccctgcaggaagagcaagtttgggagggaacagctggagttccatttggacatgttgtttgatatgattattaaacacccaaatggacatgtcagggaggcatttcgatgtttaattctgcagttcagggttgaagttgcagatgtgaggttcattatcacacagggtgaagatagctatagatagaaaaaaataggcctggtgtcttggggtaccccgatgtttagaggttgaggaggtgacaaataccattaaagcctactgagcagccacaaccagagaagtaagagaaaaactgggagagtgttacatcctggaagccaagtaaataagaggagagagggatgaacttgatttgatgtttctggtataccaaataaggtgaggcctaaaaactgaccaatggattaggcaatcataggggttatttggtgaccttaatgagtgttgttttggtggtatgatggtggcctgattggtgtcattcatgtatatgacttggggactacaagtatagacagttctttcaaggagttttgttataaaggaaagaagagaagtgaagtggtagctggagaaagaagcagggttgaagtttgctggggtttttttaaataggaatataacatttcacagtgattggcaggatcgtatagagagggggagattgatgcaggggaatttgctggagcaatgttaagcatgaggggatactatctgatacacagtaggagggtaggcctttgccaggaacatggatagttgacccatagtaattggagaaaaggtggaatatataagcatggtgcaggtaggctactgagagatggtggggagagaggtggagagatgagatggccataacttacagaagcttccttctgttctgatgttaaaacatgaatcagggttattaactgcgaatgaggataagggagaaagggagtagagattttagaagagataagaaagtctgaaattgtcactgagagaatagaggaataaatggacaggaaaatatgattgttgggcttcaagagtcaacttgaggctagcaataattaattgaaagtgagcactccacatggttgtgtgtttgctatgcaagtacaagtatactataggtagagagctagatttaaccagggatgtggtttagcaatgcaagtgaagaaggaagttgacagtggatgcaaagaggatgattatgactataagatataaccttggtaaggaggcatattagtccattttcacactgctgataaagacatgtacaagacttggcaatttacaaaagaaagaggtttaatgacttacagttccacatgactggaaaggcctcacaatcatggcagaaggcaaggaggagcaagtcacattttacatggatggcggcaggcaaagagagagattgggcagagaaactcccccttataatattgtcagatctcatgagacttatttgctgtcacgagaacagcatgggaaagacctgcccccattattcaattacctcccaccaggtccctcccacaacacatgggaattcaagatgagattcaggtggggacacagccaaaccatatcaggagggaagtaaggacataatggggccaagggatagtgtaaatgtggtactagcagtggattgaggataaaagattgttggaattgaaatactaaagggagatgggaaaataagtggtgatgagtgggatgattgaaattaagataatggaagatttccaggtattggtaataataaggtaaagaataagtggcttaggagagtgaaaggacaagattatagaagaaggaggtcaaaaaactgagaaaccaaggtattggaaagatcatgtacatagattttttaatcaccataaattgacagataatgttgaagagagtaacaatgaaccaagagcaaaaatcttcaagcaatgagccacccacagtgtggatcctcagggtatcattagatgtgctgtatacttgtacttacatggtaaacacacaaccttgtggaatgctcactttcaattaattactgctagcctcaagttgactcttactggccaacaatcatatttccctgtccatttactcttatattctctcagtgactgtttcaaactgtcttatctttaagcttgagttttaagcttaaagattcattttacttcagccatcaaggcctaaggttaatggggaattgaaggtgagaaagggaaaatatacaggttcatttttctaaggacttatttagttgcttataagatgcagaactagacttcagaggagtcttttgctctaagtctggtttctgtagtctttgatggtgctgccttatttgtttttgctctttgctttttttaatttctttttttcttttctttttttttttttgagacaaagtctcactcttgtcgctgagcctggagtgcagtggcatgatctcagctcacttattcaagcaattctcctgcctcagcctcctgagtagctggaattacaggcgtgtgccaccatgcccagctaatttttgtatttttagtagagatggggtttcaccatgttggtcaggctggtctcgaactcctgacctcaggtgatccacccgcctcagcctcccaaagtgctgggattacaggcgtgagccaccgtgcccagccctaaaaattttttttcattaatttagtattacagtttaataagtcagctagttctacaacagtgaataagataaatagcagtccacagaccctctgcctcatagtttccctttcccagaggcaacctctttcaaatccttttgctgattctttgatatgtatgtctagacctctaaatagttttgtgcatttctatttattttttgcaattttcagctttattaacttctttcctttgtaacatgaggatttaactccctttcctgtgtcccaccactatcaaaccttcatactcctcatcctcctaacacagggtcatgattttggttaaatcaagatacagctcagttccttttagtatgcagttgtccctcaggatccatgggggattggatccaggaacccccaacagataccaaagtccacagaagctcagattcattatctatgatgtagtatttgcctataacctatgtacattttcccatatacttttatcatctctagattacttaaaatacctggtacagtataaatggtatattaatagttgttgtactatatcatttagggaataatgacaggaaagaaaagtctgcacatgtttagtacagacacaaccatcttttttcgtgtttttgttttaatattttcaatttgtagtcaactgaatgcatggctgtggaacccagtatacagaactcaagatatagagagtcaactatatttagagttatgtagtcattaatacaatctaattctagaatatcttcaacacctaaaatgagggttccaatttctcttatgttcttgtcaacatttgttattgtccatctttttcattatacccatcctagcaggtgtgaattagtgtcccattgtggttttgatttatattttcctgatggccagtgatgctgaacatcttttcatgtgcttattggccatttatatattttccttggtgaaatgtctatgcagatcttctgcccatattctaattgggttatttgtctttttattgttgagttgtaagcattctttatatattctggacataagtcccttatcatgtaatgatttgcaatgatttattctgtgggttgtgtttttactttcttgatggtgtctcttgacacatgtaactttataattttgatgaagttcagtttatctgttttttcctttgtcacttatgcttttgatgttaaatcaaagaaactattgcctcttctgaggtaacaaggatttactccaatgctttcttctagttttttagtttaggcctgtgattcgttttgagtttatttttgtgttatggtgtgagttaggcattcaaattttttacatatggatatttaactttctcaccatcacttgttaaagagactattctttagcccattgaatcgtcatggcacccttggtaaaaatctgccaaaaatcaattgaccataaatgtgagggtttatttctgacttctcaattccattgatctatgtatctgtccttattatggttctgcattgtcttcattactgtagctttgtagtaggttttgaaatcctacttctgttttcttcttttatttcaagattgtctcgactgttctgggtctcttttatacaaattttagtttcagcttgtcattgtttgcaaaatagccagctaggattttgataggaattgcagtgactgtgtagatcagttatggaagtattgacatcgtaataatgttaaatcttctggtccatgaacttggatgtctttctattgcctgtcgttatatgtacttttctctctctcattttagaaaatataaaagaaaagaatcatatgaggccattagagaatactgattttaaaaaaaagtcatcagtattccctccactttgacataattttaaatgacatttccagttattttttgaggtttttcccttatacatagagattctttttaacagaaccatagttgtactgaatacgcatttgatttctctcaagccatcctaccacttcagcctcccaatagctgggactacaggcatgcaccaccacgcctggataatttttgtattttttgtagagatggggtttcgccatgttgcccaggctgggctcaactatgagctcaagcaatccacccacctcagtctcccaaagtgctgggattacaggcatgagccactgcacccagccttaagtactttctatgttatcttttttgcaacactatttcaaatactacacttgagtaaatgttccataatttacctagctattctactgtagtttaaacatttgtttcaaatattttaaaacttggggttttttcctccctgaatttagggtcccccttcccattaaaataagattcccaaaggtggaattcttgtgttaatgactataccatttcttaaaatttgtgatgaaaagtatcttgcttttaactatgtacttttagtgtgccattaattatccttagtattagaagccaagtcaccaaaaaagttacatattgaccaaatgtgagttgtaataataacaacgtttagccactattgactcctagcataattattctaaggacctacttggattatctcatttaattatgaaaacaactgaaactgaaggtcaaggaagttagacttgcttaaaatctcatagctatgaagttgtagaaccagagtctataattgaacccttgcagtctgattctagaacacatgctcagaaccactctgcagcactgccttctttagaacctaacagagcaggctgggtgcggtggctcacgcctgtaatcccagcactttgggaggccgagtgggtggatcacgaggtcaggagatcgagaccatcctggctaacatggtgaaaccccgtctctactaaaaatacaaaaaaaattagccgggcatggtggcacacgcctgtagtcccagctactcgggaggctgaggcaggagaatggcgtgaacccgggaggcggagcttgcagtgagtggagatcacgccactgcactccagcctgagcgacagatcaaaactctgtctcaaaaaaaaaaaagaacctagcagagcaaggcaaaagttcaggttaagatcagagtaagagttatgcctagattactccatttctgggtgatgctagggttactctgaagagcactacgaagcaacaacctgacacgggttttcaaaggctggcacactgaccattcgactctctaagccagcttccagccacagatttgctgcttctaatcacattgccatcttgaaaatcatgttcccctgctttcccaagcttctaattgccacgccaacctttcattgctgtcctgggctgcttatcttcacttctggccctggcttgtaaaccccctcagttaacacattaattggaagggtttaagtgctaagacatagcctctttttctcctgccctacctttcccagccggcacctgcttcattgcttaccactctttccctatgttttagccagagatctcatagcactgttgaaaccaatagtcctcaatcttggctatgcatcatagctacttggggagcttttcaagtccgtgtatccccagtgattgattcaatgggactggacctgtatttttacaaagctccaaggaggtctgttatgtagcgaggattgagaacctctggtttaggcattattgagtgataaagttgattatccttatcctaaagagaaggaaaccctacctattctgcctcagttgcttgctgcagtctcacaagtcagcaggataattatagagtcaattttctgatccctagaacctcacctgtatccttgtcagcagtaatgaaacttaacaaacattgtttaataattccttactacgcactataggggcactgggcctaaagatgagtaaaccattattagctgccctcgaggctcacagtctagtctaggaggcagattcaaaaactatagcacacagccattagctgtgtaaacaaggggctctgagaacctacttcccctgtgagaggagagctctgtgggagaagaggaaagaagttgtgaattcttcacagtggagttaacattgtcatcagagccttgaaacatgagaagaatttctgcctggcaaaggaggagctgacttggcaagaaaaccacatgaacaaagaaatgtgacagtacacagcttgttcaggaagcaactagtagtgtcctgtaacgtgatcctagaatagcaaagtacatgataagactgaaaaggcaggctgaggccagatggcaaactcatatagaaagaagctggctgggcacggtggctcacgcctgtaatcccaatactttgggaggccgaggcaggcgcatcacctgaggtcaggagttcgggactagtcttgccaacatggcaaaaccccatctctactaaaaatacaaaattagctaggcatggtggcacacgcctgtaatcccagctactcgggaggctgaggcaggagaattgtttgaatccaggaggcaaaggttgcagtgagccgagatcatgccactgcactccagcctgggcgacaagacaagactccgtctcaaaaaacaaagaaagaagctgcaaactgttagtagactctgtataattcttcgaaggaactgactttaggaagcatttagggcaataactcagtctatgctaccatgtcatcaaatctcatatattgcttaaggtcaataaggagttagtccacttaagtagatgaagtactaaagaaaatggcatgccatatttaaatgtgtaggcccatataatggcatgctatgcacctgttaaaaataatgcaatgcatctatgtgtacttacatgaagagacgtaaaaataaaagagcaaatggcagaacatgtacagatatatatatagtataatccatttgtattttggggttttttaaggtctgatacatatatacctttgtatgtgctaaataggcacagagaaaattgcggaatgcacaagaatgtaaaagtgaaatgaaaaagttgaaaagaggatcctgtttccaccctcttcccctctgtactggttgaatttttttaccattaactttcatactgttataatgtagttactgtttaaaaaacatatacacacacttaaatttgacccagcatttgctaaccttcaaagctaacaaaatttctttgacccccatggaccacttcctctttcaccatgacatcctgaaggaagaggaaatgccccaactttccaacacatcaatttcataccagccttatcagtaaatactccagtgtgtgccatgcaagtttcagaaacctagatacctggtttgtccctgtcccagctcttccttcttccccaatcctgccttgttaatcggcatattataggactcataaaattttaggactttctgccctaaatgtacactttgacccacttaaatggaacagatgactgtggcagctgtgcagtgactattaacctgcaccgaggagtgcagcaaatgaaaacttccttttctgctgaaaaaaatagctgttatcaagctctagagcgttagtgtgagaaccataaccagaggtttcatgaataggtccctgttactaagtccttttcatggcatcttatgacaaaatggggtttttcagtaattatccttattaaaagagcagtatcattttggctggttctaaacatatggttgatgagaaaagtttaggcaaaagtcaatttgtagaatttctctctctcaaggcaagactgctttaggagtgaaaaacacagggtaaaaaaaggacaggataattaactgactaaagtgagtacttgccaatctttatttatgctaaaagagagattgcatttttatatcagcccatcctaaattcagctggatataaatgcaattaggtaattaaactgaattaaaaattatagttaacaattcaaaggctttgtgactgagaataaataaatacccttgttatttgaagacaggaatgctatttcagcaatctagaaagctcagaaggaaattgagaaagtgttgtctgtggtagggcccgagagggaagaagcatgaagttcataaaaatttgcctgaagtacttgccattgtatgtaaacaaagggacaggtacacatacagaagtcctatttactaagtttgatttgatttacagagagcaagcactgagattctgaatgttttttgccttgtggaaaatagtagtcatttgtaaaataaagtgggaagccatgtgaggcctgataaccttaacaaataattgattgaatggcttcttgtgaaaagaaaaactatctcctttaacagatatagaatctgagtccaaagagataaagggttatgcccaagtcacatagtaagtgattgtgccaggttttagatctgtgcattcctgtttgagagcccctgtgcagtgcctttctgccctagcattgctcaacagtttatataagaatgctaatggcagcgttaaatgtgttgtagaatacctataccttagaatacattgtagctattaaaaatgataaatctgtattaatgtgggaaatgttcacaatatattaagaagcaggttattcctaattttaaaatggacaaagggcctgaatagacatttctcaaaagaagacatacaaatgcccaacaggtatatgaaaaactgctcagcatcaccaatcatcagggaaatgtaaatcaaaaccacaatgagatatcccctcacacctgttaggatagcttttatcaaaaagacaaaatgtaacaagtattggtaaggatgtggagaaaagggaacccttgtacactggtgggaatgtaaattagtatagccattaaggaaaacagaatggcagtttctcaaaaaattgaaaatagaactaccatatgatccagcaatttcacttttgggtatatatcaaaaaaagtgatcgcagtatgtggaagcgatacctgcactccaatgttcactgcagcactattcacgatagccaagatatggaatcacctaagtattcatcagataaagacaatatgatgtatatacacaatggactactattcagccttgaaaaagaagaaagttaatgtcatttgcaacaacagggatgaacctgaaagacattatgctaggagaaataagccagacagagaaagacaaatactgcatgatctcacttgtggaatcttaaaaagttgaactcataggagcagagagtagaataacgtactatgtacttgaaaattgctgagtagattttaaatgttcttaccacaaaaatatatgaagtgatgttagttggcttgatttaatcattctacaatgtatgcatgtatcaaaacatcacattatagcctatatacacaataaaaataaatttgcttgagataaaatattacgaaatagtatatatatagtgatctctccttttttaaaaaatttcaatagttttgggggaaccagtgatgtttgattacatggataggtactttagtggtgatttctgaaatttggtgcacccatcacccaagtggtgtacgctgtaaccaatgtgtagtcttttatcccttacctccctcccaccttgagtccccaaagtccattgtatcattcttatgcctttgcgtcctcatagcttagctcccacttataagtgagaacatacgatgtttggttccattcttgagctacttcacttagaataatggtctccaggccaggcgcagtggctcatgcctgtaatcctagcactttgggaggccaaggcaggtggatcacctgaggtcaggaattcaagaccagcctggccaacatagtaaaacccccctctactaaaaatacaaaacttaggtgtggtggtgcatgcctgtagtcccagctacttgggaggctgagtcaggagaattgcttgaacctgggagatggaggttgaggttgtagcaagccaagatcgtgccactgcactccagcctgggtgacagagcgagactccgtctaaaaaaaaaaaaagataatggtctccaactccatcctggttcctgcaaatgccattatttcaattccattttatggctaagtagtattccctggtatatatatacaccacgttttctttatccacttgttgattgaagggcatttgggctggttccacatttttgcagttgcaaattatgttgctataaacatgcatgggcaagtgtttttttcatataataactttttttcctctgggtagatacccagtagtgggattgctggatcaaatggtagatctacttttagttctttacagaatctctgtactgttttccatagtggttgtactagtttacattcccaccagcagtgtaaaagtgttccctttccaccacatccaccccaatgatggccattcttgcaggagtaaggtggtattgcattgtggtttttatttacatttccctgattattagtgatgttgagcattttttcataagtttgatggccctgtgtatatcttttttttgagaattgtctattcatgtccttagcccactttttgatgggattatttggttttttttccttgctgattttaaaactggaaaagttcccttgtcccccttgcagggcgtgcgatgagggtgtggcttccttcttcaatgccccggtgctcagacctctacgggagcatacagatgggcaggctgtagggctccgaccccacagcagtgtctgggggtgaatgtttatagctcctgaagccccagtgggcgtgtgttacagtgtgctcttttagttttgctgtctataggcggcttgtgttaaccagctctattagacccctgccttatcgcaaggacagagggctttctgtatcccggggttcttgccttggtgtaccagaagactcggatcacatgtgggcttggagaatttgagtgcaaggttccactgagcagaagtagctttccgcggatgggggagccagaagggaaatggctttcccctggagttgggcccttggcggccccagttctcctccgactgccccgaccaaactgcatcattccaccggttgatgccctgctggcctgccggcctgcctatgcctgtcagtgtgctcttctgccagcgtgcttctcaacgtctgcttgacgaccagccacttgtgtctttctctgcccatgtgttcctcacaacatccagccaccatgtgttcctgctagggtcttgggggtttttataggcacaggatgggggcgtggcaggccaaggtggtcttgggaaatgcaacatttgggcaggaaatgcctgtcctcacctaggtctgtggggatggagccctagccagggatcacaccttcttctgcccaacacttcccttcccccattccgtatcatttaaagggaccatgctcttcccttcccagcactcccgtatcaatttttttgagttccttgtagattctggataatagtcctttgttggttgcatagattgtgaagactttctcccactctgtgggttctttgtttactttgctgattatttcttttgctgtgcagaagctttttcgtttaattaagtcccatctatttatctttgtttttcttgcatttgcttttgggttctttgtcatgaactctttgcctaggccatgtctagatgagtttttcccatgttatcttctagagtttttatggtttcaggtcttagatgtaagtctttggtccatctggagttgatttttgtataaggtgagagatgaggatccagtttcattctcctacatgaggcttgccagttatcccagcaccatgtgttgaatagggtgtcctttccccacctcatgtttttgtttgctttgttgaagattatttgtctgtaagtatttagttttatttctgggttctctgttctattgcattggtctatgtgcctatttttatacgagtaccgtgctatttgagtgactatagccttgtagtgtagtttgaagtcaggtaatgtgatgcctgcagatttgttctttttgcttagtcttgctttggctatgtgggctgttttttggttccatatgacttttcagattgttttttctagttctgtgaagaacgatgatggtattttgatgggaattgcattgaatttgtagattgcttttagcagtatagttattttcacagcattgattctacccatccttgagcgtaggttgtgtttttccatttgtttgtgtcatctgatttcttttagcagtgttttgtagttttccttgtagaggtcttttacttccttagttaggtatattcctaggttttgcagctattgtaaaaggggttgagttgttgatttgatttgcagcttgtttgctgttgctgtatagcagtactactgatttatgtacattgattttgtatcctgaaacctaacagaattcatttatcagatctaggagctttttggatgagtttttagggttttctaggtatacaatcatatcatttactaacagtgacaggttgacttcctctttaccaatttggatgccttttaatttctcttttctgactgactgtggctggctagggcttccactactatgttgaatagaagtggtgaaagtgggcatccttgtctttttccagttctcatggggaatgctttcaacttttccccgttcagtataacgttggctgtgggtttgtcatggatggcttttattaccttcaagtatgttccttctatgctgattttgctgagtgttttcatcataaagggatgctggattttgtcagacgttttttctgcttctattgaagtgatcatgtgttttcgtttgtttttctcttagagtttcgctcttgttgcccaggctggggtgcagtggtaccatctcagctcactgcaacctccaccacccaggttcaagggattctcctgcctcagcctcccaagtagctgagataccacatctggctaatttttgtatttttagatggggtttcaccatgttggccaggctggtctcaaactcctgacctcaagtgatctgccctcctcggcctcccaaagtgctgggattacaggcatgagccaccgcacccggcctgatttttgtttttaattctgtttatatggtgtatcacatgtattgacttgtgtatattaaactttccctgcatccctggtttgaaatccatttgatcatggtagattatctttttgatatactgttggatttggttagctagtattttgttgaggatttttgcatctatgttcatcagggatattggtctgtagttttcttttttgtcatgtcctttcctggttttggtattagagtgatactggcttcataggatgatttagggagtattccctctttctcttttggaatggtttcagtaagattggtaccagttcttctttgaatgtctgatagaattcagcagtgaatccatctggtcctggactttttcttcttggcaatttttttattaccatttcaatctaagtgcttgttattggtctgttcagagttcttatttcttcctggtttaatctaggaggttgtatatttccaggaatttatccatctcctctaggttttctagtttgtgagcacaaatgtgttcatagtagccttgaatgatcttttgtatttctgtggtattcgttgttaatatttcctgtttcatttctaattgaacttatttggatcttctctcttcttttcttggttaatctcactaatgggctatcaattttgtttatcttttcaaagaaccagctttttgtttcatttatcttttgtattttgttgttgttgtttcatttttattaagttctactctggtctttgttatatctttcctcctcctgggtttgggtttggtttgttcttatttctctagttcttgaggtgtgaccttagattgtcaatttgtgctctttcagactttttgatgtaggcacttaatgctgtgaactttcctcttagcactgcttttgctgtatcttagaggttttgttaggttgtgtcacttttttcattcagttcaaagaatttttttaatttccagcttgattttgatttcattattgacccaaagatcattcaggagcggattatttaatgttgcatggttctaagaattccctttggagttgacttccaattttattccactatggtctgagagagtacttgatataattttgattttcttaaatttattgagacttgttttgtggcctatcatatggtctctatcttggagaatgttccatgaatgttctgatgaatagaatgtatattctgcagttgttgggtagaatgttctgtaaatacctgttaagtccatttgttctagggtataagtccattgtttctatgttgacttactgtattgaagtcccccactatgagatgagattctatttttgtgtatttcaaggttttgctctaagatttagaactccttttagcagtttttgtaaactatgctggcttggtagtggcaaattctctcagcgtttgaaaaagactttcatcttttcttcatttatgaagcttagtttcactggatacaaaattcttggctgataattattttgtcagctaataattatttaataaggctaaagataagacctttatcccctctagcttgtagagtatctgctgttaatctgataggtttttcctttacaggttacctgatgcttttgcctcccagctcttaagattttttccttcatcttgactttagatagcctgatgactgtgtgtctaggtgatgatctttttgtgatgaatttcctgggtgttctttgagcttcttgtatttggatgtctagatctcgagcaaggccagagaagtttttattcttttgcctttgtctttgttgaattgggttaattcaagagccttgtctttgagctccaaaattctttcttctacttgtttggttctattgttaaaactttccagtgtattttgcatttctctaaatgtgtctttcatttccagaagtcatgattgttttttatttatgatatctatttctctggagatttttttcgtctacatcctgttttgttttatttttaaatttaagttggttttcatctttctctggtgcttccttgagtagcttaataattgaccttctaaattcttttctggcaattcaaagatttattattggtttggatccattgctggtaagctagtataatcttttaggggtggttatagaaccttgttttgtcatattacctgaattgtttttctggttccttctcgtttgggtggactatgtcagaagaaagatctgggactcaatgtgtgctgtttaaattcttttgtcccacagagtgatcccttggtgtggtgctctcccccttccctaggggtggggctttctgagagctggactgcagtgattgttattgctcttctgggtcgagccacccagcagagctactgggttctaggctggtactggagagtgtctgctaagagtcctgtgatgtgatctgtcttcaggtctgtatgccatggatactagcacctgctctaatggaggtggtaggaaaggagtgaagtggactgtgtgagagtacttggttgtagttttatttagtgtactggttgtcttgaatgctagttatactagcactgaagttattacatggacagactcaggacctctctggttggccaagatgttacaggcagtagaattagctgttattttctgctttcttggagcagggttgttctgttgaattgctgtaatggcttgaattggttggcctccagccaggaggtggcactttcaagagagtatcaactgcagtagtatagcgggggatataagcttgccttacggtttcctggataggttttcgggcttctcaggcaatgagcagggccccacgagtttttgtcttttgtttacggctaccagggcggttagagaaagaccatctggtgggggcagggatagtgtgtctgagctcagactccttgggcagggcttgctgtggcctctgggcgatgggagtggtggttaacaggccaatggagttacgttctaagggagattatggctgcctctgctgcttcatacacatcaccagggaaataggggaaagccggcagtgacagaccacagccagcaaggccagtctcactcctgcagtgcttccccaacagccaacagaaccaaatttatatccatgcctccagtgcacagggtggagatcttgccctagactacaaaactccccgccgagaaagcaagcagggctgttaggccttgtccatctgcctgccacagcttctgtgctcatatctgcacttcctatttgtcccatccccctgcagattctgcccaggaaaattcacgctcagttgaaatcattacaaagttcagctgaaagtctccttctccctatggtccttccccaattccattggctgccctctccaaagacccctgtgagatagtcagaaatggtttccctggggaccaggagtgcctacagggctcttcctgctgctgcttctacttttatattttgtttggctctctaaattcatttcagttctccttctcccatgatctggatcctcagtgaggatgtgtgcagaagtggactttacccctctcacactgttttttgtttgtttgtttgtttgtttgtttgttttgaaacggagtctcgctgtcaggcaggctggagtgcagtgcatgcgatcttggctcactgcaacttccacctcccaggttcaagcaactcttctgcctcagcctcctgagtagctgggactacaggtgcacaccaccatgcctggctaatttttgtatttttagtagagacagggtttcaccatgttggccaggctagtgttgaactcctgacctcaagtgatccacccacctcggcctcccatagtgctgggattacaggcatgagccaccacacccagccaccctctcacactttggaccttgagagcttgtttggaggttctagcaggggagcacatttactcgtatacccttgactgaagaccgattctcctcttatcaggaatggttgtcctcttcgaccaagcacacagcttcgggagccctctcacactttgggcactcaatttttctgctgtcttgtggattttgcagcagcaagccacttctttcaaaggatctgttaattcttttgttttttctggtatgttcctgtgatagttcttggagccaaagttcactatgtgagtctccacatgctgttctgtctgtctgagtggcaaattagtcctgcctcctatctgccactttccccttaaatcagtctcatttttgtaaagaaaaaagttgagatgtatagtatgtatcacatgcacaaatatagaaagtatgctaaacatggtttacgtaagtgctttaaattttttctctttatgtttttcggtattttgtcgatttttacaagtatatattttataatgggatagttgggaggttggtgacttggaaaagagaaaggaaaatgataaaagggtgtggttggaatcaagtgatgtatacctacttactggcaaattgacccttagatgattaggttagctatgatttttcttgatgagaatttagggactttgtatggctttcacttctgatcttcatgatcctctcctctttttcagtaacagtaacgagtagccagagtactcctgccaaagcccccagggcaaagtgcaatccatccaattcttccccgtcatccgcagcttgtgccccaagctgtgctggagacctccctcttccttcaaatactcctacgttctctattaaaacctctcctgccaaggcccggtctcccatcaacagaagaggctctgtctcctccgtctctcccaagccaccttcatctttcaagatgtcgattagaaactgggtgacccgaacaccttcctcatcaccacccatcactccacctgcttcggagaccaagatcatgtctccgagaaaagcccttattcctgtgagccagaagtcatcccaagcagaggcttgctctgagtctagaaatagagtaaagaggaggctagactcaagctgtctggagagtgtgaaacaaaagtgtgtgaagagttgtaactgtgtgactgagcttgatggccaagttgaaaatcttcatttggatctgtgctgccttgctggtaaccaggaagaccttagtaaggactctctaggtcctaccaaatcaagcaaaattgaaggagctggtaccagtatctcagagcctccgtctcctatcagtccgtatgcttcagaaagctgtggaacgctacctcttcctttgagaccttgtggagaagggtctgaaatggtaggcaaagagaatagttccccagagaataaaaactggttgttggccatggcagccaaacggaaggctgagaatccatctccacgaagtccgtcatcccagacacccaattccaggagacagagcggaaagaaattgccaagcccggtaagtcagcagtggtgggaagatacatttcctaacttaaaaggggccagacacccagatgtctcaagtcaggatgcttttttttttttttaaagaaagaaatctatttattcctagtgctgccaaattcagcacataaatacaaaacaaattttgcatgggccatatttttagtaaaaatgttttatgctaagaaactatttttgtttgtctgaaattcaaatgtaactgaatgtgctgtattttatctggcaactctacttactcccattaaaatccctcctgtcagggtccatactcctcagccctgttgcctgattgaccaaagccttcatcatgctccaggatatcaattcaaaaatatctcccctctcctgttagacagtatgccatcctctttttatagataaagctgttgttcatgggaaagttgccaacatccataagtagatttccagtttgtaattccattttgtgattatttaaaatacagtgaaacttagatacttacaaaacaatttgagtgcaaaatctttctagatttttatgacttctccacaatcttttataatcattttgccacaccacagtaatacttttgacacctatatctattctttttaacattcagtgtagtgtcacttatctttttaggactcatttcattgactgacttaatatttaaattagataatatcagtcatcagtgattgatggcagaaataggtttgtgaaccttgaaaaacaagattcattacagtggtggaggcagaagtagctgagtgcattgggtgagctatgggcaccagtcagagagaataaaaagcttctgttgtttgcatgtgaaggggagatgggttaaggaagtttccactgtacttcacagtagctcttgtggtggcgggatgattgaaatagaatccagaatcatgatcagcatcatctgccattttaaagggcagaagctagataaccaaccttaggccagttttagtttaaaaagtgttcataaccccgacctgctctcatgaagacctatcccataattttagaaaaataaactgatagattttaaagacaacttagtacacaaactgcaatcaagaccttgctgtagaaagtggagaaaaaagacagttataaggaatctttccttctctcaaaattatgactgctctttatccctagccaaaatttctattttttttttcaagggagctggtctcagctatgtgttagcagaaaagtagtttcaatgaaaaactattttcactgatacataaatcttaaaatctttaaaaagtagaaacagtgtgctggtcttgtaatttatttgaagctaacatttcttaaaaattttttacctttatatgatgataatgtcaaccttcagaagagagtaacatcttccatttgaatacctatcttgtttataaattgggggggctgatttattcatttatttcaaaaaggatagtaattgtaacttatttgtttcttattaggagacttagctagtaaatgttttctattcacataagaagtctatgccttctttccctacatatcatctgttaagtttttactatagtcagtacaaatcagccaaaagagacattgccattgaaagtatttggagctgaaagcaggctaaacaatgaaatttctggcagcctaatttaaggtatgccttagtaataacttagtaacagttgaacttcaaggaaatctctgaaatctaaactttcttcttctaggtcaccatcacgcccagctccatgaggaaaatctgcacatacttccatagaaagtcccaggaggacttctgtggtcctgaacactcaacagaattatagattctaatctgagtgagttactgagctttggtccactaaaacaagctgagctttggtccactaaaacaagatgaaaaatacaagagtgactctataactctggtctttaagaaagctgccttttcatttttagacaaaatcttttcaacgctgaaatgtacctaatctggttctactaccataatgtatatgcagcttcccgaggatgaatgctgtgtttaaatttcataaagtaaatttgtcactctagcattttgaatgaatagtcttcactttttaaattattcatcttctctataataatgacatcccagttcatggaggcaaaaaacaagtttcttgttatcctgaaactttctatgctcagtggaaagtatctgccagccacagcatgaggcctgtgaaggctgactgagaaatcctctgctgaagacccctggttctgttctgcctccaacatgtataattttatttgaaatacataatcttttcactatgcttttgtggggttttttttaagtatgtgtaaaaatgtgatgctcagataagtacatttatatcagttcagtgttaaaatgcagtctcttgagttaaagtcatctttattttaaatgcagtgataaatgtcaactcttcggagaaactaggagaacaacaacagaaagctgtgtttgtcttttttctctcaaatatatctcccgtatgagatttcaggtccccatgttttcaccaagcaatctgctatgtcagccaacccaacatcactttctacaggaggttatgatttttgccatttactagaggaagatgttttatgaaatcaatttggggtttgaattcaggtgcagtcatcagttctttaggggctgcaatgttttaaaaaaaataagtcatcagattttaagaaaaaagtgatgatttcttattgatatttttgtaacagaatatagctcttaactgaaaatccagaaccagaaacataaatcttgagtttcttttcatgtacataaaaagcaatagccttttagtatagatagccctgagccaaaaagtaatagaattttctctagatatttaatacagagagtgtatagactgactctaagttaataatgtgcaaaatatcttaaacatccctccccttattcaacaattatgtatcagtgatcttgaaccattgttttatatttttcacctttgtaacctcatggaaagaggctttacatactttctatgtactatttacttagaagggagcccccttccagtcatgaaacttcatttgttttatccatatccctgaggactgtgtagactttatgtcagtttttgtcattatttgaaaatctattctgacaactttttaattcctttgatcttataagttaaagctgtaacaactgaaattgcatggatcaagtaagcatagttttatccagggagaaaaataaaaggaagccatagaattgctctggtcaaaaccaagcacaccatagccttaactgaatatttaggaaatctgcctaatctgcttatatttggtgtttgttttttgactgttgggctttgggaagatgttatttatgaccaatatctgccagtaacgctgtttatctcacttgctttgaaagccaatgggggaaaaaaatccatgaaaaaaaaaagattgataaagtagatgattttgtttgtatccctacccatctcctggcagccctactgagtgaaattgggatacatttggctgtcagaaattataccgagtctactgggtataacatgtctcacttggaaagctagtacttttaaatgggtgccaaaggtcaactgtaatgagataattatccctgcctgtgtccatgtcagactttgagctgatcctgaataataaagccttttaccttatctgatgtccttttctgagctttttgcattacctagaagcagtctacaaaaaagaactatagtagtcaagaatcccttctacttgttcattaaaatgtttattcccaaagttataatctatttcaagctgaaagagcttttaataaaaaacatcttgcttggatcagactttgagcatttaagatggcttggattacttgataaagcagggtggagtgatgtagttctttttctaaacaagtatttccagcacaaacttttccatttgaatacattccaagcactattgctaggatcccgtattagagtttgcttttggctgtttcaacacgggcccttaattaaattttgtgaggatgactgattagtgtcttcaaatgtctcttcatctggactgcacatttaactgatgttggatcaagaccatgtgtagctactcttgtgttgagggtcagcccattatccccatccccagccctaacagcttaaaacagctttaactcccatcttgaaattagcctatggccatgttcataacataggtagtgtgtgggttcaacaaatgctttttgagagcctgtcatagccaacacactactgctcttaagtctgtttttctgcttttcctagtccctagttccttttacattgctcttaaagcaaaggccaagtagtctaacagagaaaaataaattccacaactaagatagtgtgggcaacattttacaaatgtgtgtcagaagacagactgagtgaaaacattgtactagaaaaactgagttaatttcctccctatggcaattcaacacaagtggtttctgcttcataattccataaagggctaaatgtaggcccagttgagctcttgcagtagatctcattgcttctcacacaggtcttcacagggaattctttgcctgccctaggtttggatcatgccacattaccaattaacccattactcataaaattctcagggattatggtaaaaaaattggattatgcatcagttctttagatattggttggaagttataggcaggctgaacacattttgttggacttgagttaagtttaatgctttgatgcctggaatacgaccccagcttgttataagttaaccattttgttccctaaagtggtagcaaaacctgttttatttctgagctgtgtttgagtgcaagctaaaaagtgtaggggttgttaagaaatgatataagataaattcagcctttaaaaaagaaatcacctgagcatattaagcagcttgtttatattggtatgcctgcagcaagcatatacatcacaaatgagagatattgtgttattaaagaataggcttacttgatccccaaagttcatcccttgctaagccaggaaagaggatttttagggtatgcaaccaggttcttcactttgaatgtaaaaggtttaatattccatttgtactccatttctctttaatttccttaacttgccacatgcccctttgttttgacattctgaatagtttatattcaagccattttgtgaaatatgaatagcacatttcaaaatgcctttgattggaaggcgtttaagtcagccaacatttacatatcacctgggtgccaagccctgtgtgtgaggcacctggtctgcaaagagttcctttctttattttcagttgccaaaggagtcactttaatacttcagtaggccagagtcagcatttgagagaaacagcaaagatcagatttcaagtcctttgagtaaagttgtttgtaatcagctattatgtagcaagtactgtctagaagcctacttttcctccaggaacttaattcagcagctgcttagaacttttaacttctcaaagtaaaatactttttggatacatgtttttattatattccttataaggttataaataatggttgaaaacatgatccctagtgccacactgtctagctttaaatccaagccctaactgtgtccgtggacaagttacttaacccttctgtgaatgagtttcctaccttaaaatggaattatgtggggccggacacagtggcttatgcctgtaatcccagcactttgggaggccgaggcgggcagatcacaaggtcaggcaattgagaccaccctggccaacatggtgaaaccccatctctactaaaaatacaaaaattagctgggcttggtggttcacgcctgtaatcccagccactcgggaggctgaggcaggagaatcgcttgaaccagggagtcaagtggttgcagtgagccgagattgtgccactgcactccagcctgatgacagagcgagactccgtctaaaaaaaaaaaaaaaaaaggatttttgtggttattacatgtaaagctcttaggacagtgcctggcacataatacctaatgttttattaaacagttgctgttagctgttaagtatggagggcaagagttattatctatattcgatacatggacataaaagttcagctcattcctgttccctttccactaacagctgcagtctgcaaaggtcttcacaaatcagaatcaactggtaatta

SEQ ID NO: 585 - DNA, 8206 bp, Homo sapiens
gttttccataggttcctgactaggttaaataaggtggagcaaatagccccaccccaaaagcaggcttcaggatttgaagtttgagcccatccctgaggtagagccggaatttacctttgtacttcacacggtcagggttggtggtgactacgtgggtctggagctgactgccgtcctgacacgtcctagagctgcaagcaggtttgaatccaggatccctgtgactctgctgttcctctccccaccccctatattctttatccttttcccttcaggactttcccacaggttactaggtctcacataatttctactgcccttgaggacccctgcctaagtaagatttctactacctgccaacggggtaatagtctcaggtagatttctactacctgactatagggactgtcgactaactctcagtagccctttatcaaaatacctagcactgtttcctggcaggaaatgctgggaagggtgggccccagagcatgatcaactgaaggtagaggttaaggatcagggctgaggtgggaagatggtgtcggtcaccaaatatgaccttactggctgctctgccttctgcaggtcctgccagagagccaccatgacctctcagcctctcaggctagcagaagagtatggcccaagtcctggggagtctgaactggctgtgaacccctttgatgggcttcccttctcttcccgctactatgagctgctgaagcagcgccaagccttgcccatctgggctgctcgctttaccttcttggagcagttggagagtaaccccactggagtggtgctggtgtctggggagcctggttctggcaagagcacccaggtgtggtgggggttgtgggggcaggcagattctgggagtggacaaagggaggacaaagggaggacaaagggaaagtggcctttccctgggcaaggggggactgggctgcgtggggtcatgaggaaggtgaacgaagagagatgggatgggttaggttggccctggaggctggtgaaagaccaggggactccccaaataaggaaagattaaagtggccatagttccctgagcacttctgactgaagtcctacatcttcctcactggctctccttccctacttctatcccagatccctcagtggtgtgcagagtttgcgctggccagagggttccagaaaggacaggttactgttactcagccctaccctcttgcagcccggagcctggctctgcgggttgctgatgagatggacctgaccctgggtcatgaggttggatacagcatcccccaggaggactgcacggggcccaacaccctgctcaggtgggggcctctgcaggccttacccgaatataattccccttattcagtagaaacaaacccattcctctggcatctcaccataccctcccttagcccaactcactcttttttattttatttattttggagaaagggtctcactctgtcacccaggctggagtgcagtggtgcaatcacaactcactgcagcctcaacctcccgggctcaagtgatcctcccacctcagcctcccaagtaactgggaatacaggcgcgcacctccacgcctggctaatttttatattttttgccatgttgcccaggctggtctcaaactcctgggctcaagtgatccacccacctcggtctcccaaagtgtaaggactacaggcatgagccaccgtgcctggccccaactcactctaaattgtgtgtggtgcaatggctaaaataagcccttgaatcccagccaggggcctcagacattcagcctcaccctcatcagaaaaatttcacttcccagctggcgtataccttgtgaacaaagtgttctcagcggggttgtggggtgacagttatgggtccataggctcaggaagtcacagcatatttttctgaccttcaatatcaaaatatacgtcccttggggagaagattccctgagcttgtggggctggtcagtgtccacactgattcctctgcccactaccaatgtcaacaggttctgctgggacaggctgcttctgcaggaggtggcctcgacccgaggcactggagcctggggcgtgctggtactagatgaggctcaggagcggtcggtggcatcagattcactccaggggctactgcaagatgccaggctggaaaaacttccgggggacctcagagtggttgtggttactgacccagcccttgaacctaagctccgagctttctggggcaatcctcctattgtgcatatacccagagagcctggtgagagaccttcccccatctactgggacaccatcccacctgatcgggtggaagctgcctgccaagcagtgcttgaattgtgtcggaaggagcttccaggagatgtgctagtgttcctgcccagtgaggaggtaaaaaacaaaacaaaacaaaaaaaacagcctgcaaaatgagcctgcaaaaggaggtactcatcatcatcttccagtcctgaggaatgggaatgggagcaatgcctcttaggaacagtagagttgcagtatttactctccgttggggtcccagagaaaaacttgaggatttcagggtaaagaggtttaccactcacttttttattccctttaatgcagagatttgtgattcagtgaacccctgaaattataaaaccttcaactttatgagtaatttgcattttctcagagtgaagggccataactttcaacagtctttcaaagggatctgtgaccccaaaaaacgtgagaactgccctaatgccccacccacccttcttctcaggaaatttccctgtgctgtgaatccttgtccagggaggtagagtccttgcttctccaagggcttccaccacgagtactgccccttcacccagactgtggacgagccgttcaggctgtgtatgaggacatggatgcccgaaaggttgtggtcactcactggctggctgacttctccttctccctcccttccatccaacatgtcatcgactcaggactggagctccgaagtgtgagtgagagagagagatagcggtggggtagtaaagacagaaatggcccactctgatctgtcttggccttggttgggggacgggcaacaggtttacaatcctaggatccgagcagaattccaagtgttgaggccaatcagcaagtgtcaggcagaggcaagacgattgcgagcaagagggttcccaccaggtaagagcctttgccctcactgaaataaaaaacccaagagtcaccaacatgcaagccctgagaaatctacagtggtcttctttcccaggtctttttcccctcaggatcctgcctctgcctgtatcctaagtccttcttagaactagaagctccaccattgccacaacccagggtgtgtgaggagaatctgagctccctggtgttactactaaaaaggagacagattgcagagccaggggagtgtcacttcctggaccagcctggtgagcacctctcctgcccaagcactgccatctgaccacccagttctgaaacttcatatcctgtaagccctgtttcctcaccagctccagaagcactgatgcaagccctggaagatttagactatctggcagccctggatgatgatggggacctgtcagatctgggtgtcatactatcagaattccctctggcccctgagctggccaaagccctgctggcctcatgcgagtttgactgtgtggacgagatgctcaccctggctgccatgctcacaggtataaatcgctgctgtaaatccatagctcttgaaaccacttcagcccttcctcttgggttttggtgctcctgaggctagccctttcctctctgctccagttgccacccctcacaatgcctaaagaaccaggcttagtcacccatctccctcttgtctctttagccttttttctctgctggttcttgccctcagcatgcttaaatctctcctaatctgttattgctaaaactcacacacccctcttcctcaaccctatcctccccttcagctatgcagcatgatttctatcctgttctaactggtgtattgctcacccactgcactccagcttcaggtctaccatgccagtgaaacagctttcaactcaccagtgaccttccaggtacctaatccagtggatacttttgaacccttattcatgaccttcttttgacacttgagattgctgaccgctccaccttgaaactgcctcctccctaggcctctgtaacgctgctcctcatggatttcatcctacgtctctggtcatcccctttatcttttccttgagctctttgtcctcttcttatccattgtaaattggtcctcagggttctattcttgcctcttttgtcttctattccctgaactctctgagcaagtttatccacacccatggtttgaagtgctacctttagccttaaaatttccaaaccttgtgccgtgtatctctcacccaataccattcttcgaatctgagagacagagagagagcaagggagagacgcatggggagagggggagagagggagagggaaagagggggagagagggagagggaaagagggggagagggggagagagggagagggaaagagagggagagagagagagcatactccaactcctgatgaacgtttctttttttctttttcttttttttttttttcagacaaagtctcactctgtcacccaggctggagtgcaatggcatgatctcagctcactgcaacctctgtctgcctggttcaagcaattctcatgcctcagcctcccaagtagctgggactacaggcacgcaccaccatgcccagctgattcttgtatttttagtagagacgggtttttgccatgttggccaagctggtctcaaagtcctgacctcaggtgatccatccacctcagcctcccaaactgctgggattacaggcctgagcctcggcacccagcccctgatggacatttctaccagaatagttaacagtacctcagctcagaactgaactcaaatgctctattaaaccactccctcaccaccatcaccacaaaatcttttcctctctctagagtcttagattcagataatactattatctctgctgctctgctaccatcactctagaccagtctttctccaggttatttcacttttatctcctaaatgtaaatatatatataaatatattcatctgtccttctccatattcacttccagtgaatacggtaggtaggatctgccaatggtaggtcctcctcattgctcagctggttttcctcagtagcctcctaactagtaatgtgaactttttcagacacatggactctcttacttaaaaactcttcttcagccaggcgtggtggcttgtgcctgtaatctcagcactttgggaggctgagatgggaggatcacatgaggtcaggagtttgagaccagcctgggcaacataggagagaccctgtctctacaaaaacaaaaaattagccaggtgtggtggcatatgcctgtagtctcagctactgaagagactgaggtaggaggatcatttaagcctgggaggttgaggctgcaacgggccatgatcacgccacttcactccagcctgggcaagagagtgagaccctgtctcaaataaacaaacaacaacaacaaaaaaaaccccacaactcttcctctacagctactctttaccttaaagacagttcctttcctcagtactccagcctctcatgaccttacctatacctacctctccagctttatctcctgccattctgccacgtcatttcattccctccacccataccagatggcttgcagttccccaaatatgctatattattaacttacgtgccatgctgttgccacagtctaaaacatactccctgccccgtctccactcggctaattcctactcaaatttcaaatactagcccaagggtcctcatcgttttctcttacatcactcacatcctcaccacctaaagcctggattaggtatcctcctctttgtttccacagtaccatatacaaacacctatcatgcttatcaagtctgcttacctgttggtctctcccaccagacttgaagctccttgatggcagagactgtatttcatttacttatcctcaatgtttaataaagtgcatagcacctagaagttatctatgtcttttgaataaagttcccaaagggacacttctgccttttcagcattctacctgtactactatcccttcccatttcccaaatggcagattctaccttccactcttctgcctccagctgcccctgggtttacccgtcctccactcagtgcagaagaagctgccctgcgtcgggccctggaacacacggatggtgaccacagttctctgatccaggtgtatgaagcctttatacaaagtgagttctgcatccttttatagaatcccagattttccaaagaggggaaattttatgcagccagctgacagatctctatgctcagaaagaggaggccctttggctaagggttgggttatttcaggggtctcaaggactttagtttagctggtccctttcctctcctaggtggagcagatgaggcttggtgccaggctcgaggtctgaattgggcagcattgtgccaagcccataaacttcggggagaactcctagaactcatgcaacgaattgaacttcccttgtccctaccagcctttggctctgagcagaatcgcagagaccttcagaaagcactggtgtcaggatactttctcaaggttagaggaaagggtgggggtgagggtgatcaaaggagcaaaaggcaaagagaacaaatattggtaagccactttgaaatcagggtccaggtggccattcaaaagattctttagaaccagaaaggacttttcccttgaggatttgaggtacaaggggctatggtaaatgccatgaggtatagtagagaccagacaacacctagaggtaatgctttacttttcatgctctcatcacccttactctttctcaatccccttttatttttttctactgcctgcctcttcccttttatttattccgtcaatatttctgcctttcaataaggtggccagagacacagacgggactggaaattaccttctcctaacccataagcatgtggcccagctctcctcatactgctgctaccgaagccgcagagctcctgccagacccccaccatgggtgctctaccacaatttcaccatatccaaagacaactgcctttccattgtttctgagattcaaccacagatgtgagttccctgacatccctcctatactgcctattcctctccctggggccaaaattatggctggggagttagagagacagaggaagggatcttagtggttagtaaaaacatgatctgaggagacaggatttgtggaagggctggtgagaagtttaaaagtctgcattataagagaagatgcacttttggagacctaggcaggaggagtccttgaggctaggagtttgaaaccaccctgtagtcccagctacttgggagattgaggtgggaggattacttgagtctaaggctaaggattacgggagtctaaggctacagtgagttatgatcatgccactgaactccagcccaggtaacagagcgagaccctgtctctaaaaagagagagacagagagagagaagatgcagatcatctaattatgactctctctattaggctggtggaattggcccctccatacttcctgagtaacttgcctcccagtgagagcagagaccttctgaaccagctaagggaaggaatggcagattctacagcagggagcaaatcatcctcagcccaggagttcagagatccctgtgtcctgcagtgacctgcctgcctatggaatggagctgggttcatctcatcacattagattatccctcagggtgacaccaaagcacccagacagatttagaagcccaaagtttagggtcaaatgtaaaccctggaacctgagtcccaagaaatggtagactgggaatggaaagaatggggtaaaccacagtctacatagggaaggactctttccttagccttctcttattgattggagagggactgacatgctcctcattctcttaactttgccaaacccattcttgtactcccttgtgatctataaaagatttttctatgatgccaa

SEQ ID NO: 586 - DNA, 43437 bp, Homo sapiens
ttcctccacttcctggactgcgcgaccggaggcctagcgggcgcgcgcccgcaccatcgactcgccaacgagagaaggtcctggggcacggacaccgacgggttgcgactgtgacgtgaggtgttctcgcgcgcgctagcgcgcgtctccgggtgccgctgacgggcgtgcgcgcttgtgcggagccggaggtgggggccgaaccagccaaggttgcgggggccgcagagccggacgaagacggagggcggagccggcttcgggactgcggagactacacaccgagcgagcgcctgggcccgaagggagcgatgctgtggttccagggcgccattccggccgccatcgcgacggccaaaaggagcggcgcggtcttcgtggtgttcgtggcaggtgaaggaggcaggggttcgagaggcggccgggacacccctccggcctaccttcatcctcttgtatacctcagccgccggcccgccctccccgagacgcgggctcctgtcggctcgcacaattgccactactaccccgcgccccagggacggctgcgactccgccgccagatcccccagaggggccatgcagaccctcagcgccctgctccttcaggccccgggcgcccccagcctttcctcagtgtctgcgaggcccgggctgccggcccgtggctgttcagcgcctccccggttcgtttgagatacagtgggcctggccccaccgctgcgtctcccggcagccgggccggaggcaccgtctggccctggtctccaaagcgccccgaggcccgccgaaatctccccgctcggggcgacggacgcggccagcaggccccagccgcccagccccgctcgtcgccccgagcctctcccctgcgcagccagacccccgcgaccctctccctgacgtccctctctgtcaccaaggaccctctttgtgctgcttgaacgcccgtttcgttactgctgtttagatggaggtaggaacgggccattaggcaagcagttgggttgtaattagttgtggactgtcgggaagaaagctgtgtcatcgataagcaacaaagagaaaccacctgatgttcacggttactggtgttagtacgttcctgaaacgtaaacttttgagctgaatagaggtttaatttttctttatggcagtcttggtaggggatctagtgtgaaataatgtaagtttaaaaaaaatccattagtttcaaagaaaatagacgttcagtccttggtttcttccctttgttgtcttcttaggctaaaatctacacgactttgagaacgtttattaactcatatattctctgttgctctaggctattttgctccatattctcctgttttattactgaaatcttgtagatttacagtgaactccctgcctctacggttctgctcatactcattacatggaccaaatcaatgtttgtggctgttgttaatttgaggtgtatttcttcaactatttgtgtttaataacggtttattcataattaactcgtcttttaatagctctataactttatgcactgcagtgaagaacgaattactgaaatgtgaatgtcatttagcattaaatttggaatttataattgttttgttacgccaagtttttagctcaatgctgtttattagaagagcttgaatagtttagattctgtgatgctgtctgggggttatattatactttacataaattaattctgtaatcccgtaaggaaaaaaatggattgaaaatgaaaggaaaagtaaatgacactatgcttattgtgtacattagtaggtttttgacattttaaattgtttttctcctaatatctcagttgatccttgcagtaaatagaacaggtttaattatccccattttatagatgaggcacttaggtcagcagtcataaagtgacttgcactagggccacaaaaaggatttacatgtcttaacagtcaaattttttagtagcttcaaaaaaactggcttttttgtttcttaaggaaaaaactgaacaatttgtaaattggtgatttaaattggtatagaaatcagaaatttggattatggtagtcatgtttttgaacaaatgtccaaacattcctagaaggcactcttgaggtaaatcagttaatttaaaaaaagaaacgagagatttttattaacaaatattaatatttggaaactctagtacaaattattggaatagttaaataaagttataggtcttgcctttcggggttttgtgtatatatatatactttcttcaattaagtttttactgatgagcatgtattacatgtatttagaatataatgactcttgaatgtttgcaggaagactgttagcaatctcacaaaggagtctctgtctgtcccttgacctgttccaaaatccagctagcttttttagagctttagccagttaatccccaagactaagtaggattagtgtcactctaggagtatgtagatactggactcatgaaaccaaaacacttacagattgcttagagctttcttcataactctgaagtcagaacttgtgattttcttaggtctaagatctcagtaataatataccaacttaatggaaaatttgaaagatgtctttatagttggaagacgtgatctcaagagtacactttggttcatagaactgttcaagtgggaaacgttttaggcaagtggtctttagttagtgacattttcatggatgaattaaagaatattgtagagttgatgttaggagacgagagattactactacttcagctaacaaattaatatgattttcaaagtattgtggctgtgtaaagtaagtgaaacaaaacgatattcatttaatacttgggaaggtagaataatctgacgagactgaagtaaaggtatctgttcactggctaatgttgctaggtaggtaggccaaactttgttaatgatagacgccattttctgccttttttggtgaatgtagaccacagaagcctttaggttttgagcagttgagatttattttacatcggaaagactggctgtatgagggtctgcaactctttgcttctgagttcgtgttgctctctttaagtgccttcgcttaggatactgccgatacaaaggatatgctgttttctcctaaaatcttaggcccacctaactttatagttgataatttgattaaaaataagaaatgaaagataccagagttagcaatcagtcatcccactcagtagtattaggaaagttgtcattaagcattgagtaattccattcagctttccaccactgctgttcaagcagctgctgccaccactaggctgagtctaggacagacactgccagtagggttgagacatctgggaccctaatcacatggtacagtataggtgagggagtgatgcaccagcctcacaagaagcaagatttatactttcagctacttacgtgatatcactgtttagatcctcccaggattctcaagcctaaacgtgtaagtgctgcctaaacctgtgtttctcccagtgttctgcatctgattggcactaccatacatctggttggataaaccataaatatgagagtcatctttgactcttaactcttcagtctcttcttgagctccggattgttcacaacattccaaatcacataggcctttccctacacacgtattccttctgcgtggtgaactcttctggctgttggcatggctgagctctcttatcctttagattttagcttaactgtcacctcagagagggcttctctgaccattataaagagttctcttgttattttctctcatagatttctttttagtagcatttattactgtaattacgtatagtgtctatttgtttaaaaattttgtataccattagattttaagctctgttgaaggcagacaatgtctcatttggtttatatttagtatacagttcaatgcctagaacaaaataaatgcaataaaatagtgaacatataaaagaatgaatggaaaggatttctcattcttcacagccttctctgagaagggttcgtagtaagaatattctcatatacttatttttctttggtaggtgagtcatttatttggaatcttaatctctcctcatcagatggtttctgaagatgcatttagagtgatctcacttgcaaatagtaacttctcgttattttgcatcttcaacatctaggagtctgctaatggagcattcttaatggagcatttggtctgtggatgcattctagtcccgtttactttttttttttttttttttttgagatggagtctcactctgccgccaggctggagtacagtggtgcaatctcggctcactacaacctccacttccctggttcaagcgattctcctgcctcagcctcctgagtagctgggactacaggtgtgtgtcaccacgcacagctaatttttgtatttttagtagagacggggtttcaccgtgttggccgggatgatctagatctcttgacctcgtgatccgtccgcctaagcctcacaaagtgagccaccgtgcccgaccccgtttacttttccatggtcaaatttctcaaactcctatttctggtattcctgaatctcatctcacaaaatatatgcaaataaacagcattagagtcaattattataggcatgccatcatacttactatattaggcatttagctattccacagagtacttattgggtgcctactatgttttgtagagattttagtcttgtcagtaaataaaatggaaccaatccttgccttcatggaaccttcattctagttaggggagacagatactagtaaacataattaaaaatgcatagtatattggaaggtgaaagtaatacagaaaaacaacaggagataagggagctttgggaatgtctcaagagtgtaattttaaagtaagtgagtaggagagttgtaatattaaagtgggtgattaagtatcagctttattgagctgatatttgagcaaagttttaagggagttggaagttaaccatgtagttatctgggggaagaacattccaggcagaggaaacaactagtacaaagaccttatggctgaagtgtctttcatatttgaggaatagaaggaaaaagaatagcaagaaaggaaaaaggaatgaggtcacagaggtagttggagtcctgatgtatggggccttcaagcgccctgtaaggactttggcttttactttgaggaaaatggggagccattgtgtgatctaagcagagggttgatgtgatctttttttttttagagaaagttgctgtgttaagaatagacttagcaggaagaccaatttggaggcttttactaggcttccaggtgagatgtgatagcttggatcagggtagttagtagtggaagtggtaagaaagttacattcttgatttattttggagctggagtcagttacaatcaaggaaaactagttttttggcctgagaactggaaggatggagttaccataaacgaataactgcaatgaggaaggccaaagtggattaaattgtcctggccaacatagtgaaaccccatctctactaaaaatacaaaaaaattagctgggcgtggtggcgggcacctgtaattccagctgctcaggaggctgaggcaggagaatcgcttgaacccgggaggcagagattgcaatgagccaagattgcaccattgcactacaacctgagcgacaagagtgaaactccatctcaaaaaaaaaaaaaaaaaaaaaaaagatacagaacgttttcagcattccagaaggctccttcatgctctatcaaggtagccactatactgaattctatcaccatagattagttataggttagcataccttttataattagcatacctacaataaaaggcaagtctaaaattgcaaacagaattgtacctgcctctgtctaccttggattaattttggagtataaatgctgtggagtggagatgttgaactcaacagaaaggtgccacataaaggacagatatcaaactttttatttttctctctctctagacggtctcactgtgtcacccaggctggagtgcagtggtgcaatctccgctcactgcaacttccaccttccgagtgcaagcaattctcctgcctcagcctcctatgtaggtgggattacaggcatgcgccaccacacctggctaagtagagatggggttttaccgtgttggccagtctggtctcgaattcctggcctcaggtgatctacccgcctcagcctcccaaagtgctgagattataggcgtgagccaccgagcccagcccacaacttttattttaataaaatcttatgtacaaaagcccaaataggcactgcaccgatgactgcttattattgtggtactttgcgcatcataatttagatggcttcttttatgaaatattttgtatcatttaaatagtccagtgtagtttgttttcattgctcttcatgatgtgaactgtgtatgcagtcacacttttcatttagtggaaaattcagttttcaaatttggcagaaagtggtataggtgggattatattttatttgaggtttccgttttccaggggaaaagagtttgcaatcagcagatcccagcctggtataagaatttttgaaatgttttacaggtgatgatgaacagtctacacagatggctgcaagttgggaagatgataaagttacagaagcatcttcaaacagttttgttgctattaaaatcgataccaaaaggtttgtttatgttttaatattttattaattttaaaatttataagtattgtctttgatttatagtgatactcttggactagaagaatgttgatgttgggctgggcactcccagcactttgggagactgaggtgggaggatcgcttgagcccaggagttagaggctagcctgggcaacatagtgagaccctgtctctataaaaaataataataaaattaggagtgtggtgtgtgcctttggtcctgctacttgggaggctgaggggaggatcacttgatccctgaagactggggctacagtgagctgtgatcatgccactgcactccagcctgggtgacagagtcaaactctgtctcaaaaaaaaaaaaaaaagaatataggccaggcacagtggctcatgcctgtaatcccagaactttgggaggccaagacaggcggatcacttgaggtcaggagtttgagaccagtctgggcaacacagtgagaccttgtctctactaaaaaaaaaaatacaaaaattagccgggtgtggtggcacacgcctgtaatcccagctactcggggggctgaggtaagaggatcacttgagcccaggaggttgaagttgaggctgcagttagcagtgactgcaccactgcactatagcctgggcgagagagcaagactatctcaaaaaaaaaaaaagaatgtttatgctatgtttttgggtatctaaggcatattaggaacttaaattctgactgccgtttgctaaattcatcatgaatcctgctgaaaaaactttaagctttcctactctaccaagcagccatctaacatgtaccaggaatgcaaaaagaacagtcatctccagcttctaaaaacttggaagtaatggtaaatcatacattgaatatctctgagaggttgatcacttactgtcttgaatcctatttttgggaatggagtcatttaatcagtggaaataaggacatttataggttcctcaaagtacctgatgtccacaagtctattttgtttctccgttcctcctccccatcttttaaaaaaatttttgttataggaagtttcaaacatatatgaaagtaatgtaacagtgtaatgtaccccatgtacttgtctactagctttggtaattaactcatggtcagtcttgtttcatctatacctccacccatttccactcaatccaaataattttgaaacaaatcacagtcactgtatcacttcatctataaatattttagtatgtctctgaagtataagtattgttaattttttaagcataactataatattaatacttcacaaactaataataattctttaatatcaaataaccagccagtgttcgacttttcagttgtctcatcaaagtcatagttttattactttattgcagttttttagttcaaaattattcaagggccacacattaggaagcattgatttctctcagtatgtaggcttctcctccaactcccctgctccttggaatttatattttaaagacaccaggtcatttgttctatacatttgttctgtggtttcctacagtatggattttgttgactgcaatgtgttagtgtcaagttggttctttcctgttttctgtattgataggtagattcaggtttgtttcccctcccctcatcctgtcctaagactacttcataggtagtgatgtgtcttccatcagaagacagataataccctgttttctctctttatgatgttagcagctatcagtgatcattacctaaaaacattattatttatttttttctttgaagcaggatttcactatgttgcccaggctggtcttaaaatattggactgaagagatcctcccatgtcagcctcccaaatagctgtagttacaggcatgcttcactgtgcctggtgctgaaaacattaattcattagcacttacaaagtggtattcctgtctttttgatattgatactatcagaatgaataatgtgtttgaaaatcactgtcaagattaaagcattcagaaatttctactcgggaggctgaggcaggagaatgctgtgaacccgggaggcagagcttgcagtgagccgagattgcaccactgcactccagcctgggcaacagagcaagactccgtctcaaaaaaaataaaaataaaaataaaaaaataaattcagaaatttgcctataagtttgtaaactttatgtaaaaattttctgtgtttacaaaaacatcaagtcgtagtatagcctgtctcacaacagttactgaactatgtatttactgagtagtttttaaaaaacagaatctgtcaatttaagtatatctttttttttttattgttcatcaccttcctgaagcacctttgagagttggcagtggcaagaagaatatagggatttatagggaatgtgcaatacatgagaattccagaattcttgagattgtatacagactgatgtgtctggcttttttttttttttttttttttttttttttttttttttgagacggagtcttgctctgtcgcccaggctggagtgcagtggcgtgatctcggctcactgcaagctccgcctcccgggttcacgccattctcctgcctcagcctcccgagtagctgggactgcaggtgcccgccaccatgcccggctaattttttttttttttttgtatttttagtagagacggggtttcaccatggtctcgatctcctgacctcgtgatccgcccgcctcagcctcccaaagtgctgggattacaggtatgagccactgtgcccggccgtgtctggcatttttaaaaataaattacttttttttattttttattttttttgagacggagtctcgctctgtagcccaggctggagtgcagtaacgtgatcttggctcactgcaagctccgcctcccgggctcacggcattctcctgcctcagcctcccaagtagctgggactataggcgcccaccaccatgcctggctaatttttaaaatagttttagtagagatggggtttcacagtgttagccaggatggtctcgatctcctgacctcgtgatccacctgccccggcctcccaaagtgctgggattacaggtgtgagccatcgtgcctggccttaaaaacaaatttctattagcagatgcagggatacctgcatatagtgatggttcatgtttgtttcactgtagactgcatgctgatagaatctagtgtgcctttaaattatggaaaataaattttcttcatttcataataactaagtcacccaatgttttgggatcattttagtgtgtatgtatttttggagatagcgtgcattgaaaatagattagtaggaaatgcgtaaaaagtttacaattatttctgaaatggtaggattttgggtaattttttttcttgattttttactatgtttttaaatgtttttatgataataatgctttatatttgagggaaaaaagcaaattctagttcttagaagcatttgtttgattattggaagcatctacattgatgagtatctcttactaatcttataaattctctctcccatccctgaccactcagctcccttctctggagggaaccaaatcaagaaaatatatttatgtttgttttccttccatgttttacaaaaatagtattaatagcattttgacatacttttctatacctttttcttttcttttttttgagacagagtctcacattgtaccctgagctggagtgcaatggcatgatctcggctcactgcaacctccgcctcctgggttcatgcagttctcctgtgtcagcctcccgagtagctgggattacaggtgcacaccaccacacccagctaattttttgtattttcagtagagagggagtttcactatgttggccagactggactcgaactcctgacctcataatccacttgcctcggcctcccaaagtgctgggattacaggcgtgagccaccacgccaggccaatttttgtatttttagtagagacagggtttcgccatgttggccaggctggtcacgaactcctgacctcgtgtccacctgccttgacctcccaaattgctgggattacagatgtgatccacagtgctggcctgcctttttttgtgattgcataattattcagtttttattggtatatagattgcttttaatcctttgttattatagagtattacattatcacatgcctaagtaagtcgtaggccttatgtcttcgtgttccaggttaagatattgtattcaggtatacttgtctgctgaggaagcagcatggcagataccaaattaattttttagctaccagatgcagccactagcttgtgggttgtaagagcaaatagttctttctcttttgagatgaagtctcactctgttgcccaggctggagtgcagtggcgcgatcttggctcactgcaacctctgcctaccaggttcaagcgattctcttgcctcagcctcctgagtagccgggattacaggtgtgtgccaccacgccgagctaatttttgcatttttagtagagaccagatttcaccatgttggccaggctggtctcaactactgactttgtgattcacccgccttggcctcccaaagtgcttggattatacctgtgagctaccacgcccggcctttttttttttttttttttttttgagacagagttttgctcttgttgcccaggctggagtgcaatggtgcaatcttggctcactgaaacttccacctcctgggttcaagcgattctcctgcctcagcctcccaagtagctgggattacaggcacttgccacaatgcccagctaatttttgtatttttagtagagacggggtttcgccatgttggccaggctggtctcgaactcttgatctcaagtgatctgcctgcctcggcctcccaaaatgctgggattacaggcatgagccaccatgccaagccacaaataattctttcatttgaaaattataaaacaaaccagaaaaagtcttaatgaaataagaattatatttttctccttcaacctgattgctgtgaaagaaactggtagttgcaggaaaatacttgtgattggtacagtaaattttattaaaacaactcagtatttagaaaatacttgcattcatctagtgattttgtttgattttgttttacagtgaagcctgcctacagttttcacaaatctgtatcctttcagtaaagaatggcttatatatatacatttatttaccttccttttggttaatttatgaaatttagaaattattcatttttatttaggaaatcatacattcttttttatggaaactttattactaagtgtcctcatttaaaaaaaatgttattataggaaatttcaaacatatataaaagtaactcaatggtgtagtgcaccccatacattgagataatatattgcagctaaagataggatagggagtttttaaaatgtgaatatctgaaaaacaatatagatcagttgggttggaatgttacaagtagcttgcaagaggcagctggcagcaagatggatagaaaaggaagttatgatagaggagaatgtagtagattcttcactagaatatacctcataaattaacatgtcacatgtattaatactacaggtataatgatgcagtacttgaaattatttaataaatgttagattatattgtgaaaatcacaaagatcatttgttttcctttgttaccaatagtgtttcgtaaaactatcctttcgtttcacatgaattgttagacttcattaaactgtacagatcctgtagtgtgtgttccatccagtttctttattggagacagtggaattcccttggaagtaatagcaggaagtgtttctgcagatgaacttgttacaagaattcacaaggtccgacaggtaagaaggaacagaactgttgtttccgtaaatggtacgtcaggaattggatttttttttttgagatggagtctcgttctgtcgcccaggctggagtgcagtggtgtgatctcagctcaagtgcagcctccgcctcccaggttcaagtgattctcctgccccagcctcccaagtagctgggattacaggcacctgccaccacactgagctgatttttgtatttttagtagagacagggtttcaccatgttggccaggctggtctcaaactcctgacctcaggtgatctgcccgcctcggcctcccaaagtgctgagattacaggtgtgagccaccgcacccttcctaacattggaatatttttggagcccctctgtatattcaggaaactgccatgccaaaaatcttaaaaggtagtaagtactgtctttgtcacctgtttttgtaaatagcatgaagttacaggtgccagtagccagtacctaatacttgactgacttctttacctttctttatttttttatttttttgagatggagtctctgttgcccaggctggagtgcagtggactgatctcagctcactgcaatctctacctcccgggttcgagcgatttttctgcctcagcctccccagtggtgggattacaggcgcatgccaccatgcccagctaatttttgcatttttagtagagacggaattttgccatgttggccaggctggtcttgaactcctgacctcaagtgatctgcccgccttgacctcccaaagtgctgggattacaggcatgagccaccacacctagccatcttttaccccagtctcaacacataatgaatatcaccataactttgttgaaagagaaagttgctgtcatattaaggctctaactatatattgcttaatatattttaaggacgttatactcaataattaatcatttctgtctactttggacaaatggctggtagaagtttgtaacttttttctttgaattctaatttgagggaaaatcaatagtgtgctttaacaaatgtttttatggtcttgccagcttgcaggtaaattccataatgtgattatatcatacttaggattatacattttggattcatctatttatgagcatttcgtatttctctttttatagagtataaatcaacctgtattttggtctctactgccatggtaagtttagattcttatctattaattaaaatccaatttattttctgcctagatgcatttgctaaaaagtgaaacatcagtagcaaatggcagtcagtcagaaagttcagtgtctactccatctgcgtcatttgaacctaacaacacttgtgaaaactctcagtccagaaatgcagagctttgtgagataccacccacttctgatacaaagtcagatactgcaacaggtaacttttaatgtacctttttgagtgcaatagaagctccttcactacattttaatatttaaatattaatattttaaaaatatattgtatgtatttttcttcacatttatttaacttaaaatttaagagtcatattaaatacacatgtgtcatttagtggcagaagacaataaagtcagtgaatgtcagctcaactcccaaatagtcaacaatccagagcaattgatttataatttctgctattgcgctgcatgcttcaaggaatgtcatgacactgagcagttttataaatctcttactagcctagagaatttggaaagtttcaaatgaactaaagtattatatttggaattgtttctataacatgtaaaaagctatataaatttaagagaatagtgttatatatattttttttgattagaggtaaaagataattatgaaatagagcttgtagaagtaagaggtgtgactgtaaactcattgatagaaaaggcaaaagagaaatttttgggattgtggttggagttgtttggtgtaatatagctttgtattaggcaaccgaggggtaaataaatcaagatgttaggatattagtgtcctaaaagatgaatctactccagcatcccacacaaataatcatcaagcttctatttgaatgcattcaatgatgggaagctcattaccttgctaggaagcctgttctgttgttgaacagctctagtttttagaaagagtcttccttatattgagctgaaatttgatgccccataacttcctgttaacattaatgctgccttgtggagttacacatgacaggttttgaatatttgaaatacagctatttgtctcattttgaggttttacatcggatggatcattcaacttctggatgtgtacggaacggggggactctattatggatgttcatttaggtctacgacagaataattactttaattgtatttacctggatatatatcatttccaaaattcttcattccattttgaagatagacacatgtttccctctggtataatattctttcagcctgaaaattttcctttagcattacttattgtacaggtctggagttttctttatgtgaaatgactttgttttatcttcattctggaaggatatttttgctggatataaaaatttttgtttacagttacaggtattgtccaccgtcttctggtcttcatagtgttctaatgagaagtctccacaaattctgattgttcccccctgtaaggagtatgttgcttttctctggctgctttcaggatttctttctttctttggtttttagcaatttgactgtgatatgcctaagtgtatttttctttgtatttatcctgtgtttggtttgcctagtttcttacatctgtaaatgtgtgactttcaccaagtttgggaattttggtccatatatcttgctggaatgaattacatgtatattaggcttcatggtattgtcccacaggtttattttttcacacttattttttcttctttggattggataattctgttgatctgcaagttcactgactctttatcatctccattctgatgttaagcccatccagtgaattttttattttagataaaattatgttatacattttttagttgtaggatttctatttctttctctcttattataactttttattttgaaatagtttgactcataagttacagaagttgtgcagaatgagtactcttcatctacgttttattcttttaattcatttcaagtgtatttcccttttcctcatttgagttataatggctgctttaaagtctttgtctgacagtttcaatatctagctcatctgaggattggcttgtgttgatcacctttaccctttagaatgggtcacattttcttgtttgttcatatgtcaaaaaatgctggattgtatcttgtacattgttgtagacactctggatttcattatattcctgcaaagagtgttgtttttgttttagtagacaattaacttggctagactaaaactgcaagctctggcttacctgaggtgagtagcagctctaatctcagtttttttttagcttaaaaaaaatttttttttttttttggtcaggtgtggttgttcacacctataatcccagcactttgagaggccaaggtgggcagattgcttaagcccaggagtttgagacccgcctggacaacacggcaaaactctgtctctacaaaaatgtgtctgcagggtctggctctgtcacccaggctggagtgcagtggcacaaacatagctcactataatctccaactcctggcccacgtgatctcctgcttcagccacctgagtagctaggactacaggtgtgcaccaccacacctggctaattttttttttttttttgagatggaattttggtcttgttgcccaagctggagtgcaatggcacaatcttggctcaccacaacctccatctcctaggttcaagcgattctcctgcctcagcctgctgagtagctgggattacaggcatgcgccaccatgcctggctaattttgtatttttagtagggacggggtttctccatgttgatcaggctggtctcaatctcctgacctcaggtgatctgcttgccttggcctcccaaagtgctgggattataggtatgagccaccacgcccagcctaattttttaattatattctttgcagagatggggtctcactatgttgcttaggctgtctcaaactcctgtcctccagtaatcctcctgccttgccctctgaaagtgctgggattacaggcatgagtcattggatccaggcctgtagctttttaaaactatttattatggaaaatttcaaacatacatagaagtagaaaaaaatagtataagaaaaccccattaatccattgcctagcttcatggccaatattctcatctgtgccctccactcctcttctttttcaacttatttagaacaaatctcaggtaaaatatttcaatatgtatctctaaaatataagaaaggaatataaatcttttaagattatatatagttgccttttaaaataattttttttttttgagacagagtctcactttgttggccaggctgcagtgcagtggcgtgatctcggctcactgcaacctccacttcccaggttcaagtgattctcctgtctcagcctcccgagtagctgggactacaggcgtgcaccaccatgcccggctaatttttgtatttttagtagagacggggtttcaccatgttggccaggctggcctcgaactcctgacctcaggtgatacgcctgcctcagctcccaaagtgctgggattgtaggcgtaagccactgcgcccagccaaaataaattttaattatggaaatttgcaagcatattctaaagtagagagaacagaataacgaactcgaggtactcatcatcctgcgtcagtgattcccattatttgctcggtttttgttatctgtctccctatatgaccacccttccaggttattttgaagcaaatctcaggcatttgtatgatttcatcttttaaaatatcaatatctaaaagataagaaatttttaaaaataacaacaatactattatcaaagccagaaagcttaatagtaatcctttttgtcatcaattatctaggcaatatttatattatactttttttcagtttgagttacagttcgatatattgctattggttgatgtgtttttaaatttaatatatagatttctgctctccctggtagtttttcctatagttttccacagtctggattttactgcatccccatggaattgtgtaagatgttcctctatcccctttattcctctaaattggtaaagctacagacttgatcaagtcagcttcattattctttttgacaagactactttgtagatgatgatgtatatttctctcaggagatacattatgcctgttattccagttggctttttaagcctaaaggcggaacttctcaatacatttttattatatttggatttttatcagttgttttagcttattgaggtgttttttcaatccagaattttttttttttttttttttttgagacagtctcgctctgtctcccaggctggagtgcagtggcgctatcttggctcactgcagcctccacctcccaaattcaagtgattcttctacctcagccttccaagtagccgggattataggcacccgcaaccatgcccagctgattttgtatttttagtagtgatgaggtttcaccatgttggccagactggtctcaaactcctgacctcaaatgatccacctgcctcggcctcccaaagtgctgggactacaggtgtgagccaccatacccgacctagaatttttcatttaggaattagcagttaaatatgagtgttaataagctatttcacacaattttgggtcacccataaagttacacatgggccaggtacaatggctcatgcctgtgatcccagtactttaggaggccaagatcagttgagctcaggagttcgagaccagcctcggcagtgtgacaaaacccagtctccatacaaaatacaaaaattagccaggcatggtagcgtgcactggtggccccagctactagggagggtgaagtaggaagatggcttgatcccaggaggcggaggttgcagtgagccaagatcatgccactgctctccagcctgggcaacaaagctagaccatgtctcaaaaaaaaaaagttacaaatttatattttacatcttcaagtcatttatgaaataccaaaggcagagaactctgtgacatacaattggaaatcttcctctatatgacatctttccatttctctttaattatgagtcatagattcacctaactgtactcttattcaacacttttcccccagcttgtccacaggttatcttcataagatgttaaatttttgctgataataagacatgtcctcagcatttattttatttgctaaagaaaggtggttaatttcctattgagcctctactggctgctagtggttaccacttcttatccaagagttgcattcagtgatacactggtaaacatttatcagaaggatctgtggaagcaaaggcccatatttgtagtatttgctaatttcccaggtgtaaatactcccactttgttgatttcaagctacctaggttatgcccctgaatggggagggagaagagatatgcaccatcgtctctacttagtcatactaattatttttactactactgtagtaacgaaaatgcttaccatgtgccagtctcagttaagttctaagcattttacttgtattaacacgtatttcttataacaaccgtgtgaggttactatccccattttactgatgagatacagaggtattaaggaacttactgaaatgactgtgtggctccagagtccttgttcgccaaagactgtaaagaagaatcaggttggtggcaagttgtaaggaagggaatgacagaggtcttgtagaataggctaggacaaaagtctatctttcaggaaatccttcaaagaaaactagcataaagaggctctctaaggaaccactctggtcagcagaagcagattccttggaccagtgtaagtccagagccatacccaggatcaaacctggcctgtattgctcactgctcaatagccacagccacattttaattaaaattaattacaactaaaatttgtccctcacttggcagtaacctcattttagatgttcaacagccgcttgtctagtggctgctgtgttagacagtatagatattggagggcactgctctagagtgaaggctacccatagccaggcatgcctcctgccagattgttattcatgttttacatctgacctttaccttggtgattttaactcggtaactgctttatttctatttgtgaacaattttatccacgtctaaactttaggattagtaatagcatatttagctccttctccatttttagggaaaatatataatgcttaagatataaaattattaacagatgctataatctgaaagatttattcctttaaaaagttgcattaaatgcagtattcttatttctttttatttaataattaaggaggagaaagtgcaggccatgccacttcctctcaggagcctagtggatgctcagatcagagacctgcagaggacctcaacatccgagtggaaaggtttgctcttctttttgcaaatagcattttgtttaaaaagacagtggttttcagttatttcattaatttgaattaaagctaaagttatacaaatgaagttttagaattctgagttgaaatttttgatcacctaactaatttgtatccataaacattacactctaagtgtaaagttttcatgtatgtctgaagtcaccagtcagcttttggtctgatcattctaagaatcccctttttaatggtattttggtacatgggtgtttccatctgtcacttctgcttttatctctatgccataaggataataagctccagatgggcaagaacttcagcttatttcatgactatgtactgagcttaagttctgcataagtgggtgtctactaagtggcatttttcattagttggtctaataatcagatacaaatttctggctctttgtagtttctagtatttttaatgatacagtaattgtcaaatcatagtcttttatgctgtgattcctacatgagttaataattagtggttaagcgggaatattttaaaccctgatttaaacccctttagcgttagttatatggaagtttaaaaaaattccttagcatttaaaaatttttttaaaaaaaccttccttagagagacttgatattttcttgttcacatagatgcttcggggaaacagggttcaaagtgattgctgatattgtctttgagtttgcttgtgactcagtaaagatcagcttcttttcagcaaaacctagattctgattgttctttgtaggggaaggggcagtgcccagaccttgaggtgaaaagcaggctggacctcacagtggtgaggaaagtggtataagcctagaagaatagcagcaggaaacttaagttcccaagggttcatcctgttttgcttctttctgatttgctaacaccaggcccactactctgtacctttatttgcaccactctgggctgaagtgaaaataaaaaatctggaaaagggtttggagacttggggcaaaaacctgaattacatcaggtagccctttattttgaggtggggtcaggcgctatttagttatactggaaaaagtttttaatagcctccattcttatgtaggggaatgtcagctagtgtctgcctgtgtcatagtactaattaattcacaagctgagatcctgcattttattcatctgcgttcatgccaaattaggaatcttgttccttttgtggaatctgattcattgacaatgacaataactaataacaccagcgtatgtaatattcccattccaaatgtccacttagctcattatttataccctaagagttgccatcgttctcaccatcccctgccatagactgtgaagctcttgtgccctcaactaactcatcccctgccatcttttgcagggtattgaactgtgaaactactagtttccctgtctctctgaactgaagtgctttttctcagcctggttaagttggacccatcagtccctgttgtgtaatctgatattttagaattatatgaagttctataaagcaaaattcatgcatttttctctgaccttgatggtattttaaaatctatttcatacaaattaaaaattcagagttaaaatttggcaggggctgtgagtggtggctcacgcctgtaatcccagcactttgggaggctgagacaggtggtttgcttgagcccagaaaatagagaccagcctgggcaacatggcaaaaccccatctctacaaaaaaatacaaaaattaattgggtgaggtggtgcacacctgtagtcccagctactcaggaggctgaggtgggaggatcacctgagcccaggaggtcaaggctgcagtgagccatgatcacaccactgtactccagcctgagtgacagagcaagactctgtctcaaaaagtaaataaataagaccaggcatggtggatcacgcctgtagtcccagcactttgagaggctgagatgggtggatcatttgaggccgggagttcaagaccagcctggccaacgtggcgaaaccctgtctctactagaaaaatacaaaaattagctgggcatggcacgcatctgtagtcccagctactcaggaggttgaggcaggaaaattgcttgaacccgggatgcagaggttgcagtgagccaaggtcatgccactacactccagcctgggtgacagagtgctactccgtctcaaaataaataaaataaaataaaataaaaaataaagcaggatggattagcaaatgtaagattcttactttcctctcaggctacagttgaaactgagatctatttccaaagaccatgtttttggaaaactaattactgtagttgactttaagtcttaggcttttttctcatctagcttcaaagaaaactaattttgttaagggaaagggtgactaaatcaaattgacattagtgagaaattcatcctatcttgtacataagaacatagtccttcaatcttgagctgcattttgtcaagtaaacataattaaaaaaaaacggattggtgatttgaaattgtgagatctaagtttttatttttaatattaatggatatacaatggttatttatttatttatgaggcagagtcttgccctgttgcccaggctggagtgcagtggcatgatcttggctcactgtagcctctgactcccgggttccagcgattctcctgcctcagcctcccaagtagctgggattacaggcatgcaccaccacacccggctaatttttaaaatatttttagtagcaacagggtttcgccatgttggctgggctggtcttgaacttctgacttcaggtcatctgctcaccttggcctcccaaagtgctgggattacaggtgtgagccacagcacctcgcctgtgatggttttttgtttgtttgtttttgagatgaagtctggctctgttgccaggctggagtgcagtgacatgatctcggctcactgcaacctcctccacccagttcaagtggtcctcgtacctcagcttcctgagtatctgggattacaggtatgcgccaccatgactggctaatttttgtatttttagtagagacaggggtttgccatgttggccaggctggtctcgaactcctggcctcaaataatccacccgccttggcttcttcaagtgctgagattacaggcttgagccaccacgtctggccaggatatacaatgtttcactaaagtaacagatgtgaaataggaatcttttagcgaatctttagttaaaatgcattattttgtttatttcattatgttttttttttttttccctgagatggagttttgctcttgtcgcccaagctggggtgcaatggcacaatctcggctcactgcaacctccacctcccagattcaagcgattctcctgcctcagcctcccgagtagctgggattacaggtgcccaccaccacacccggctaatttttatatttttagtagaggcaggggtttcaccatgttggtcaagctggtctcgaactcctgacctcaggtgatctgcccgcctcggcctcccaaagtgctggaattacgggcatgagccaccacacccagccatgtcattatgtttaaaatgggcagaattatctggcaaagataatatatactaccatgaattctagtctttttatttgaataagtttcaaacctcaacgttgaaaaaatagtgtaatggccatcttttaatttttttctttttttttttcttctgattcatttgaaagttgcagacataatttcacttcatgcctagatacctcagcatgcagctcctaggaagacattggctgagggtctgtgggctttgagcagggactccatcctaggccaggatctggggatctgtgctcacagacccatgtcctgcccccttctggcacccaagcaggcatagtgaccattaagaagtagatgccagcccggcacagtggctcatgcctgtaatcccagcactttgggaggccgaggtaggtggatcaactgaggtcaggagttcgagaccagcctgagcaacatggtgaaaccctgtctctactaaaaatacaaaaattacccggacgtagtggtgggtacctgtaatctcagctatttgggaggctgaggcaggaaaattgcttgaacccaggacgtagagattgcagtgagctgagattatgccattgcactccagcgtgggcaataagagagaaaagccatctcaaaaaaaaaaaaaagtcgaagcccaaatgtagaagttatggaacagtcaatttgttattaaattagatgcagtgtagcttttcacccaaattaaaacaaacttgcgtttgtatttctcagaagaaaattctacagatggtctataaatacgtttatacaccattttcagatggtgtatattttcagatacaagcacgataccattatcatactcaagaaattctcaattgatacagtaagattatctaatttgtccgtattcagatttcccagttgctccaataatggcccttttaacttttcttcccttgattcaagatccagtcaaggattgttcattgcatttagtttaggctctgaatccaagacacttcttgtttgcatttttcatgatttagacattttgaagagtctaggttagttgtttctacaatgtcctttgatctgctccctgttctatcattagattcaggttaaactctgataagaacattaccaagataatgttttgtcctttccattactcatatcaggagacaagtaatatgagatgtatgcattattggagctgtaaagtttaattatttggttaggatgttgtctgttgggtacccttttcattttctaatatataagttgtctatggggtgattcaaatggtaaatatcctactgcttaaaaacttcacccggtggtttcagcattcattgatttttgctgtaatcacctatttcattgatgtttaaaaattgtggtatttttctcattctgtttttttctacatttatcagctagcattcttctgtagagaaatgctttgatctaccccctctactttccatctgcccacccccgccccctttttccagtaaactacttattggacaccagcacccagatgaaggaatagaaaattaccagtgctagtctggcatggtggctcacgcctgtaatcccagcactttgggaggccaaggtgggcgggtcacctgaggtcaggagttcaagaccagccttgccaacacagtgcaaccttgtctctattaaaaatacaaaaattagctgggcgtgggggtgtgcatctgtagtcccagccactgaggagcctgaggtagaagaatcacttgaacccgggaggcagaggttgcagtgagccgagatcgtgccactgcactccagcctgggcgacaaagtgagaccttgtctcggaaaaaaaaaatgaaagaaagaaaattaacagtgcctaataagctttcctaatgccccttcccaattatggattccctccataagatgatcactatcctgaatcgaacactgtaggttagttgtctgtttgtgaactttgtgatggaatcatgcaacgtgtatttttgtgtttgatctcctttgttcagctttgtattttgaggcttatccgtgttgcatgtcacagtaattggtgcactctcattgctttatagtattctgtttgactctaccttgatttattaatccattctactgttggtggacattaggattgttttcagtttggggctatttgaatagaactgctatgaggaatattcttgtatatgtcttggtgaacatgtgtacacatttcttttgggcatatatatgaagaagcgggaatttctgggttatacatagtgatcaaacagctttccaaagtggttaggccaatttacagttccccttagcagttaagacatgtcacagatgcttttttttctctcatgtgttactatccatttctctattctttttggtgcacaaattgccccaaatttgacttgttggaatccccttcatattgggtcttctggctttttgacagtactcactcccttgattgctggcacacattgttcagtttggtatacaccaaacacttttagagaaaataccattttcatttaaaaaaatgaaatataattcactaccatgaaattgaaagtgtacaattcagtgagttttagtatattcacaaggttgtgcatccactaccactgtctaatttcagaatcattattttattttttaaatttttttatttttttgagatggagtctcactttgtttcccaggctggagtgcagtttcaccatctcggctcactgcaacctccgccccccaggttcaagcgattctcctggctcagcctcctgagtagctgggattacaggcgcatgccaccacacctggctaatttttgtatttttagtggaaacagggtttcaccatgttggtcaggctggtctcaaactcctgacctcgtgatctgcccacctcggcctcccaaagtggtgggattacaggcatgagccaccgtgcctggccgattttattagtttttgagatggggtttcattacgttgcattacactaccatgctcagctgattttatattattatttttttttcctgaggcggagtctcactctcgcccaggctggagtacggtgacatgatctcggctcactgcaacttccgcctcccaggttcaagcgattctcctgtctcagcctcccgagtagctgggtttacaggcgctcaccaccacgcccagatgtttttctatttttagtagagacagcgtttcgccgtgttggccaggctagtctcaaactcctgacctcaattgatccgcctgcctcggcctcccaaagtgctgggattgattacaggtttgagccaccgtgcccagcctgattttttattttttgtaaagatggggtctcaagttgttacccagactggtttcgaactccagggcttaggctatcctcctgcctcagcctcctgcagtgctgagattacacatgtgagccaccacacccagcctccatttgtttgtttatttcagacagggtctccctttgtcacccaggctggaatgcagtaacgcgaacgtgactcgctgcagcctcgacctcccggctcaagcaattctgttaccttagcccctaaagtagctggaactacaggcacacgccaccatgcctggctaatttttgtgttttctgtagagacagagttttgccatgttgctcaagctggtctttagctcaagagatccaccaacctcagccctcccaaagtgctgggattacaggcatgagccactgtgcccagcctccattcatttttaactgatgaacttcttacagttgagaatcaagttggtgttagtaatttggtattaataatttgctggccttaagtttttatttttacaggttttttttttttttaccatagtgctgtttagttttatataaggagtagagcatttataagtcactgatttatgtatttgtttgaaaatgtatttgtagattttaaagtcaatatcaggtaaatcagaaaaaaagggaaactaatcataagtgggaagtgaggcatttagaatgaagctaggcttctgatgggctctcgttgactccaggatttctgtaggggcctgaagccaggcagataaatagttgcttgctttttgtttgtttgtttctttatttctccaattgttttagctaaatccatctcctaaatgtgttttatattaatatgatgtgtctcaattagtggtggtttttttttttttaatacagactaacaaaaaaacttgaagaaaggagagaagagaaaagaaaagaggaagaacaggtaaagttcatgcagttagcattgttttgtcctctcattaactgaggttgtgattgattattctattcagtgtggcaggcctagggtgacttcatagttttagttcagtgttgcagcactatgaagataattcctgttttctctagtagagtcatagtatatacattttttgtgttcttttcgtaaattactatgaataaattagaccatgctttttccctctgcaatgatttttttttacactaagaataaagggacttgagctaaaatgtttggcttgaggttgaacaaagttttagttcatttttgtgaaaaaatgtatagacattttgctgaatttttcctctcctgttaagcattctagcacatggttcatttttctcaccatgtatacctaactgtgtagcatgtctttggagttctaatataggaaggttaccatttcattcaagccaaatacgtgactgccatgttgtccctgaagggtaatatatttaccctcatgactaaagacctgtaattatgcttgccttcaaattacactgactacattattatcttaacagaccattggcaatgatttatagattgatagacatttgaccattaaccatgccattaataaactcgtctagacttacattttatgaagttttattcttttaactgcagttttcgttgcattcaaaataatatctggggcagattatcaagtttttggatcataaaactttttctttaattcagagagaaattaagaaggaaattgagaggagaaaaactggaaaagaaatgttggattataaaagaaaacaagaagaagaattaacaaaaagaatgctggaggaaagaaacagagagaaagcagaagatagggcagctcgagaacgtataaaacagcagattgcattggtaagtcttaagtttccagacattcgtgaaactgtttttctgtgcacagtagctttagattactaccagactgtgcacacaaaaatagattttagtgactcatagactaccaatcctgagcttccttttattagaaattgtaaatgaattaaaatagttaagattaaaattgagttgatttttttgaagtgatttttattcatattttgttaatttatgacttttatcagcattcaaaaagcagcttttaaagattccctagaaaataagctaagtactagtacctactactagtactaagtacctactagtagtaactactagtactaagtacctagtagttcttctgtagtcacaggcacacttttttgcaacattgaaaggatttaggcacatcataaagcttagtttgcaacaattgcttttataattcatcagctgcaatacatattaaaaccatcccgccaggtgtggctcacgcctgtaatcccagcactttgggaggctaaggagggcggatcacctcaggtcgggagttcaagacttgcctggccgacatggtgaaacgccatctctactaaaaatacaaaaattaatcgggtgtggtggtgggcgcctataatcctgctacttgggaggctgaggcaggagaatcacttgaacctaggaggtggaagttgcagtaggctgacatggtgccattgcactccagcctgggcgacaaaaagcgaaactccatctcaaaaaaaagaaagaaagaaaaaaagccatccctaccttaatatttttgttcatttggtcagtcaacaagtatttgttgagcatttattatttatttatttttgagatggagttttagtcttgttgctcaggctagagtgcagtggcgcaatcttggctcactgcaacttccacctcccgagttcaagcaattctcctgtcccaggctgccaagtagctgaggttacaggtgcatgccaacatgcccagctaatttttgtatttttagtagagacgggatttcatcacattggtcaggctggtctggaactcctgacctcaggtgatccacccacctcggcctcccaaagtgctgggactacaggcgtgagccaccacacccaggcttgttgagcatttattatgtaccagaccttgttccaggctttggagatacagtagtgagcaaattcatttccttgtttccttaataataattctggtctccgacagttgataaaactaaaaaataacagttccagaatgttaaagttcacatatggtgttagacaatttcaggcagcaaaggcacagtggctcacaactgtaatcccagaattttgggaggctgaggtgggaggattgcttgaagccaggagtataagatcagcctgggcaacaaagtgagaccccacctctacaagaaaagaaaaaaaattagctgggcatggtggcacacacctgtagtcccagctactctggaagctgaggtgggaggattgcttgagcccaggtgttcagaggctgcagtgagctatgattgtgccactgcactccagccttgatgacacagcaagaccctgtctcttaataaaaaaaaaaaattccatgcatatttgtttggaattgtgtgaattaaccattctggcagtaaaggtaattggtatttaatgatgttttaaaggaccgtgcagagagagctgctcgttttgcaaagacaaaggaagaagtagaggctgccaaagctgctgccttgctagcaaaacaggcagaaatggaagtcaagagggaatcttatgcaagagaaagaaggtactatatttcatgctgaaacatctctgtgcacataggggctgaggagaatgattataagctggtttttaacactgatgtatactgtggttataagcagtccattccagagggacatattaatttgacagctcccaatggtatctctcatttcgtgtgagtgtacactaaaaaagtactacataaataactttaaaagagggcccaatagccgggcgcggtggctcacgcctgtaatcccagcactttgggaggccgagacgggcggatcacgaggtcaggagatcgagaccatcctggctaacatggtgaaaccccgtctctactaaaaatacaaaaattagctgggcatggtggcgggcgcctgtagtcccagctacgcgggaggctgaggcaggagaatggcgtgaacccgggaggcggagcttgcagtgagccgagattgcgccactgcactccagcctgggcgacagagcgagactccgtccccaaaaaaaaaaaaaaaaaaaaagagggcccaataaatacctgttttccaaagacagaaatgatttgtaaccaaatgaatataatgtttatctcatacgtattaggattctttatttttcagaatcccctatccgataggattaagcaaaagaggaaatacattggctctgcagttcagaaatccaagggtgaatttggttaggcatagctgtgtccagcaatctaaaggataccattacaatttctctctctctttttaattcttggtttcttctgttttagcttcattcttagagaaactctccaaatggtgtcaggagagcccagcacctcctggcactttcaggaccttgaattcacgatcccagacagaagagattaaccttttctctctcatgcctgtatcagtcactgagaattctgactgcccctgtttggatcatgtggccaccttcagagtagtcagtgtccacatgtgtgggccctctggttggaggaggtgacatgcccaatcttgtggtgaaggaggtgggggaaatgttattgataattataccagaacgaatgacacatagcagggtaagaaggcagttcccaaaacaaaaatatgttgaaaagacaaaaaaagtttagatttctagtacaccttgctaattggattatggttaatacttattgtcttctctgtgccttttcatatttccatattggacagttaacaagtagtattttgtaatcagaaaaatttttaaaaataattttccaaaaataatgaagtaataaatttaacaaaaatgtaagatttgtgtgctaaaaatgacaaaacattgttgaaagatttaagacctaaatacctggaaagtatcctatgttcatggataagaatacttaacattgttaagatgataatcctccctaaactgatctaactgatctatagattcaacactcctatcaaaattccagctggcttttttccataaattataaacctaaaattcatatggaaatgcaagaaacacaatagttaaaacaaactggaaaatgaagatagatgactcatacttcctgattttcaaacttactgcaaagctatacagtgatgtaatggtataagatgaacatacaggtcattgtaatagaatggagtctctagaaataaacccttacatttatgaactgtttatttttgaaaagggtaccaagactattcagtgggaaagaagaatcttttcaacaaaaggtgcttggacaactgaatatctacatgcaaaataatgaatttggacctttacctcacaccatgtacaaaattaacttaatggatcatctaccaaaaagtaaaactataaaatatatattcttagaggaaaaaagaggaatatatttttgtgatctaggagtagccaatggattgttagacatggcactaaaagcacaggaacaaaatttaaaaataggtaaatcgcacttccaaaatttaaaactttcgtgctttgaaggatatcatcaagaaagtgcaaagaagctgggcatggtagctcacacctataatcccagcactttggaagactgaggcaggcggatcacttacggccaggagttcaaaaccagcctcgccaacgtggcaaaaaaccgtccctactaaaaatacaaaaattaactaggcatggtggtgcacaccagtaatcccagctactcaggaggctgaagcatgagaatcgcttgaaccagggaggcggaggttgtagtgaaccgagattgcgccactgcactccagcctgggcgacagagtgggactctgtctcaaaaaaaaaaaaaaatgcaaagaacaacccatagaattggagaaaatatttgcaaatcatatatttgatgagagacttgtgtctagaatataaaaagaacctgtgactcaattataaagacacccagttcaaatatgtggaaaggatttgaatagacatttctccaaagaagataaacaaatggccagtaagcacatgaaaagatgttcaacatcattagtcattagggaaatcaagtcagaaccacaatgagataccatttcacacccactaagtatgcctaaatgtaaagagaaagtaataagtgtttgtgaggatgtggagaatttggaacctttctgtgttactggtgggattgtaaaatgatgtagccaccttggaaaacagtttgccagtaacgcaaaatgttaaacatagtgttatcataggacccaggagttctacagcagcagtttatacagcagtttatatccaagagaattgaaaacgtcaacacaaaaacctgtacatgagtatagcagcattagtcaaaatagctaaaatgtggtaataacccaaatgtccagcaactgaagaatgtgtaaactgtatctcatacaacaatgtttttcagcaataggaataagaactgatacctgcaacaacatggatgaaccttgaaaatacaatttccatgaaaaaagcaagttacaaaggtcacatactgtatgattctattacacaacatgcccaaaatagacaaatccgtagagatagtagattagtggttgccagggtctggaggagggagggatggggagtgactgctgatggggttggagttcctttttggcatgatgaaaatgttctggaattagataatgttgatagttgcacaattctgaatatatttaaaaatcactgaactgtacactttaaaaggcttaatttttgtttgtttgagatggagtctcgctctattgcctaggctggagtgcggtggcatgatctcggcttactgcaacctacacctcccgggttcaagccattctccctgccttagcttcctgagtagctgggattacaggcatacaccaccatgcccagctaatttttgtattttttagtagagacagggtttcaccacgttggcccggctggtcttgaactcctgacctcaggtgatccgcccgccttggcctcccaaagtgctgggattacaggcgtgagccaccacacccagcctaaaagagttaattttttatatgaatctcagtaaagcagttattaacaaacaaaaagatctgatatggtagaaaaaactattgtcattgcacatttccacttccattttctctaacttaatgatattgttagagaatatatagaggtgaagattgtgactttaattttcttttttcatagcactgttgcaagaattcaattccgtcttcctgatggttcttcctttacaaatcagttcccttctgatgctcctctagaagaggcaaggcagtttgctgcacaggtaaatttatgtcttgagttgtagtaaaaatagatgtgtaggttactaaattataggaagggaaaatttcaaagcagaagttgaatgtgagtgaattgtgacctctccaggagggaggcacaagacgcctctgagatattgtggaaattctgtcgggtgttagtgcatatgggagtaacatatctgctttgtgtgcagaagtaggaatttgctgatattgtataataggtcctgggaacttttcttttttaaaattttttgagacaggatctcactgtgtcgcctaggctggagtgcagtggtgcgatcacagctccctgcagcctcgacctcctgggctcaagcgaccctcccacctcagcctcctaagtagctggaacttacaggcatgtactgccatgcccggctaatttttgtactttttgtagagacagggtttcaccatgtagccgggctggtcttgaactcctgggctcaagcattcctcccacctcagcctcgcagtgcgttgggattacaggcgtgagccacccagcccagccactgggaacttttttcactgattagtagactcattgaaggagtgacaggcaagtgatttcccgaaggtctgatgtgagggaattgtcccactcccctgaaatggaagcagtttttctcactcctctctccatttcctacagattgcttaggggctggtcattttcctacgatttaccttttggctaaggaaaaagaggcagtaaactttatttgacaatagtatcttcttcaggaatttacttccaaaaggtggccttactcagaatctgaatggagtatatatcttgagatatgagtagttttcaatttatttttattccctgattgattccttattcaaaacggattctgagcatcagatgtcctttgggttctaggctcattatatgtatcagtatttttttcatatatataatttcaaggttaaaattagggatttgggttcagatctttccgccagaccttttctccacatttggtcgtcttcttgcactcgtgaactaggctggacaatgtaaacgtttattttaaaaactgtttccccctaagctttatagtagaaacagtcccaaataggtgctttcattcttcttttgtcttggagcctcccacaatgtgtcccctgtcctgagtttcactgcttttgccacaggtaaatggagaagggactacatctttgattgcatgtgtcctattaaaactccacctcaggccaggcatggtggctcacgcctgtaatcccagcattttgggaggccgaggtgggtggatcacaaggtcaggagtttgagaccaggctgaccaacatggtgaccccatctattctaaaaatacaaaaattagccgggcgtggtggtgggcgcctgtaatcccagcttctcgggaggctgaggcaggagaatcgcttgaacccaggaggcagaggttgcagtgagctgagattgcgccactgtactccagtctgtgcaacagagcaagactccatctcaaaaaaaacaacaggctgggcgcagtggctcacgcctgtaatcccagcactttgggaggctgaggtgggtggatcacgaggtcaggagattgagaccatcctggctaacacggtgaaaccccgtctctactaaaaatacaaaaaattagccaggcgtggtggcgggcgtctgtagtcccagctactcgagaggctgaggcaggagaatggtgtgaacccgggaggtggagcttgcagtgagccaagatcgcgccactgcactccagcctgggcgacagagcaagactgtctcaaaaaaaaaaaaaacaaaaaaaaacccaaaaaacaaaaattccacctcagtacagttatcaagttttgtattttgtgtatctttagaacagtgaggggtatgtgtgatctacagtaaaaaaaaaaaaatacgaaaaacaagttagtctccttctttggaatcttctagggaaagatacacagatgtctaagattttacaagtgatttttgtatatagaggacttaaaattgtgagggtgacttacagtgctgtccattgtacgttcctggatctggtattgtgtgtatcatgtaggttgattatggaccatttatgccttgagacaaggaggaggctacacttcctgaaggtatatatgagggaaatactggtctagtccaaattcttaatagggattacctgtaatccaaatgtgtgttcatgagacattaagtttgccaaaggatagtgaaaacctaatgatgaactgcaacagtacttaaaggagatacacaattgtccatttttactcaatttatttgtgtgtttttaggaactatattttgctattttgtggtcatctttgagttacagaagcttttaaaaactatttggatttgatagcttttcagctgcttaggggctggaagcacaattttatacctttttttgagtttacatgtaatgaacttttaaaattaaggcaatgttaattaaagcatcattttggattcatctgagtaatatcttacttttaaaggcactctttaagtttttaaaacttattttacagactgttggcaacacttacggtaatttttcgttagcaaccatgtttcccaggagggaatttaccaaagaagattataaaaagaagttactggatttggaacttgccccaagcgcttcggtggtactgttgccagtatgtatatacagatgcatttttttctcttcttattgttttctgtttatcatactcttcatttcttataattaggggaaaggaagtgcacagatatactgaaggtaattaaaattcaagtgatccaataattagatgaatttataattccattatcctgtgctttatttgtattgctgatattacttgtgagacatgaaacagtttaatttttaacttttttcttcacatatttttgtgtacaaaaaaaatgaccaataggagaagacagtaagaaatgcagattatctgtctaatccacacacttagtgtcttttatttatatatgctctactgtttgccaaaaataacatgaatattcaaacagattatcccatttgatctgcacaacaatattttaatctctggtgaagaaaagaagctcagacagcttaaatgactgctgccgtaactgggatgagagcctgggtcttctgtgtcctggttaacatagttttccttgctctatactagacgtgccctccaccccaaaacagttagctctccagtaatcaggatttcattgtttgaacctttttttttaaatcagcaagaaagactcttcttataaaagtttaatattcttaaaaaatagttggctcatttcactgagaactactttctagtttgtatattacaatttctcttaaacacagctccaaatattataacataaaattacaattgtatatataatatacaatattatacaattatatacaattattatataaaataattatataaaataattttataattataatatattatataaaatataatatatataatatataaaataattgtatactatacaattatacagttattatacaattatatacaattgtataatattgtatatttatctttaaaaacttctgggagtcttcagaagtttatatatacgtgaaaaacagcaaaagatatcattttaccctcttgaagtaaactaaaattggtaggacctccttttccagataaaagtttcatctggaaccttgggcgtgatgtgattgtgctaacgtagtctttatctaggtttgtttattaatttctaggcaggaagaccaactgcatccattgtacactcttccagcggagacatttggaccttgttgggaacagtgctttatccattccttgccatctggagattaattagcaatttcttgtttagtaatccgcctcccacacagacttcagtgagagtaacatcgtcagaacccccaaaccctgcatcatctagcaaatcagaaaaaaggtatctgtgtgtgttttccccatttataaaatatgtaagtcatgcccagtatcttttttaagtaaaaagttgagtactttgcctttctgtatatgtcctctccagttcccacggtggaggagaaaaactccgatgctctgaaactttattacatcatctctactgcagagctcactacctgcgttttctcagccagctttataaaaccaattttttggaaagcagcttcacctctactggtttattgtttcattcattgaagtttctttaccccataactatcaaggcagatttttttttctagtaacctctttcttgctaaccatgtttgcttgacaagatagttcattgcattaatcgttcagggtcatcttgcataattactgtaggtgaactactctgttttgatcattttaaccctgttggttcttttatctaccggctgacagccttgtctggatcattcagagaaggaccaaattgtggaaacaggttattgctttgaaaattctctctcagagaattattttggactaatcccttaaccaagagaccagggcctgatgcagtggctcacgcctgtaatcccagcactttgggaggctgaggcgagagaattacttgagcttatgcattcaagactagcctgggcaatatagtgagaccttgtctgtacaaaaacaatttaaaaatttgccaggcacatgtctgtggtcccagctacttgggaggctgagatgggaagatcacttgagcccgggagattgaggctgcagtgagccaagattgtgccattgcactccagcctgggtgacagagtaagagtgagatcctgtctcaaaacaaaaacaaaacaacttttatagcagatagcatgcaatggttagcatagtaatacaacactgacaattttaactcctatctttgttaagattttatatacttgaaacaggttaatgggaagtattttcctagaaagtaagtttatgcccctttctaataattacataataatgtaacttactgaaatggacaccgctgttaagcactctatgaggccttttataggcattataacaaatcttcatgccagtcctatgtgataagtaatagaaattcttttttctctgccctcagtatggagaagccctagtcatgtgtttatggattccataggtaatgacatataagtattgtgattgggctgctttgtcctttatcttatttcataactgttaggcaggaagaccagttacctactaagtacgttactgtagtgaggacagagggaagctcaaacaaggctgaatcttaaaactcttactgagcaatgggtgggagcatttaatactgaattactgtaatataggagagctcgttgtatggatttttaaaacttttttcaggctgggtgtggtacctcatacttgtaatcccagctctttgggaagctgaggtgcaaggatcacttgaggccagaagtttgagaccagcctgggcaacatagtgaggctccatctctacaaaaaaaacttttagtgagctgtgtgtgatagcgtgtgcctatagtttcagctgcctgggaagctggggcaggaggattgtgtgagctccagagttttgaggctgtagtgaaccgtgatcgtgccactgcactctagcctgggcaacagaggggacaccctgtctcaaaaaagaacaaaaaacaacacttttttcaaataagagaaaggtcttagattagagcaaaggatggaataaaaggtgtgtcaaagagagggtgaagctttgtgttccaccattatttttccttttttctctcccctctagagttataaaagtctgttggcttaaattttatccttatacctttgtattttcagaataggaagtcctcttcattcttaattgtttataaataagtcattcttgaagattttgcgaaggatttaaaattgaccctttctgtcaagctgactggagctttggatagtctctagggtgctaagttacaaatgttttagtagataatgtcggcttgcataaataacaaaggaaagattagttggcaaatggtcacactcctctaatgcttattaagtcactaagaaacacaatggaaatggaatatatgatttggctggctggcttgacttagagatcagatgaagctaaactaccaaagactgctaaagtctagtactgtgttagtagatataatggtctcccatggactttccttactttagatggcattaaaagtaaaacttagttgcctgtactgatggaagttggaaacagcttgtattactattgtttttattttatgacatcttccccttgctccctctttttcgtatcagggaaccagtgagaaaaagagtgctggaaaaacgtggagacgactttaaaaaggaggggaaaatttatagattaaggactcaagatgatggtgaagatgaaaacaacacttggaatggaaattccactcaacagatgtagtgtgacaagtataatatgtgcaataatcattgtttctcttatgatttaattcaactaaaattctactggagaagtgggactgctttatattttccaactggtctataaaatgtctctttattcctgcttagtgggtgtgggttgaaggtgtttaactcagaaaagtaaagacaggaaataactctctgctaggtccttgcttatatggcaaccactgctagaaccctaaaagaaccaaaaatctgccacagcctgcctccatcagcttcttatttagtatttcatatgcccattagccctatgcttcagatgacacgttttgtttagagctactttgctccaagactcttaagcccaaagtaactggtatgtcactgagtaacttgactcggtgtcagagcattttaactagccactcagatgagaatttatgtttaacttctctttttactcatcagctgcaagcaaaatcttgtagtttttaatcttaaacactgaataaaaaaactttcccctaaattggaatgatcttagttttgctttgagttttgttatctagcatctttttgttgcacagggctctattgaggtcctatgtctctgatttttttttttccccagtattgccctggagctgtctctggaaagtagctggcgaggttaccttaactatcactgaagaaagaaattttctgacacactgatggcatgtgacttgtctcctaagtcagtgaggcatcactttgtttgcataaagtatacggtttgttaaggcctttgttcttgtgagatgcaaaacagctgctagtctgcaacctagttttccctctcacctttaactgacgttttgtcctcaataattacacaaggacctagagtacctataggacaaaaagtatagaataaaaatatgcctttagtcatttggtttttcttaaaaagttgagattcttaatctgacttacatgttactttatccgtatgtctttgttagtggagaccgctaaactaatgatgtttgaaaacagttcctctgttttagattggaagatagcactctagagtggacatacggaaagactgtgactttattttgtaatgggaggaagaaattttctcagagcaaactttctattttttacctgtgaaataacagtgactttttaaaatggtgacagtgttggcaaggaaacagcaacacaggctgcgctgttggtaggagtgaaaaccagtataattcttctgaaaaacatttatcagaaacttaaaatatttcataccgtttgatccagtagcttcttctaaatcataaatgcagacaatgtttaggtaaagacatactcattaagtgttatttattttactcaagaactggaaaccaactaaatgccttctatagaagtaatttttgatgaggagaaatggtacaatactaattaacaacttggtttaacatgtttactgagcatctgttaagtgttgggggaaaaagcagcaggatccagagctataggtacagtgtgatctcagctttgcaaacacattttctacatagatagtactaggtattaatagatatgtaaagaaagaaatcacaccattaataatggtaagattggtttatgtgattttagtggtatttttggcacccttatatatgttttccaaactttcagcagtgatattatttccataacttaaaaagtgagtttgaaaaagaaaatctccagcaagcatctcatttaaataaaggtttgtcatctttaaaaatacagcaatatgtgactttttaaaaaagctgtcaaataggtgtgaccctactaataattattagaaatacatttaaaaacatcgagtacctcaagtcagtttgccttgaaaaatatcaaatataactcttagagaaatgtacataaaagaatgcttcgtaattttggagtaggaggttccctcctcaattttgtatttttaaaagtacatggtaaaaaaaaaaattcacaacagtatataaggctgtaaaatgagaattctgccccctcacctcttaccccagtactattctccagaggtaatctattaacaatttcttatgtaattttcagaaaatttgtatgcgtatataagcaaatatgtaatctttattttttaaataaatgggatcatattat

SEQ ID NO: 587 - DNA, 123575 bp, Homo sapiens
atgtgcgggacccgacattgtgcttgtcccatccggtgctccgtagttagcctctgtgagctccacgtaggccgcgcaagcgcccttggcgcacagttcacctgctgccgttgtcgtcgccgccgcggctcccggggctggatggggggccgaggccagccagtggcacccggaagaaagagacgcggcggcggcgacgccgacaccctcaggacgagtgtccggacttgcccacagcctcaaggaggagacggcgaggcccggcccccgctgtccctggtgtaaagaagtcgccgtagccgtcgcggccgggactccccgggctctcgcccttcaggtttcgttgacactcaggaccgtacgtacgctgcgccatgttcaagaaactgaagcaaaagatcagcgaggagcagcagcagctccagcaggcgctggctcctgctcaggtacgatggccgccgctctcctcccctggttccgaatacctcttgaaccggcccgcggacgaaagaggcggggggagtggggaagttcttccgtgacctttaacccctaacccgcacttttcccaaactccggacccagaaggagctccgggcggtgcaggtcgtccgtaactcctgacctggattttcccatcgcaaaacttcatccagtcaatgagtggatgggggtggctggatccctcgtgacattccatctccgttaagagttttctcctaaggccagagtccgaacttgcatgatttctgatccatatttgaggttttcccactcatctgagaccccacgctgggaatgagggcggggtggaaaaacccgggtcccttgtgatatctgacctctgctcgaggggtccccctctcttttgccagtcgtgagattttgtatggaatggccaggatcccgcacaattgaccctcgacggaagtctcctaattccaaacccaggtccagggattgaaggctggggagtagagccatcctgggtcaggctgctggtaggagcggtgggacctgaaagacgtggcggcgtggccggcgtccagcgcccgaggctgtcacgagttagtcacttcgcataacttggttaatccgggactggcgggcggaggggcagacactctgcctgtccggagctctgctctgctttttaagtcttgctgctctgcggacagggttatgcttgtttttcaggaatgctgttgctttaggaaatgcgtttccagggaaaaggaggcgtgttaagtagtattaatttaaagaaacaatttcctaagcgttcactggagatgtttcgatgctggcagcacagggtcttaacagcgaagacgtcggtttctgcttaatttcttcccagcctttttgaatttcaacagactgagcagatctgtcccttaattttagggtttttggtctttgcttgcggttgcaagaaaagctgagttttgactaacttggaggcatttctaaattcttaacatacaacgattgcattaggtttattctgaaactataaattgaagttgttctttttaaatgtaaagctcatgtgtagtaaaacagtgcttgagaaaaacatcagaacacaacactgaagggttgcttcttttctcaagtgcaaatggtaattaaaatttaaatggtaaagattgtccttttcataccatctattgcagtcatttacaattttacaaaacactgttaattaagaaacaaagataaactttaaaagtgaggtagagatgaggaatgtgaggaaatgggcatgttagtgaatgtaaggcacttccacttgggaatgtataaaatgtaattgagccaggattccatttctagaaatttattctaagaaaatttaggttgtattaaagatttagctctatggattttcacgtcaatgttgttttaataggttaaaaactagccaaaaatgtccaacaatagagaattggttaaattttatcaggcaattagttatgcttcataggttattatgcagccataaaaagtcaacatttactgtgtcattagtatgtaccagacattttgcttagtatttacacagattatttaatctcacataaacctgtgaggtagataatactataattcctcttttatagatgaaggagtgaggctcgaagaggtgaagtaacttgcctaatgttacgcagctagtgttagagtcttcagaaaagtattaacacagaaggatatttgtgttaaaagacagaagcagcaggtaaaatgtgatcccagttttgggaaaaagaatctgtatgtaagtgtatttatatacacacatagtaaaactagtttaagaagaatatactttaaggtgctggtgaattattgagtgtgctttttcttatttgtagtgtttagcttttcttcgtgaaaatgaattgtttttgttcattaacaaagaggtttttagtaataataagctagtcacaaactaagatataagagctctgtttctatagcttaatgcttctggtgagacagggcatctggatcaaataaaatcactttgtgtacgaaaggtttaaaataatccttttggattatatgtatattcactatgttggccaggctggtctccaactccggacctctggtgatccgccagccccggcctcccaaaatgctgggattacaggtgtgagccactgcgcctggccattcgtggtctacttttgataattattttgtaacctttctttctgcctgccatatatttttctccttgcttgtgaattgttgtgatcttagaaacaaaaaatgtggcctggtatggtggccttacgcctgtaatcccagcactttgaatcgcttgaactcagtagttcaagaccagcctggccaagatggcaaaatcccatttctggcctggcaccgtggctcatgcctgtaatcccagcactttgggaggccaaggcgggcggatcacctgaggtctactaaaaatacaaaaattagtggggcgtggtggcgcacacctgtaatcctggctactccagaggctgaggcaggagaattgcttgaccctgggaggcagaggttgcaatgaactgagatcgtgccactgcactccagcctgggagacagagcgagactccgtctcaaaaaaaaaaaaaaaaatatgttttaacaacaaatacctattttggatttttaaactccttaaagaactaagtcaataaaagaaacatcaagaagtaatacagacattgtaatttcttgggatatatgtagtacatgaatacaaatattttaaaacatttttagccttttcaagtacttctaaaacttaaaaattatagaagtatagatacaaaaggatgaatacatgactccacttaattgaggtacctagagtagtcaaattcttagagacaaaatagaatggttgttgccaaaggctggagagaggagagaatggggagttactgtgtagtgggtacagagttttagtttggaaagatgaaaacgtactggtgatggatggtggtgattccacaacagtgtgaatgtagttcatgccactgaattgtacagctacaaatgtttaaaatggtaaattttatgttatgtatatttttaaaaaatcaacatatacgcccctccttatgcctgcagaatcatcccttatttttttccctcagctcagagatggcagctgacctcactcttttagagtgagaccccaaaataatagtttatgtgatataaatttaaaaaataaaaacaaaaaaaccagcaaacagttccacagataacagggaaaagagtcctttctgaagggacatagccttattgtaaatccaagtttactaaatagtttcagtcttgaaattggggaaagcatgagtcccagagaaaacatttagatcagaaggtagtttattaagaacatgatgaaaggctttaataagtttggtacctaaaatataaaggtttatttgaagaattaaccccaagttactttgactgctcttttagaactgggatgtcaaattgatttggcagtgacttacaacagtgctgtgatgaggattcaatggctgtgtctctgctgtgactaatccataggtgttgtagggagagtgaaatgaaccagatgttagttatgaacagtgaatgcctaggtcctctgctggatgttgcatttgctttgaagggtctatgtagtccctacacaatggagttgagagacaagtactttcagtgtaatagtgatatatacagggtgttgtagttgtgcaaaataaggcatttctggagaagatcagggtgacatctgagtagagccttgatggataatgaaaagtcatggtatagggacaagggattcaaggcttattcctaaggatgactggattagttttctaatattgcataacaagttaccacaaccttagtgcctaataacccagttattattttatagttctgtaggtcagaagtctggcatggcatgactgggttctctgctcagggtcttgcaaggctaaaatcaatatgttgtccaagctgctttctcatctggagctcaggatctttttgtatgcccatgtggttgtggtagaattcagtcctttctggttataggactggggccttcatttcttgctgaccactttcggcttagaggctaccagcagctccttgccacgtgcccctgtaggcattttgctttctttcaggacagcagaagtacgtccctctgccctctagacccatatttgaagggcttatgtaattagtttagacccatccaggtaatcttttgatgaactcatggtcaactgattagtaacctagtaaccttaaatatgcctttaaaatccctttgccctgtaatataacaattatgagagtgatagctcattatattcacagggcaggggtcatttggggtcatcttacagttttgcttatcacaatgactaaaatggtttttcttaagtttttgtagagtcagggtcttactgtgttactcaggcagtcttgaactcctggcctcaagtgatcgtcttgccttggcctctcaaagtgttgggattacaggcatgagccactgtgcacagctaaaatggtttttcttacactgaaattgagtataactgtggtcagttaataattaggcagtgggcaataaaatattaattgtgggtctggatgtagctgtcaggttttttggttaacagcttagaaagctgactcagatttcttatggctattgcaattaatcagctcaagtttggtttgaaggaacctaaatccctttatatcttgaagtgaggatagcccattaaggaaccaggcacctgggacaaatgctgaagtacagttagttctttatgcactgttatatactttatactcacatccattttctcatataattcttactcttgtaactccagaggaagatccagaggaagatcaacaagtcatcaggccacgttttgccagatagtactacttttctagggagagtatgttttagaatctgttaaactttgtaaaccccgttatttgatttttttgtcagtttctccagagctgatgaggctctcagttactgattagaccatatgaggccaaggtgtaagacgtaatgccaatttttcagatttgcagtgaggtatactttttaagcagttggaaggtcactgtctaaggtagccctttcctggcatctggatatttggaaagctgaattaataacccagagatttcttagacatgatagaatcacaacagagagagttgattagtcaagaggtatttcctgtggtctagtagtacttttctaactttttaccacccagtgaccattttattaaaggagttcttagatataatcatttataaatacatagatacaaaaggctgcccccatagtggcagcctttgaggcacctacagcctttgaagctggcactggcatggtttgcaaattatggctctaggtgtgggaagggtttattgaatttatctcaactttaatgaaagctatttctgatgttctttgaacatttgtaatttgaacgtggtgttcaaggtaggctcaaacttattccaagactgagactaatactacacagtgactgtgctttcccttgccattttctaagtacaatgttgacttttagtcacatattttctagacatttaaaccattgctaaggcttcaactttatttcacattgattgattttcttgtttatatgcttttttttttgagacggagtcttgctctgtcacccaggctggagtgtagtggtgcaatcttggctcactgcaacctctgcagttgaagcaattctcctgcctcagcctcctgagtacctgggattacaggcgcacaacactactcttgttcatgtttttaagtccttattcttcctgttttgtctttggtgggagaggatatgtcatcccttaaggtgacttctgcacatagctaatttcatctgttgtattgatttttctggttcatcttttagaaggtgttggagttcttggttgtaagcaacaaaaagtcaatctaggtaagcagaaaaataatttattgaagactctttaccctacagaatttccctgaggtcccaaaagtctgagctgattgctacgtccagttatactggggagactactctgtgttgcagctgcttcagcttggcaccagcattgcatctgtcacttcacagcttatatttgtgtggatgcatgaagttctgtctccattgtcatcagatgatgaactttatttgtatgtctgttttttcacatcactcacttatgactcgaagtctcatgtgtttcattgatggagctcaggttaccctgtctcagataaaaagaagattgggttagtaagttttctgagttctaacttacggacttataagagctgtttatagaaaaaaggttattaaacttttgtcatatttgtagatgcttttcctcacctcccaattaaactgctgctttgatttgtttttcacataaaaatctctttcccattcagagattgtagaaatagactcttgaattttttgtatttcaataaaaaaaattaaatctttaatatagcttaagtatgaaggatctgatttgtgtgtcttgccccatatggatggccagttgtcccaacatttattgaatgtctatcctgatgcaaaatgttacttttatcataagctaaatatgtatatgtctgtctggatgtatatatgtgtatatagagtatgtgtatatttgtatactattcctcacgacctctcagttccaccctaaccacagcagtttgtgcacggataccacagaccagagttccatttgtttattcattcattcatttatttgacaaatatttattaactgccttttgtaaagtgcagactacaaaaagaggtaagatatcatgactcattcatttctcaaaatagatctgagttcagatctattttgctgtgggtgtagggggatttcaaaattttggttttatacttttagggttgtttttagctcaccttagagtagaccccagacctctagtttaaattttgagccctttctcctgagtttttttgcgctgagggttataggagtcaggctgtcaattacagagctaaatggaatagcatctcagtatttagcagtggtattcaaggtaggctcaaagcaaggccattaattaggtgggcaagtgctgtttatctgtgcatttcatactattgaatgttagagctagaaggtagaagggatcttaaagattgaattgccagccttttttttttaaatgaacttctaattttggaataattttggtttatagaaaagttctaaagatagtgcagagagtttttatatacccctcacctggcttcagttttctctaatattatcatcttacactagtatcgcaactttattttatatatggagacacatagtcctcaaaaagttcatgtagctaagatcatagttctagttggtggcagagttaggccagggacctagtaggtagcctgggttttctagttgattatatttgttatccttttctgcttttcgtgtttttgctcttttcctttctttcactgaattctttgggcatggactgagagaaggactacctagttcatagttcactagtcaatatagtcttgctaatttgtgcaataatttttaaatctaggcgtcctccaattcttcaacaccaacaagaatgaggagcaggacatcttcatttacagagcaacttgatgaaggtacacccaatagagaggtaagtttggaattccttttctagtatacctctcaaaagaaactaatctaaaatgtatgctgttgataacaaaatgggaaacttttgacaggtcagctatttaattcctaggtagagtttttattagtaacacaattggtcttttttttttttttttcacaaatagcagttatgatttatgtctgtctgtctgtctgtatgtatgtatgtatgtttttgagacagggtctggttctgtcacccaggctagagtgtggtggcacgatcactgcacattgcagccttgaccttctggattcaagtgatcctctaacttcagcctcctgagtagctgggactataggcgcacgccacctgcctggctaacgtttaaatttttcgtagacggggtcccactatgttgctcaggctggtcttgaactcctgggctcaagtgattctcccaattatgctttataaagtatggttgttgagaaccttaatttgagaggataatatgttctggatttaatagttgaagttttcagaataatttgataaatttgttcaacatagcatcattttttcaagctggtgagtggaaactgagaagtaacttatttaacttattccatgtaaccagcagctggcattaaaactcattatttcccactttttttctgtgaagtgtaacacacatacaaaaagaaggtaaaacataaatgcacgggtcagcaaattatcatgaagtgaatcctcccaggtcaagcaaaggaacactgttagcactgtcgtgctccctttccccctgaaggattaccaccatcctgaatttttggtatttgcttgcttcctttttttttttttttttaatagttttacctcttaaatatgctttctaaatgtaaacattgtagttaaacatttgggttgtctacaggttttggctactatgaattatgttgccatcaacattattgtacttttttttggtgtacatgtacctgcatttctgttggtatgtactttggagtagaatcactgctccattttaacacataagaagataatgctgatggttttccagagtggttgtagaaatttaaattctcaccaggagcttatgaaagttgcttttgccctatatttttgagagtctttatttttctactctgtgtaaatatgctggaaaacagtctttttcatttcagctgttctggtggtggtctttcattttggttttaatttacattctctgataactaacgagattgagcatttacatctgtttattgcccatttgatgtcttttgtgagtgcttaagtcccttgcccattttctattggattatctttttttaaaactgatttgtaggagttttttaaaaaatatagaatactaaggagttttttgttgaatatatatcttgcagctatcttccactcagtggcttgccattcattttaatgatgtcctttgatgaacagaagttcttagttttaggccaagtatggtggctcatgcctgtaatcccagcgctttggaaggccaaggcaggaggattgcttgagtccaggagtttgagaccagcctgggcaacagagtgagaccctgtttctgcaaaaataaaataaaataaaattagctaggtatggtggcatgcacctgtgtggtcccagctactcaggaggctaaggcaggggcattacttgagcctcggaggtcgaagctgcagtgaaccatgattgcaccagcctaggtgacacagtaagaccctgtctttcaaaaaaaaaaaaaagcctggttcccatccatttcccatccctgacagtaccttctatcttagaagtttaacaaaatgagaaaccgcatagggtacagggaaatgatgaaaaaattaatttaatgtccttttaaccaaaaacttaattatataattgaaaaatcctttatttattataaaataagttgaagtaaggtttagattgcactctgtggtcaaagtacctgttaaagttgtcaaaaaagcttaaaaagcaaggagatgaagtgatgacaatgctttgtcattctatccgaaaccatctcttagctaggattgttaatattaaaatttagaaagaaataaataaactttagctgacttggtcgattgtaaaagagtgctaaaaccaaatctttcagaaataattattttgtaaaggtatattcaattaaattattttaaagcatcctagatttttaaaaagtattttaaaaaagcaatggtagcagtcagccgggcatggtggctcacgcctgtaatcccagcactttgggaggccgaggtgggcagatcacttgaggccaggagttcgagaccagcctgatcaatatggtgaaaccctaaaaaaatacaaaaattagccagacgtggtgacacgtccctgtaatcccagctatttgggaggctgaggcaggagaatcaattgaactcaggaggtggaggttgtagtgagctgagatcgtgccactgcactctagcctgggcgacagagcgagacacagtctcaaaaaaaaaaaaaaaatggtagcaatcaacataattctgcactattttcagtgtttcactttattgtatgcaaactaatatactataatgtcaatcaatatactgagtatagaaatgatgccattaatactgattgcaaaaacattacaactcagtactgcagctttcattcaaataggttatatgtataaactgagttcaacaatattgtatttgagatggtaaagttaaagaaatgcaataatgtaaataatacttaagaaaataagatctcaggaaactgtatatactctgtacttttatgcaactttatcagatcatttcagtatatgcatcaaggatatagtgtatatgacatgaactttgagtgcaaaaactgtactatgtaccttttgtttattttgctgtcaacatctaaataaaggtttttttgtttgttttttgtttttttaattgttttgttttaaagattgttttaattaattaaaaaattaattgttttaattaaacaattgtttaattgttttaaagtcgccaggctggagttcaggggtgcagtcttggctcactgcaacctccgcctcctgggttcaagtggctctcctgcctcagcctccctagtagttgagactattcgccaccatgcccagctaattttttgtgtttttacttgagacggagtttcaccatgttgctgagaatggtctcaatctcttgacttcgcgatctgcctgcctcggcctcccaaagtgctgggattacgggcgcgagccactgtgccgggccgtatttttacaatttttaaattagcttatatattatatatattagcttattatattattattagctattatatataatatacattatataaattagcttatatattatatatatagcttatatatattttaaattaacttataccctattatctagaaatcccatttctagaaatctgtcctatagaacaatagcattttaaatgtatatccacaaggcttactgtagaaagctatttataatactaaaaaaatgataaagtttgatttgcaatattaaggctttttccaaacttatctttagactcagtgcaatcccagtcaaaatccttataggtttgttttgttgtcatcattattattattattattatttttgaggcaaagtctcactctgtcacccaggctggagtgcagtggtgcgatctcagctcactgcaacctccacctcccgggttcaagcaattctccctgcctcaacctcccgagtaactgggattacaggcacccaccaccatgcctggctaactttttatatttttagtagagacagagtttcaccatgttggccaggctggtcttgaactcccgacctcaggtgatccatccgcctcggcctcccaaagtgctgggattacaggcatgagtcaccacgcctgacctttatatgtcccttttataaagaagcctgaggcactccaaacaaagacagatttatttgggtttatatacagtatttaccaacacaggaaagtagacatattagtattttcagcaatagataaaaaggcaaaacctttttttaacttaatgaaatcaggaaattaacttaatgaaaccattctaccacctaagcattccagatacgtagactttactgtgtctactgttgcggtggacaaatatttatgttttgagctaaatttccacattttcttttaaaaaaaagcattttttttttttgttttttgagacagggtctcactctgttgcccaggttgaagcatagtggcacaatctcagcactacgcagcttcaacctcctgagctcaagtgatccatccaccttggcctcgtaaagtgctgggattacaggcatgagtcaccgcacagggccaaacaaacaaacaaacaaacaaaaaaacacttaacacttaaaataaatccaagccagtcacagtggtgtgcacctgtagtcccagctactcaggaggctgaggcaagaggatcccttgagcccaggaaatggtttttcaatatggtgtgaagtagggatcaagtttcatcccctccagtatgtgtatccggttgtctcatctttttcacactgctctactgttctacattttttcattaattgggtccatatgtccatatttgagtggctgagttctctattctgttccattgttctctttgataccacactgtcttaatgagtatcgttttacattcatgctttatattcatgtccatatttgagtggctttgtttctgagctttatatattccgttccactgttctctttgtctttgattcaataccatactcccagctattcaggaggctaaggcaggagaatcgcttgaacccaggaggcggaggttgcagtgagccgaggtcgtgccattgcactccagcctgggcaataaaagcaaaactccatctcaaaaaaaaaaagggacataaaaaaaatctatattattataaacattgaaggcagaggagagtagactgaatttgcattgactctgaagtctacattaagtctactctgggtactctcctatcctgcgcaaatggcagatctgtctatttgatcatagcactctctcctggtgatcctaggcatagccccactatcctcagagtagggcttcctgtccttgttgttgcttgaggttaatcttttttgcttccctagttctgggttgctttagagcaacatgtgatgtaggatcctgtaagggattaactagggcaaatgaagctaacatcctcctatcctctgccccactccagattggacctggactttttcagcgatagggtatcactatgttgctctggctggcctccaactcctgggctcaagggaccctgattttttttttttaattgagtttaaattcatataacataaattaaccatttaaagcaaacaattaagtagcgttcagtacattcccagtgttgtacattcatcacatctatctagttccataacatttccatcaccccaaaatgaaaccccatgctgattaagcagtcattcccactccttcctccaacccctagcaaccattaatttgctttctgtcttaatggatttaccttttctggatatttcatataaatggaatcattcgatatgttaccttttgtgtctgaccacttttacttagcttaatgttttcaagattcatttgtgttgtagcatgtatctactttctttttataactgagtctaatgattttttttaagggagtaaaaatctatgtactgtattagtacctggaataagacctggaatagactggtgaggaaaggatggtttttggtgttacctggatcagcccaagtttacatcctgtctttgctgtttgctgactgaaagatctattaaagttaacttttcagtctcaggttttctcatttgtaaaatgagaaatttttgaagttttggggattaccagtaagaaggcatgtacatctctagtgtggtaccttgcacgtagtaggtgctaactaagttattagggacaggcttggaagaggggaggggctgctccccttcctctttttaggtctttgtgtgaggggaggggaacagatgtactattatgtggattagggtcctagggatgttatctctgtgtcactttgcctattgaatttatgaaggaaggattgatagcttcattttgcctcctatcctgctctctctggtttgctgtcttcctgagacacttccttatttattagaggccatagtaaccatgtccattgttatcctggggccttatccacaaacaactttcatattgtttttaaattaaattccagaattaggtgtgttttcatatatatacatatatatatatatatatatgtatgtatatatgtatatatacatacatatatatgtatgtatatatgtatatatacatacatatatatatgtatgtatatatgtatatatacatacatatatatatgtatgtatatatgtatatatacatacatatatatatgtatgtatatatgtatatatatatgtgtgtatatatatatgctctgtatatatatatgtgtgtatatatatatgctctgtatatatatatgttctgtatatgtatgctatatatatagcatatatatgctctgtatatgtatgatatatatagcatatatatatgctctgtatatgtatgagatatatagcatatatagagagcatatatatagagcatatatatgatatatatagagcatatatatatatagagagcatatatatatgctgtctgtatatatatatgctctgtatatatatgctctgttgctcaggctggagtgcagtggcatgatctcagctcactgcaacctctacctcccaggttcaagtgattctcctgcctcagcctcctgaatagctgggattacaggcatgtgccaccacacccagctaatacttgtgtttttagtagagatgaggtttcaccatgttggccacgctggcctggaatgcctgacctcaagtgatctgcccaccttggactcctaaagtgctgggattacaggcatgaaccaccacacctggccccagttgttgagaattcttaagcacattttagagatttattttatgtttcaaggcttatatggcttaaaggcatcgttttagggattactgggaagtatcttcaaagtaatacatgagaaacattccttcctaaatcctttattatattgaatatcgtattaattggttttcagaggttaaattaaccatgtattcctgcaataaatgtcacttgtttcttgtatataatcttttttatatattaccggattgattcattagtattttgttgaggatttttgtgtctatattcataagagatgctggtctgcagttttctttttttgtgataatctggtttttgtatcagtaatacagcccccatgaaacgagttgggaagtgttcacctctcttgtattttttcaagagtttgtgaagaattgctattaattctttaaatgtttggtagaatctaccattgaaatcatgtgtcctgggcttttttttgagggaagtgttctgataactaattcagtatctactttttatagctctgttcagattttgcttcttcctgagttagttttggtaatttgtgtatctctaggagtttgtccatttcatttatctcatttgttggcataaattaaactaaatttggcctgagcctacctgtatatcttgagtccctctgtaaggaactgtagcctaacttgtacataaacaaactgaaatcctaaattaggaatgtagtttttgtaacagctcctgagtctcaggcagtcacagcagtcaagtctgtcaattgcaggctgctaactaagcagcccatgctcaaatgaggcaaaaacctttgcttttaacacatagtatagctttgtaatccttttctgcacactcgggtaatttcttctttttcattcctgattttcatgatatgagtcttcttttttcccctctgtcagtctagctaatggtttgtcaattttgttgatcttttgaagaacaaacctttggttccactttcttgttgcatatgctgagtattctcataattggagtggaaagctgatctttgattacttattttacttagggctgaggagttcatggacttcgcaaaacctccttgaatctaaattgcatcttctttcctggtttctgggctgatacatgttttttcccatcttatatacccttggtcttttcattggcgattaagactagagaaagttagataccttgtccttttatgctgtcattttgtttaaaggctttctatgtagtaaaactatctatatagacaaaatagagccttgagttgtggtcttgaatttgatcaacatgatttaccacattctgtactggatatttcttcacctgctgctactgtaaaccattttattcttggatcttctgtagagtatattatcacaggtactttttacaggggtgtctaatcttttggcttccctgggcacattgaaagaagaagaattgtcttgggccacacatcaaatacgctaacactaataatagttgatgagctaaaaaaaaaaaaaaaaagcaaaaaagtctcataatgttttaagaaagtttatgaacttgtgttgggcctcattcgaagccatcctgggccacaggttggatgaatttaattgacccaaaatcataagggttctactaacagttgtacttaacagtatctgggaagatagaaacagggccatctgccaggtgtggtggctcatgcctgtaatcccagcacctaggaaggccgagtagggtggattacttgaggtcaggagttcgagaccagcctggccaacatggtgaaacccaccccacccccgctgtctctactaaaaatataaaaacttagctaggtatgttggcgggcacctgtaatcccagctactcaggaggctgaggcgggagaatcgcttgaacctgggaggtagagaggttccagtgagccaagattatgccactgcactccagcctgggcaacaagagtgaaactccgtctcaaaaaaaaaaaaagaaacagggccatctgtctttgaggcagagggatttacacccttgctaagacactaaagttttttgctaaggcactaaactttttaggcccttcccccagtattacacatgagagatgataatcaagcctttgttgcctatgagtgaaaaggaatctaaaaatcactgaaataaataataatagtttttcaaggaatttcaaagaagttttttcacatgggaaaggactgctaggctggatgtggtggctcacacctgtaatcccggcaatttgggaggctgcagcaggaggaatgcttgaacccaggagttggagaccagtgtgggcaacatagtgagaccctgtctctaccaaaaaaaaaaaaaaaattagccaggtgtggtggtgtgcacctgtggtcccaagctacttaagaggcttaagtaggaagattttttgatcccaggaggtcgaggttgcagtgagccatgactgcgccaccgcactccacccttggtgacagagcaagaccctatctcaaaaaaaaaagaaaaaagtctgctggttgttgttggaaataatcagtcacagtggcatgctgcctaacatgctaaatcctcacctggaagactttaggactttcggtcaaatcatgctgtgatttgacccttgaggcacccttgctgtttcagtcatggaagtagtagataaaacttaaaaaacattgagacatgtatctgagttcacaaacaaggtaaacatctccttgggctgagagggaatgaatccttggtcctagagggtttggggttgggacaaaggcagccattttcaactagggttttgtgagagaattaagccctatggaaaatgatttgagtaactgcagtttttaattcttccaagtatggtatgaaactagtaccatgctatatatacacagtagatacattaattcattgtatacaggcatttggatttaattttctctttgaactctggttgagaaggactggaaatgttctatacagaggagattttgtgttacaagctgagagctaatgtggggctcctagcactggtgaaaggaagttgaaaaaagctgtcactaactgctgcctagagctctcagtggtccattatgggaaactgctgtccttagggaggcctcatgaccaagaatcgaatccagcctcacattatcttagtgattgagtttgtgataacccctatattgccataaggtaagaaacctgaaccaaggccttgggtatcagattggctggataaggagggatgagcacagaaggaaggacaaagataatacctttttcaagatgagcctgtaaatgaaaattctaaaataaatgctaagaaggccaccagtaaaaacagagattaagacatatttactccagatgaaattaaagtaatacaacagtctggaaattactttaaaacaactttcttccataagaaaaaggaagtaataattttcttaaaaagaacagaaaattgtagaagaaaaagaggccaaaacaaaactagactagatggatacgaaaaataactaattagaaatcctggaaattggccgggcgtggtggctcacgcctgtaatctcagcactttgggaggccaaggcgggcagatcacttgaggccaggagttcaagaccagcctggccaacatggcaaaaccccatctctactaataatacaaaaattagctgggtgtggtggcacatacctgttatcccagctactcgggaggctgaatgaggcaggagaattagttgaacgcgggaggtggaggttgcagtgagctgagatggcaccacttcctgggtgacagagtgagactcccatctcaaaaaaaagaaaaaaatcctggaaatgaaaaaaaaattgatgtaaacatgtaaatcacaataaaactcagactgatgccagttaaagagaaaattatagaattcagaaagaacactgtggctaggcctgatggctcatgcctgtaatcccagcagtttgggaggcggaggcaggtggattgctagagcccaggagttcaagattattctgggcaacatggcaaaaccctgtccctatttatttttatttaaaaaacaaaaacaaacagacaaaaaatactgagtaatcctaccaaaaccaccgagattaaggaaaaatatatgatgtgcctcataatgatgttttgttcagtgatggactgcatatatgacagtagtcccataagattataatggagttgaaaaaatcctattgcctggtgacatgtagttgttgtaatgtgtttgtggtgatgccagtggtataaaagctcacagtaatgtcctaggacttcaccttcactcaccactcactcactgactcacccagaacaatttctagtcctgccaatcttcattcatgataaatgagtgccctatagagttgtgtcattttttcttttattctgtagttttactatgcttattctatgtttacatagataaatacttaccattgtattacagccacctacgatgttcagtacagtaacaggatggactagtttgtagcgtaggagcaataggctctaccatgtatcctaggtatgtagtatgctatgccatctaggtttgtgtaagtatgcttgtccaacccagcttattttgctgttgttcttgttctgtgttttgttttagtcttttagcagcctaaaggcatggtttttagtttctgtctctagtgataagcgggaaagagggatgaggaagggtccttactgatccaaccaggaacagaaactaagaaccgatggctgtattctctcccttggacacccctccatgatgttcacatgacaaaatggcctaacaacacatttctcagcatgtatcccctccctattgttaagcagtgcaagactgtatatcctccacgtctcacactctcatatatgtatgtgtgtttatttaggaaggaaataacaaggtcaacaaagactccttaggctttaaggtggctgccaatggacactaattttgatatactttgatatacacacgcatatatatatgagagtatgagacatagattgaaagccttcgacgcatatctgctgagagtttcaaatagtcttcatgaatgttcagacacatataacttcagtgttgattcaactgatggcttcactggggaaccacacagaagaggtgaattaaatccttagcagaattgcagcagaattggttttcaatttgaacagagtttgagtgatggagttgagacagaatcttagtgagaatattagagaactgttgcttgcgagactttctcaggcataagaaggaaataacaaggtcaacaaagatttcttaggctttgagatgactgtcagtggacactaattttgatatactttgcttttgctagggttagaggtcatagtgtacatttttgtttggcagcacatcttgaaatggtggacatttttctgtgctgggcattagcctttgtgtttttcttttaaaatttcaaatatactcctctgaagttttgaattattttctaatgtgggcaagagcgacttcattacaaaaattaactttggaagtctaagaaaagtgaattttttatagcctttaacttaaatttaacatccattcaaaggatgatctgagttcctgggagagtaagattttcagcaggagtagaaacttggatatgatgataccctagagccaaagaggcatttagcatattttagtatactactaatactaaaattgagaatttagtgtaaagttaattgctgaatcctgtctaagaagtactagttattacataatataaaagactttgaaatgtttttcctatttataattatgatggtctctaatgtaggaccaaatgaacagttagttaaggctctagttagtattcataactctgcagtactgagtgaaaagtttatattcttaagcttttgcagactttttttttcagatgttattatatatggtatatgtaatttatcaccatgttagataatatattaactgctaaattcatgtttcaaaaattttttttggaggcaggatctcactcttttgctcaggctggagtgctgtggtgtgatcacagctcactgctgggcttaggcgagcctcctacctcagcctcccaggtagctgggactacaggtctgtgtcaccatgcctggcaaattttttgtattttttgtagagtgggttttgttatgttgtccaggctggttttagtttttatttagaaataattatagattcataggaggttctaacatcttttgtgggggaggccctatatacccatcacccatttctccccagtagtaacaccttatataaccatagtacactgtccaaacaaggaaactgacattggtaatctgtgacatccacagaacttattcagattttaccagttttacatgctcatattgtgtgtgtgtgtgtgtgtgtgtgtgtgtgtataattctatacaattttattatgtgtagatttgtgtaacctccctcatcaaaaaattcattctgattataatttattgtacatctaattaatgtttgtcagtattttggtgtgtagtatacagtttctgaaagaaaactaaagcacagaagataatatataccagaagcactagtgtaacagaaaatgtctttaaacttatagagtttcaaatgtttcttctgtacatactttagagaaaaataatgtggtatgtaagtacaaataaatgattaaagttttttatgttttatcttctccatgtgttctcatgctattttttgaatatgtaaaaatgggtcagtatttataaatgttattcttaagactttgtgttctttactatgcatttttaagcccactttactgaggtatgattgacatgtaaaaagctgtacatacttaatgtatacaatttgatgaatttggtgttaagtatacacctgtgaaaccatcaccaccatcaaggccatagacatatctattacctcccaaagtttcctcctacccccactgttactatttgtggtaagaagtaacataagatctacttttctagaaaattttaggccggttgtgctggcttatgcctgtaatcctagtacttgggaggctgaggcaggtggatcgcttgagctcaggagttcgagaccagcctgggtaatgtggtgaaaccccgtctctacaaaaattagcaggcatagtgatgtgcgcctgtagtcccagctactcaggaggctgaggtggaagatggcttgagtccaggaggtggagggtacagtgatccgagattgcattactgtgctccagcctgggtgatggagctagaccttgtctcaaaaaaaaaaaaaaaaaaaaaaattttaacgttataatacggtattgttaactgtaggcactatgctatagagaagatctcgataacttacgtagcttgcgtgtctgaaactatgtcctgtcatgtatttttttattgtttgttttgttttgtttttttgagatagagtctcactctgtcacccaggctggagtgcaatggtctcactctgtcacccaggctggagtgcaatggcacgatctcggctcactgcaacctccgcctcccaggttcaagcgattctcctgcctcagcctcctgagtggctgggactacaggtgcgcaccactatgcctggctaatttttgtatttttagtggataaagggtttcaccatattggtcaggctgatcttgaattcctgacctcgtgatctgcccacctcactctcccaaagtgctgggattacaggcctgagccactgcgcccggcccatgtattgttgttaattggtattgatttttataacagagtgccaggcactctgtgtgcggtggttcctattgcctatatcatttgtatgccaataagcaagttgttcatagattggattttgagatcctaaactgatcacgcatctccattcctgatattttccagcagcttattatttctgtgggtgagatggtggtggtggtggtggtgatggtggtactgaaggccattatagtgttatgcatgctgcgtggtgagaacactttgcaacatgccattatgatttgtttttcatcatttgttttatttttgtacttttgcttattacactgaatgagacagctactagccgggatgatagcagagcctgcttttctctctgagtatactatctttgctttggattcctccaaacatcctaaaacacagagtgacagtgtggtgagtccttccaccgctttctgcattccctttgtggggaagcaaagtaatttggcaattgtagaagcaaatctcatgttacttgccacttaccatctctcaaagtatcttcagtgtcctgttgctaaccctgctctaaaaaaatcagagagtaaattgctgaattctgatggctggtgtgcttcctggtagctttgtaactgcaacaaaaataacactgttttcgctaatgtagctacttcagtaatgaagctaccttcgcttactctaacctctttttttcctagggaatgtttgttcattaactaaaaaaaggtatgcagtgctacaaatctctgttctactattgatgggcggttaagaatattttgagatatgacttacatttttaggggaaaaattcgttgttatgtaaatccataattaaacagcattgaataggtaggtagattctactgtattagataattgcatcttattttgcagttacctgttttttatatattaaacatctgaaagagaattgtctcatttgtttttaagtgactggcgtcatacggttttgaatcttgtatgtaatttcattttgggaaagtggacattttcctattgaaagtatctggtaagctcataatttagcaaattaaagtttagagatgtttgtccagtaaggatagcctttggtgttaaacactgactctactgggattgaggtttttctttctttttttaaaaaattgttccacaaatctatttattaattacaaaaacaaaagaaaagtttacaatggagaaatgtggcaaacaccattggattgaggtttttctaaacaataagaattgatttaacttattaggtagctggtgatggaagtagaacatttcggtacttgaaccatgtagccagtgaagacttggtatgcatatggccagtagcagtcttaaattacattgtaaactcagttttagaaaagaaagcagctagggagataatgggatttctagtgatggcttagcttgggtctcagggaaaagtggtctctccttggctctggctacaagtaatatctcattgttttaaaaactgatttgggagggaatcagaagtcccaattagagagacttgtttactgtttttatttatttatttatatttgtttgagtggggtctcattctgttgttcaggctggaatgcagtggtacaatcacggctcactacaccctcaaatccctgggctcaagcagtccttcttcctcagcctcccaagtatgtgggaccacagacatatgccaccatgcccagctcatcttattttagtctttttagagagagagtctcagaatattgctcagactcatcttgaattcctggcctcaggtgatcctcttgcctcagcctcacaaagtgcttggattacagacatgagccactatgtctggcccaatttactttgaaaagcataaaataatattgctttatattttcatgtagtagtaatagaagctattaaaaaaaaaaccgtaaaggttctcctagggccacttccataagtacattaaagtcatttgtattgagtacttattctgttgttgaaaatgctaataatgttaaagtggggctttaaaaccttttttttcttttgagagagaactttttttttcttttgatacccaggctggagtgcagtggcacgatctcggctcactgcgacctctacctcctaagctcaggtgatccgcccacttcagcctcccaagtagctgggaccacagatgcgcaccaccatacctggctaacttttctatttttagtagagatggggtttcgccattttggccaggctggtctggaactcaggctcaagtgatccacctgcctcggcctcctgaagtgctggaattacaggcctgagccactacgcccagcctagtcagaaacttatttctcccaatggaacaagggaaaccatagcatatcccatattagaataaaaatttagtgagggtctaatccattacaagttcagtaggtactgacttttgcttagttaagttttttgaaaaatgcagctgtttaccccaaattctaaaattaccgtaaccttggtgctcagcagtcaatgcaatggttgttgaaagattgaaacaatatgtaattgaagacaagtctgtcagggaacctgtgtgtgcttttaagttgaatatactttaaaagagtttttatctaattttcccctgtagaaagtattggtgagttttgagtattgacatgtattgagctagttctacaggcacctcgctaggggaaagccttcagaggaagcaactgcataaggatttaataagcatttattgagcccttactactagtcaggcaaaatattaggtcatggggactaagatgaaaatggtagcattctcaccatgggacacgtttacctatgtaacagacttgcacatcctgaacatgtacccctgaacttaaaagttgaagggagaaaaaaagagaagaaaatgtagggctctgtcctcttgagagtttatagtttactttggagacaaacatgtcaacatacacttaaagtacaaaggaattaaggcttcacagaaaaaaaaaataggcataaggaatgtgttagccttccaggaaccgtataaaacttcacatacagagcttcacaaaatttgaaagctgaaagatgtacaaaagtttggcacaaatggagaaggcattacaaatagtgacagatctctaattttacttctaaatattcgtaatgtaaattcacagggcaacttaggccagtacttttcataagctatcctgcatttatttagatatgtggtttagtacataaattgaaatatatatatgaggagaagtttttaaatgttgttctctgtgtgcttaatggggtgatatttcaaacaattgtagggtagcttttttttttttttttttttttttttgaggcagagtctcgctctgtcacccaggctgaagtgcagtgttgtgatctcagctcactgcaatctctgcctcccaggtaccagtgattctcctgcctcaggctcccaagcagctggtattacaggtgctcgccaccatgcctggctaacttttttatttttagtagagatggggtttcaccatgttggccaggctggtcttgaactcctgacctcaggtgatctgcctgcctcggtctcccaaagtgttgggtttataggcatgagccactgagcccggccagttgtagctttttttttttttttttttttgaggtggagtctcactttgttgcccgggctggagtgcagtgacaccatcttggcgcactgcagcctctgcctccaggattaaagcgattctcctgcctcagcctcccgagtagctgggactacaggtgcctgccaccacgacgtttttatagaaaatataatttttatatttttagtagagatggggtttcaccatattggccaggctggtctcgaactccttacctcaggtgatccacctgcttcggcctcccaaagtgctgggattacaggcatgagccacaacaccagcccagtgtagcttttttgtatggaccacaatcatgtgtcaagtcatttacttaaaacagaatatggactcttgctgttcttcctcttaagctaaatattttatggagccccttcatttcctttctccataatttgtttattaattttcagtatattaactggccaagagaattgttgatctctgtaaagtatattttgtattttatgcaattgtccccaacctttttgggaccagggactggtttcatggaagacagtttttccatgaactgggggcacagggatggttttgggatgattcgagcgcattacatttactgtgtactttatttctgttattattacattgtaatacgtaatgaagtaattatataactcgtgacaatgtagaatcagtgggagccctgagcttgttttcctgcaactagatggtcccttctgagggtgatgggagacagtgacagatcatcaggcattacattctcattaagaccacgcaacctagatccttcatatgcacagttcacagcagagttcgcacttctatgaatatctaatgtcaccactgatctgacagtagacagagctcaggtggtaatgcgagtgacggggagcaggtgtaaatgcacatgaagtttcgcttgctcacccaccgctctcctgctgtgtggccccgttcctaacaggctatgagttgatactggactgtggcccagagatttgtgacccttgctttatagtatgtagtatattatatttttagacctagaaggcattcattgtaatgtcacacaggtagatgccatgtaggcaactggaagataaaagttaattcctatgttctcccaacctttcttccccatctaactttaaggaaatgtcttagactgatgaaatttgatagctttttattagagggaagaggaggtacttaaagtttgtctttattagggaaaagttgaaacatattacaaaagtggaaatagtagtagtattggtacaagaacccctccccatatctattacccaatgccaataattaataactcatggccatcttgttttatctattagcctacccctacacttccctgaccgtaccactaccattttgcctacttgtgcagctccccctggcttccccactcccaccccattggatatttgaagcaaatttcagaagttctgttccatcagtaaatattttggtatatatctctaaaacagtgcttcccaacctccaggcacaggtccgtggccctttaggaactgggctgcacagcaggaggtaagaggcaggcaagcaagtgaaacttcatctgcatttacagctggtctccatcacccgcattaccacttgagctctgcctcctgttagatcagtggtgacattagattgtcataggagcgtgaaccctgtggagaactgtgcatacgggggatctaggttgcatgctccttatgagaatataatgcctgatgatctgtcactgtctcccatcacccccagatgggactgtctagttgtaggaaaacaagctcagggctcccactgattctatattatggtgagttgaataattatttattatatattacagtgtaataatagaaattaagtgcacaataaatgtaatgcatttgaatcatcccaaaaccatccctgcacccccggtctgtagaaaaattgtctttcatgaaacccgtccctggtgccaaaaaggttggagaccactactctaaaagataaagatggttgggcatggtggctcacacttgtaatcccagcattttgggaagctgaggagggcagatcacctgagaccagcctgggcaacatggggaaaccctgtttctacaaaaagtacaaaaattagctggacctggtaatgcacacctgtagtcccagctactgaggaggctgaggtgagaggatcccttgagactgggagcttgaggctgtagtcagctgtgagcatgtcattgcactccatcttgggcaatggagcaagaccctgtctcagaaaaaaaggattaaaaaattttagccacaatattatttatcacacctaaaaattaataatttcctaccatcaaactacttaatcaatgttcaaaaagtagaaaacacgtttgcaaaactgagcacctttttcacttaagaataagttaggtcagatatttgcctttccttggtcagctctagaccaaggggaaatgcaagatgtaactactgaaacatagtggttggcatttggtggaatatttttgtttaaaacatggaagttattttatcatgagttacttctatagttctaactaattttagttagacaatgtattataaatgcagtgtagaattttgaacctcaaagaatctcatctagtatcatgaaatctatgccagtatgatgtaatcagtagaatgttgcttaactgggagcctttggcataccaacagaacagaacaaaacaaaaatctttcgcgtgtggaagaagaggtttttaagttcttctgaaaattatcatttcatttagattgctaacttcaaatgaatgagacattaccgtttcttgctatcaagatatttttcagagcttagcccaaataattttgagtattattttattgtaggaaaaaattgaaattacttccttttctggatagttttctgtttgagtgagatttgtgcattgattccctgatgttgatttttgttatgggggaaaaactggggacataatgggaagaggtatgtgactagcttgaaataggtttttctacatactaatctttgctattgagttctgtgtattacagcaaaatgaattttctaaaatacttaccatactacaatagttttgccttgcatgaaaacattctaataaatgaacaattactaattttgtttaatagataaatgtatctgataggtcttggcacatgggctttattcttaacagttttaaacctttagttttttgttcttttgctttacaatgtttctttctttttcttagaatgcatctactcatgcctcgaaatctcctgacagtgttaatggaagtgaaccaagcattcctcaggtctgttactaattgttattttagaaaataacaagtcatttcagagtgttggtcagtctgtgttaattattagcatctgactttacattgaaatggtgatgtccaaatattcagtacagtatatatggtaaacacaggtttgctcatggtttcttggaaaaagttttaaatgaaagcaagactgtattatttctcattttaaaaattaatgcaaggccaggcactgtggctcccgcctgtctgtaatcccagcactttgggaggctgaggtgggcggatcgcttgaggccaagagttcgagactagcttggccaacatggcaaaactctgtctctactaaaaatagaaaaagtcagccaggagtggcgcatgcctgaaatcccagctacttagttggctgaagcgtgagaatcgcttgaacccaggaggcatacgttgtcatgagctgagtttgtgccactgcactccagcctgagcaacagagtgaggctctgtctcaaaaaaaaaaaaaaaaagataataataataattatgagaaagtgaaaactttttgaaaaactgtgatctgagtttatagttataaaagatcatggaggtagccatattgagagacatactgagttatataaggtggaaggggaatatgaaggaatgagatcttttaaagtattctctactttaaagtgtattttactactagagtttaggttgtccttgattttaaaaagttatttataaagaggggctcaagtcattttttgtttgaacccctccaaaaaaggaagaaaaaaaaatcattatgatagcaggctgggcgcagtggctcatgcctgttatcccagcactttaggaggctgaggtaggtggatcgcttgagaccaggagttcgagaccagcccagccaacatagtgaaaccctgtctctactaaaaaaatacaaaaattagctgggtgtggtggtgtgtgcctgtaatcccagctattcaggggactgaggcatgtgaattgcttgagcctgggagtggaggctgcagtgagctgagattgtaccactgcactccagcttggatgacagagtgagaccctgtctcaaggaaaaaaaaaaaattgtgatagcagtgttggagatgaacatttgctgactttggttttagtgatgactattatcatcatcctggttgttcttagtagtccctaatgtaaaatagtattatttctaattctgtgaacccagggcatgagtctagacaagttgatttatgagctgaatgatttgtgaactaaattacatagacaaaacattcggaagtattgtctaacaaatgtttagggccgggtgcggtggctcatgcctgtaatcccagcactttgggaggccgaggtgggtggatcacaaggtgaggggttcgagaccagcctaaccaacatggtgaaaccccgtctctactaaaaatacaaaaaaaaattagctgggcgtggtggcgggtacctgtaattccagctactcaggaggttgaggcaggagaattgcttgaacccgggaggcggaggttgcagtgggccgagatcacgccactgcactccagcctgggcgacagagcgagactccgtctcaaaaaaaaaaaaaaaaaaaaaaaaaagaaaaaaaaaaccccaaaaaaacaaatgtttaaatgagcttcccaaactctgtggacaggtgtcttgtgagcttagatcctcataactgtcagtgaggctggtcaggttgtgggaacagcccaagtccctgggtctgttgactctagtcttgagcagccactccagttaatcccaaattctctagaaatacataattttctataagtgccatgaagtaggggtaaaatattgggaggcatcagtctaaacagcactgtacagaacatatccagtgatctttaaagaatatcattggccgcgggcttcgtttgtgaggaagggggcctaggcccgggcctgcggtggtgggggttgctgcgcgccgggggtcgctcctgctgtgtcttccgctccagcttcgcccacttccccttgccagcggggtgggcgcggagaagacctgccggagccatggaggacgaagtggtccgctttgccaagaagatggacaagatggtgcagaagaagaacgcggctggagcattggatttgctaaaggagcttaagaatattcctatgaccctggaattactgcagtccacaagaatcggaatgtcagttaatgctattcgcaagcagagtacagatgaggaagttacatctttggcaaagtctctcatcaaatcctggaaaaaattattagatgggccatcaactgagaaagaccttgacgaaaagaagaaagaacctgcaattacatcgcagaacagccctgaggcaagagaagaaagtacttccagcggcaatgtaagcaacagaaaggatgagacaaatgctcgagatacttatgtttcatcctttcctcgggcaccaagcacttctgattctgtgcagttgaagtgtagggagatgcttgctgcagctcttcgaacaggggatgactacattgcaattggagctgatgaggaagaattaggatctcaaattgaagaagctatatatcaagaaataaggaatacagacatgaaatacaaaaatagagtacgaagtaggatatcaaatcttaaagatgcaaaaaatccaaatttaaggaaaaatgtcctctgtgggaatattcctcctgacttatttgctagaatgacagcagaggaaatggctagtgatgagctgaaagagatgtggaaaaacttgaccaaagaagccatcagagagcatcagatggccaagactggtgggacccagactgacttgttcacatgtggcaaatgtaaaaagaagaattgcacttacacacaggtacaaacccgtagtgctgatgaaccagtgacaacatttgttgtctgtaatgaatgtggaaatcgatggaagttctgttgagttggaagaattggcaaaatatctggaccattaagaaaacggattttgtaactagctttaaactaggccaagcaactagttttcctgcaaatcaaatttttaaagcaacttgagttagactttgtttttgacctaacatcccttccttaaatgccttctgtagtttcagatcagtagggagaccatataataattgtatggtacctgtttcaaaacatattttttctgtttttataagtaagttgatattaattaaactcttggcaatatttcttctttcttaaaggaaaatacaccttaactttttttcttttacactgtgaaacatacacagtagaaattctgttactctctgttattaatacataaatgaaaatacttttttttccatattggcatgtagctacaaatattaaaggaggagaaaaggtaatataattttaggtttaccaaatatggtgtgtattcaaataatacttgaccagcttatctaaaatgtacataattttgaggtagcttatgaatttgattttaattattatgttcacaagcttggaatattagatattattttgcatctgtaactaaccgtgatcatcatctcttgtaatttcttgtacatgtatattacttgttcttaatagatttttggaaacaagactttattgagatcagtttggttttcctgttaatttacctgtttgactttataatgtgttttagttttgcagaagaacactgttgtagtttagaaggcttttcataaatcccctcataggcaaagatgagaacttcccactatttttttcccctcttaggaagacatactggaaagaaaatgtttagcatcttagtgtagtatagctattgtaaacagttcatgactagattttgattcggaaatctatactgaccaaggattaatcttaaggactgtataattcattaaagcggtggtctttccatgtggagactgatagaaaataattttgtcccaagtcttatttgctgactttttctgtcaatgagtgagattgttgaacaaactgaatatatgggctatagcaagtagctttacagtacagatcttacaattaagttttgcttttgttaaagtgtgtaccattttttctgtttggagtaagacaaaaattgttttgacataggttccctagggtacacttgctctagcatactttaaaggccactgttgcaaagtctacattttatgctgaatctgcattctgtcaggcacccgtagaaagacctcagtacatgctttgcactctcctttgctccctttttccaatttcttattgcatatcattttgttgtaatacagaaagcagcatttttaaatgtccatgttaagaattggcccactggtaccgactcacctctattttgtcagttcatagttgaagattttgttttatttcaaaaacaaagtacatttttgaaataatgtttcagaataaaataatctcacttttaaattaagtgatccattttaaaatttgtaattcaataaagttttttttgttgttaaacataaaaaaaaagaatattattaaagagtatgatttaaaatgcatattttcttttcttttttttttttgagacagagttttgctctttttgcccaggctggagcgtaatggcgtgatctcagctcactgcaacctctgcctcccagattcaaacgattttcatgcctcagcctcctgagtagctgggattgcaggcacctgacaccacgcctggctaattttttgtatttttatagtagagacagagtttcaccatgttggccagtctggtcttgaactcctgacctcaggtgatccacccgccttggcctcccagagtgctgggattacagggatgagccaccacacctggcctaaaatccatattttcttctgtcacagaatagtccaaaaagactaaatatagttatggatacaaaaacttgaatgagtcaactttataacaaattcagaattttaattaaggtaaagaatgaatgtaggtgatattcaggaaataagctcactgagggctttgcactttcttaaatattacagatattttcttaaaaagtgataaaaatggtatttattgtgtactgtgtattagacatatatgaaacattttacatatatgatctcattaattctcataacaaaaagatgccttcactcagtttgtttactttttttttttttttttgagacagagtctctctgtgtcacccaggctgtagtgcagtggtgcagtcatagcttactgcagcctcaaactcctgggctcaagcagtcctcccacctcagccttccaagtgactgggattacagatgtcagccatcacgtctggcttgtttacctttattttaaacaaatttctgaaaagttgattgttgagtttagcaaattaaaaacaatgtatatacacaaagacggggggatgcttactatgtttgagcatattgacagcagcaggaaaccatagttgacagcaaggttgaagacatggtaaaaagcacatcctagagttcttaaaacatagcagcctgtggaccctcttattactggggcaaagtatcctataaagattgaacatccctaatccagaaatctgaaatccatgtgctccaaagtctgaaactttttgagtacccatatgatgccacaagtggaaaacttcacacctcacctcgtgatgagttggagtcaaaacactggtgtacaacatagtttattcagtgttcctaagagaagaaagcttccccccgccctctagctgtaagatgatcttttccaggcatacccagattctctcatgcgagcatgcccacaaagcgtaatacagtggcacatgtgcaggccagatggcgccaagggcaggttccccatgatgctccacgtggggccaagactcatgtgctttacttgctgtgttttttttccttcttttctgctctgttatatgaagatttgttgaaaatgttaaaaagtcctgcagaggcccagcgtgttggctcacacctgtaatactggcactttcggaggctgaggtcggcagatcacctgaggtcaggagttcgagaccagccgggccaacgtggtgaaatctcctctctaccgaaaatataaaaattagtctggtgtggtggcacatgcctgtattcccagctacttggaaggctgaggcacgggaatcacttgaacccgggagttggaggttgcagtgagctgagatcacgccactgcactgcagcctgggcaacagagaaagactattgtctcaaaaaaaaaaaaaaattaaaaagccatcctgcagaatgcctcctccttcctagtggatccatttcctggtccctcaattgcttccggtgtttcttcttacctaaaaaaagaaaatacagtgtagagtaaccgttcaatcaaaacacagcatcgtagatagagactgaaagcttaccattgtttgttgttgctgttgcttaacagctattacagatattctggtgatactactgtgctgcttagttaccctgaacacattttgttttactgtattaatggtatgtcatatatatatatttctttcactgtgaagtacttatgggtgaataagcataagaaaattattgcttatcagtagcatgtaagttcagagtcaggaatgatggtggtgccagacaaccatagattgtattggtggctgaaattgtgacacctttgctttctgacggttcagtgtacacactttgtttcatgtacagaaatggtgaaaaatatgatataaaattaccttcaggctatctgtataaggtgtatatgaaacataaatgaatttcgtgtttagacttgggtctcatccccatgatgtctcactatctatatgcagatactccaaaatctgaaaaaaatctgaaatccaaaatacctggttccaagctttttgaataaggagtacttagtcaaaatgagttcacaatatacatattgttttataatttgacctttcccatttaatagtatatcttgaacttctttccatatgttattgtttatttttaaattttttttgaaaatactttatagaccaggacatacttttcaagttgccttggggagtgctctccatatactataatttataaactgtatcctctagtgataaacatttgggttgtttccagtttttactcttttaaaccacctgtgataaatttgtgtgtatgaaggtatgggacatattatctcctcttactcctaccttgcccaatattattaaatctctagaatccgtgagcaaaacatttctgttttgatttttcaaactctagactgaagagaatctttttattttcctgtattttttgcctacacatgacctcagtttccctggagtatttcactcctggcacctttgagatcttagtgacccggttgttaactaatgagaatgagcttctaggagacatcagtaaatattgactgctgtgacctgaacaaaataatactgcttagaacagttagttgaattaggtcatattatttttcattgtgactaaattaatttgttattccaattaattaggagaacaggtcttccttatcactgtctaacattggagttactgatttgtgcagagggactctaactcagacctttcaactgtcctccatgatttgttaatgcttatttttattcctagtagacaaatggtaagtagagcagagttggctgttactagtcaactctgcctcacattcccttattaaacaaagtgggttcattacacattaccctccccccatcccaattcccctcttttcttgggaatgatcaagaattaccatgtccataaagaccctccagataaagcccacttgagttcagttacacacttcacatttcatggtatatacctacattttagacactgggtatgcactgttacagatggtgtatggagatggtcactaccttcaaggatctcacagtttagtggatgaatcctcacaatacacctgtgaggtcggctgggaaagtactgtgtttttctttcttccagatgtgcaaactgaaggaaagtgacttactgaagggcattctacctctaggtgacagacctgggacctgcaccccagtcctctgactccaggtccaacactgtttcagcaataaccaagtgttttgtttttcagaaaacaatgtattatgtaaaatgtcaggaatataaattcaacttgttagaacttttattagattattgctggtgatggggtaatggaagtctaaatgtatgtattttaatccacacattctgttgggttttggttgcagtcaggtgacacacagtcttttgcacagaagctccagctccgggtgccctccgtggagtctttgtttcgaagtccgataaaggaatctctattccggtcttcttctaaagagtctttggtacgaacatcttccagagaatccctgaatcgacttgacctggacagttctactgccagttttgatccaccctctgatatggatagcgaggctgaagacttggtagggaattcagacagtctcaacaaagaacagttgattcagcggttgcgaagaatggaacgaagcttaagtagctacaggggaaaatattctgaggtaggagcatgacctttttgcctgtacaaaaatttcttccccttgttctctcattcatattactgtattgctttactcctgtgattggctaaactgttaattctctggatatatcctggttactaatggtatgtagtctgtggcattatctagttaaagactctcaatatctagttaagtaaagacagaggccctttggcaagactcagtaaaattttggagaagattgttgtctgtagccttctggttcttatattctgttcccctctcctttcgtagtccctctgttcaaggtcacttggacacccagtgtggagttcatcttctggctcatatcctctcctttattcctctctaactgatgcggctccaaaatgacctcatctgccagtgagagtcccattattactgattctaaaattgttttaggtagcctgattatttgacagatttggttcattctcattgtacctacatttaaacctttgccttggatgaatcttttcattgctaaacccttgagaatgacactccctgtttggtctaagggaggaaggaagtcaatgctagtccatttcacttttcaatcctttaggaatgtagcaccttcctttcaggctaaattttatttgttgccctccctcaattccctctgcatcctatgcagttaaaacagttctttctcaggaaagcttttttggagtaagttgtccatatttttttgtttgtttatcttaaaatgtgtaatgttttattgtcttatggtttgcaaatcaccattgtagttaattttaattaatgaatactaaagttcagagtcagtatattaaagatagttgtaacttctgtttccaattatgactacaatatgagtaattttatcctacaaccaaaaacaaaacaaaacaacccaaatgaaatatacaagataagatatctttttaaactgtgaagtgctgacaaaataggaagcaattatcaggcttaaatatataggctggctggaacccacccagagatataaacaaggcactaaagccatgtatgtcatgaggcacttgtagaatcaagcacctttttcctttaaatttttttaacttttatttttaaatttctaccaaagttaataatcgttatgaatctttgtctgttacttcactaacttaaccatggcttttaagtttgaagctggggtagtggtataagtagtatttacgtatgctagatactgtgtattttatatttaatttttgttgttgtttttgagacagggtctcactttgttgcccagactggagtgcagtggctcaaacatggctcattggagcttcaacttcctgggcccaagcgatccttcagcctcagccccagctccctcaagtagctgggactacaggcgcacaccaccacacccatctgatttttgtattttttcgtagagttgaggttttgctatgttgcccagcctggtcttgaactcctgaagtcaagtgatcctcccacctcagcctcccaaagggctgttcttataggcatgagccactacacctgtcctgtgtattttatatttataatgtcatgtaatattgtaccattcccgtagatgttaattagctcagttttgtagaagaaggattggagactcatagtaacttgcttatgttgcctggtaactaacttgcttatggttggacaggttgtagttgcagtgtctggatttgattttaggtctttctggttgtttctagtattctgtctcagagtcaggcagcttatcgggatcaaaagaactcatagactttgtctctacctctctctggcattgttagtacctaggatgaaataatgttgtaaatgacctctgattcttgggttactcttccacacacaacccccctccaccccttttttgagcacaatttttcttttatttttagttcagggatacatgttcaggatgtgcagggttgttacactggtaaatgtgaacaccatttttcttttttttgtgagacggagtctcactctgtagcccagggtggagttcagtggcgtgatctcggctcactgcaacctccgcctactgggtcctgggccaagcagttctcctgcctcactctacaggcatgcgccaccatgctcagctaatgtttgcgtttttagtagagacagggtttcaccatgttggccaggctggtcttgaactcttgaccttgtcatctgcccaccttggcctcccagagtgctgagattacaggcgtgagccaccacacccggctgtgaacaccatttttctatctggtgttatgataataataaggggagattcctggtcttaggcagaatttcgttttttatattctttgttgctagactcaccttccattgctgctttttttttttttttttgagataaggtcttactccctcacccaggctggagtgcagtggcatcatcacggctcaccttgtagccttgagttcccaggcttaggtgattctcccacctcaatctcctgagtagctgggaccacaggcacacaccaccacacctggctaattttttgtatttttggtagacatggcgttgccattttgcccaggctggtctccagctcctgggctcaagcaatcctcctgtcctggcctcccaaagtgctgggattacaggtgtgagccaccatgcctggctgtattgctgcctgtcttttgattcaggatatcactagtggcatttgggacacagcagccttctaaggtaaatggcaaagctcaaataggggatgcttcctcttaaacctgcagcttatctctttagcacttccaaagtagggtccaaagaattcactggagccatgtacttagccttcagatgagtaacttttttttttttttttttttaaattataatagagacaaggtctcactaaattgcccaggctggtctcgaactcttgggctcaagtgatccttctacctcggcctctcaaaatgttgggattacaggcatgagccactgcacctggtcctagatgagtaatgttatgtaacttccaggctgaaaagatttgttaatccataatttcattagggtgtgctagaatgtttaaatatcctgtttaggttaaatggttaaatatctctttaaggacttgaattaccagttttcatctgttgattatgaggttctttgctcagatttttgcagagctgtagtcacagaccctataaccagaaggaacttttagaaatcaattacatgatctcttatagtccaaagcagaaaaattgcctggtgagctcattaaaacatagtttcctgtctctccacacccttcccaagtctcaaattcagttagattggggtggggcccaagaatttctgtttcaagcaaacttgcaagtgatgctgttgctgatttagtctgtaactatagtttgagtagcctcctgcctttaggcaagttggcttgaatccccacctgtgaattaggtactgaaatttagaggtgtatctctaagatgaagtcatatggagatttaacgtctgtcaaatttacattttattttttagaaatgtatgtcctatgttagttttgaccgtcatgcatctaattaggttatcctattaaggactcttctaatttattttttgactttcataaagagaattttttagtggactttagaataattgcatttatttaggaatgactaatgttgttgatgactatattttagcttgttacagcttatcagatgcttcagagagagaagaaaaagctacaagtaagtgatttgtcaactgcattactgagtcataatttttaaatcagaaagatcttatatagtaagatatttctttcttttttttttttttttttttttttttgagacggagtctcgctctgtcgcccaggctggactgcggactgcagtggcgcaatctcggctcactgcaagctccgcctcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcctatagtaagatatttctaagccttccttttaaataattctgcatatgaacaaaatattaagcttgttttaccattattggaggttttgataaagagaaagtgaatgagatcccagagattttacctctgttaaggatgagcttccttgagttacagatctcggtagtgtttaagaagttaggatttacagcatgcctctctcaagcatgttttctagtgtctcagtctacaggttgcttccttgttttagtggtaaagacatatctaaccttctatgctttccttctgctttttaaatacctgcagacatctgtttcttatcattatatcagggtccaaatgcaagcatcctctcttctataataactatttcctgtggctgctgcttgtgaagcttttgattaagtatgtagggataagaaactattatattcagggtgacccaccttggccccactatgtcatcctgtttgcttgtgtttctatgcattggctatggaaatttcccactaggtattccaggtgataattcagagctaaggagaaatatccattccctttcaaatggtgccatcagtttgctgtgttttaaaataaaatatagttggccaggcgtggtggctcacgcctgtaatcccagcactttgggaggccaaggcgggtggatcacctgaggtcaggagttcgagatgagcctggccaacatgatgaaaccctgtctctactaaaaatacaaaaatcagccgggtgtggtgacgggcacctgtaatcccagctactcgggaggctgaggcaggagaattgcttgaacctgggaggcagaggttgcattaagccaagatcgtgccattgcactccagcctgggtgacagagcaagactccgtctcaaaaaagaaaagataaaattcaatgctttgctctcttttctacatgtgtacctgcctagaaaccttttaaaataggcaaatatcttttcaatagagccaatgaaattaaaatagtaggtattgccaacactcttacctatgctgcttatactagctaacatttattgagctcctactgtgtgccaggcattttggtatatttagttctagcctctttcctgtgaagaaactgagggagagtgactcgttcattgttgcacagcttgtaagaggtaaggaggagagccagggtctttttcctagcagttagactgcagagcatgtgcttataactactgcactacagtttttcatcattctcagcatggcatgttcctgcatttaaaattttatatttgaaactgaacaaacaaaacctgtgttcatggcttttttggggaaaagaactttggtttttgttttattcacttacaagtccccacaatacaatccagtcatactcccttggtcataggtaagccatttgcctgtctgtatccccttgttttgcttgttagtccacacaaaccagtgaagctccagattaccctattcctttacctctgtatttatgttgtacaggaatatgtggttactttgtttccataggtcataacttaccaagtttaatttcctttactagagaaaagtaccttccttaccccaccccaggaaagggtgagtcatttcatctcacaatattactcttttattagcttcttgatttttttttttttttttttgagaagtcttgctttgttgcctaagctagactgcagtggtgcgatcttggctcactgcaacctccacctcccgggttcaagcgattctcctgcctcagcctcctgagtagctgggactacaggcacgcatcaccatgcccggctaatttttgaatttttttttttttaagtagagatggggtttcactatgttgaacaggctggtctcaaactcctgacctggtgatccgcctgcctcggcctcccaaagtgctgggattacaggcgtgagccaccatgcccggccagcttcttgattttttttagtgtatggttactaatttagccatctgatgttctttgtgaatttttctggatggtttttttttttttgagatggagtcttgctctttcgcccaggctggagtgcagtggtgcgatctcggctcactgcaagctctgcctcctgggttcacgccattctcctgcctcagcctcctgagtagctgggactacaggcgcctgccaccacgcctggctgattttttttgtatttttagtagagaaggggtttcaccatattagccaggatggtctcgatctcctgacctcgtgatccacctgcctcggcctcccaaagtgctgggattacaggtgtgagccactgcgcccggctggttttgtttttttaaatatagacaattattttgtttctaagccacaaaaacctttagaacaggctgttaattgatgtgttccacacattataagtttcaatgaaataaactgcagttggaatttgatttaattttaaaacattttattttttaaattgaacagacagtaaaattgactttttgtttggtttacatgtccatgcattttaacaaatgtatagattttgaaccactgccactgccaggatgcagaacagttctataacatcatgatctaacttaacagatttttcaatatggtcacatctttaacattttaggcttgtcctctatcttcaggttatttttggataaacggttgtaatattttaaaaataattatttttgacttgctttgtatttactatgtcatacagttagctgtttaaccagcttttttttctctctcaattaaagggtatattaagtcagagtcaggataaatcacttcggagaatagcagaattaagagaggtaagtttcagtgatgagtactttgaaaatagtaattaaatctcatatttatcagaactgttgtatgtgctagggtagtttcatatgcatctcattagttatactaataactaaccagtccagcctacaagaccaggggtcagttcttgaagtttttatttgtatggtttttctaagatacattgttggaattaatgaaatgaggtgttagcaacagaatatcaattgtctgcatgaacagtcagcgtcaacttccaagggttaactgggttcttctgttatgtatttcaggcttctttttgtttttcctaaccctaagtcttttttataaaataaattatgtttactgtaattttgaggggggtgggtaatttttcatagcacttagactgtttgaattcctttatgtcttcctgagggccatgtgtacccacttgccatcggagtaggcaagaccactcctggtttgacctgctgtctcaaattattttgtaatgagtacctgttgacttttggggttctcctgctgtcaggtccatctgataccttgtcgcttccctctgctttctcctatacagatcccaacaattgcatattttactgctattggtgttttctctccactcatttgtattgtttgttgaagaatatcttgttacctatttttgttatgagtgttcttcatgggtttttgttactttctgttaatttattaacaaaactagtgttattttgagaagtttgaaataggtagctttaggacaaatcaaagtaagtttaatgttttaggtattctaactgtgtaatttatcagtccaagatacagatttaaaaagtatagatagccttaaaagggtcaggtaaattaataaatctataaatagtaattgagaaaaactagtataattgtgggaggaggcaaagaagaaaaacaagggagtatagattaggatgatatcatcaatatagccgtattgtcccatagaatattctttgttgttattgtcaatgacagactattgcgtgaattaacaatcagaattaatcatataggaatttcctgtattatattactaaagttttattcttattgctatcatgtttgatttctagtctctcgcaatttttttatatagccaaattactgaatttttgtggtatgaaagaaagattatatcatttaccacaattcccaaataaattctttaaaacatttctaaacatgactttgaaaaccaggctaatttacttttgttatactgacaagaccaagcattggcctcaataatacaaataattacagatgtcctttattaatgaaaatttgtacaacttcttttggattaataacgtagaaaaatgtatacccactttggaagttatagagaaggaacaaaaccttaactcctggtctgcccaagattctgctttcctagttggactgggaatgtgttagtactcagaaaagtatgcatggggattaggcgtatgcaacaaaggggttgtaggaagtgagagaatgatagctagggtatcctcttttgtttctcctgccttatattaatagaaagaaagtgcttttagcagctaaaagcacctttgcttttgctagaggggcaaataatacggcatttctacccaaaagatttttctgttaagctaatatctttttgcttaacatttcttttttacttgtcttgtgttttgggaataaatgaagggtgttgataggtatcttgtatttctggtgagaaattaaatgcccatgttttatacagttaatgattagatatacatagtaatggagagcaggcatgtttaaaattcagagagtgcacattagaggttaggcatcaggttttaatgcctaaaacctgatgaatcctctttaaaacattcgcattatttaaatatgcattgaataaagacacaggaatacctctttataatgttattatatctggaaacacaggaatacctgtttttttttccttcctatgctcagcccttctccactaagagcccttgtctgagggagttatactcaagaaaatacagctgaatgggaaacacatctactttactcatagatgagtaagcacccatgtgattgccggctgttagtaaagataggcctcctatctatctattctctaatttaaattatagaaccagcattccctggcaatatcaaatggggaaagaaaaagaattgacttagctagcaggccccagccttactcatctactcagttgcagctgttgagggacttagaaaactgtgagagagctcactggctgaaaagcatgccttgtcatgcttgtctgtggtaaaatgcatttgtgttgacctttcaaagagggtggagctctgtgaaaactctggatgctgccaattagatttgcaactctacctaaattttttaggagctggtgaaatgttgggggcaaagaccagaggtaagggaatatggaactaaagggcctaatttaactttcctgcctaaatccataattttatgcattaactttatcttcctctattaggaaatattaatacttatcagagtcacagattgatgaatttgttggtttttttttttaatccacctacatgtattagttttctcttgctgctgcaacaaattaccaccaacttaatggcttaacacaacacgaataattatcttagaagtttgacacaagcctcactgggctaacatgctggcagaatagtgtataggtagccgggagagggagaagggtacatgattaaaagatgctcccttgtaaccaaggactttttgtctagatgaggaaatgaaaacttgcaaaatctgaaaactatagtataaatcgaggagtgttttttggtttgttttttttgttttggtgggctgttaggactgctatgtaacagagtccagcatggaaggttgtaggttgtaggaaattatttggaagaaatgaagtttaccttccagttccttccagaagtgggggagaagggagttgtcatagggccactaactgttgtatttcggaataaagacatcaggaataagtacccagattcttttattgccattatttcattaaagtagttgtggccgggcacagtggctcatgcctacgcctgtaatcccagcactttgggaggctgaggcaggcagatcacgaggtcaagagatcgagaccatcctggccaacatggtgaaaccccgtctctagtaaaaatacaaaaattagctgggtgtggtggcacgcacctgtagtcccagctactcggtaggctgaggcaggagaatcacttgaacccgggaggtggagtttggcagtgagcctagatcgcaccactgcacttcagcctggtgacagcgagactccgtctcaaaaaaaaaaaaggttttagtaccaaaacaattaggaaggacatattcccaggataaagtaacagctacttatatgaaaggaatttagatctaagaaaatctctccacattggcttttgtttcttatttcacgatggatctctgaaaacattatttagggcatgaccagcatttggagaccactgctgtgggaatgtaaagtcaggagacatttgtgagaggaaaagtaaaaaatatgctcagagatgttggggcaatgtgggtgttgggcagaatagaggacacttatgagtgtaccagatagtgcctcagtgttttgctcgggcaattcttagtgttttgagaattaataagtttgaaacaatgtaagaagagggagttgcttataattctttgaaaatattgtttgaggaaaattattctagcaaatgtgtgagggatggataaaattagaggaggacttgaggtaagaaatctgtctagaaggctattgaaggaaattaactgtcacaagcttgtctaacctgcagcccgtggcctgcatgcagcccaggacggctttgaatgtggcccagcacaaatttttaaacttccttaaaacattgtgagatttttcttgtgatttttttttttaaatgctcatcagctattgttaatgtattttatatgtggcccaagacaattctttttcttccagtgtggactagggaagctaaaagattggacatccctgatctaaagtttgagagacctgggctgtggttatagttgtggtaaaagataggatctaaacattctagaaaaagtaataaaaaatattgattatatgcagggattaacaaagataagtaaaatgtgactttgaatattttgagtttagggaactagtgaagtataggaatcccagaacgataaagagctgtctaatacttccatgtgctaacctccggcattctaagggagaaacacagaagacacaagattgaacccaagagggctagaaggaatcagtgaaggacaaagaggaaactgtaattgacaggagtgtagccaggagccctaaagccatggtcagcaggtatagctgagaaaagcttccataggtcattttgtcattgtgcaaataccagagtgttctttcagaaacctagatgctataacctgctatatacctaggcaatattgtattgtttattgttcctacactacaagcctgtacagcatgttactgtactgaactctgtagacagttgtaacacaatggtaagtatttgcatatccaagtctatctaaacatagaaaaagccctgtaaaaatacgttattataatcttatgaaaccaccgtcatatgtgtggtccgtcatcttccagaacattgttatgtgatatgtgactatacctaaaatgaacgggtaattactggtggctggttttgcagagagacaaaaatcaatggatttggttaggaaggctcattaatgacctaaagaaagcagcattttaactaattgcaggaactagaaatttcattttacagatgagaaagcgtttggtttcgactatcagacactttcatatgttgggaggaggaagactactggctatctgtttggtatataataatttggtgttagatcagatgaatataatataacacaagtagtaagagtctcaaagtttttcttttatcttaagtaatttttttttttttttttttgggagaccaagcctcactctattacccaggctggagtgcagtggcaagcctcaactcactgcaacctcttcctcccgggttcaagtgattcccctgcctcagcttcccaagtagctgggaccacagatgcctgccaccacgcctggctcatttttgtatatttagtagagacggggtttcaccatttgttggccaggctggtctcgaactcctgacctcaagtgatccaccctcctcggcctcccacagtgtgggattacaggtgtgagccaccgcacccggcctgtcttaagtgattatttattttctccacattattatcagtgcagccatcattacagctctggaaagtacacttttttcttcttggatcttcatattctttaaggaacaaaatcatttgttgatgcaaatgttttaaataatgttaatgttttacatactaattattctctaattattgttgctgataccttaaggggaatgcaaatctgtattcaacatgtttttaaattttgaaaactttgtattttttgttttatactgaaaattacctgtaaatcattttatgttttaggagctccaaatggaccagcaggcaaagaaacatctgcaagaggagtttgatgcatctttagaggagaaagatcagtatatcagtgttctccaaactcaggtaaaagagtaaaagaaaaagtgtggaattttttggataaagaaaaatagagggggtttgatttggatatctgcaaggttgcaaaagttttttcttttttaagacctatttttaaaactttttgctttcctcaattttttttatttttaattttttttgagacagagtcttgctctttcaccctggctatagtgcagtggcgtgatcatagcttaactgcaatctcaaattcctgggctctagcaatcctccagcctctgcctccagagtggctgggaatacaggcatatgccaccacgcccagctaatttttaaattttttgtagagatggggtctcactatgtcgcccaggctggtctcaaacccctgggctcaagcgatccttccgccttggcctcccaaagtgttgggattataggcatgagccaccactcctagctcttcagttaatgttaaggatacttttttatttattgtatcttttgactaactgcataataataatagcaaatataaaaaccagctgtattgggagtaaactttttattttgattattttcccccactttagtaagaagaatatcatttaatccgtcctctctctgttttaaataaagtacaataagccatccacattgatgtgtttttgtatgtgtggattcaaccaactggatcagaaatatttagggggtgaaaaccatgtgtagtgaacatgtagactttttttcttctcattattttctaaaatatatgtagtacaacaactacttgcatagcattttcattatttaggtagtttatgtaatctagggatgatttaaattatactggaggatgtgtgtaggctatatgcaaatactacaccattttatataatggacttgagctcctgcggattttggtattaacagggaatcctggaaccaatcccccacagataccaagggacaattgtactactcccatagttttttttgacttttttctaatgaagcacatttatattaggtttctctactgaaacaacgattacgaaatggcccgatgaatgttgatgtactgaaaccacttcctcagctggaaccacaggctgaagtcttcactaaagaagagaatccagaaagtgatggagagccagtaggtaagcttcattttgtcaaaaggttaatttaaaaactagaggagagccaggctccttggcttacacctttaatcccaacactttgggaggccagtgtgggaggatcgcttgagttcaggagtttgagaccagcctgggcaacatagagaaaacccttctccacaagaaaaacaaaaacaaaaatgaaaccccaagaaaacctagaggaggattttgagagattccaggatgtgagctgatagatatgggctgaggtagaagtgtccgtggtcctaatagtttcagaaagatgcaagggtttgttttgtttttttggttctttgttgttatttaggagaaaataagtgttttttgtttgcttgttagtttgagatggtgtctcactctattgcctaggctggagtgcagtagcatgatctcggctcactgcaacctccatctcctgggttcaagcgattctcctgcctcagcctcccgagtagctgggattacaggcacacaccaccatgcccggctaatttttgtattttcagtagagacgggctttcactatgttggccaggctggtctcgaactcctaatctcaagtaatctacctgcctcagcctcccaaagtattgggattacaggtgtgagtcactgtgcccaaccaaaaaagttgttttaatatgcaaaaatttcatagtctgtaacaccacattttcattgtaattgaaattcatttattatgctacactgttttattaatagcagtagctagatttcatatgaacaggtcagttctgcttacatgctaataagtgggctatttgtaattgtttggatattttagtttttaaatattgcttaaatagttctatattcatagatatttgtatttgtcctattaattgctttttaactggaaaaagaagaaatagctatattttgtcttaaaattcagttacagccttctttgctttgaggcttgaggtatatacgcaataaaattcccgtcttttatttcctagctttttctttcaaagggacttatgataaacttggagtaagtagttgagcagttaactatctgagcaaccagactatggtggggtggtggggcggcggggccagtcccgaaattcccagacatgtggaaacttcagactcataaatgtaaagagatggagaaagttgcacttaccagaactcctctcagaaagagattagaatgtggttggaaagaataccgtactttattaatccttttgggaggtgagctaagacacataattttgaataacaaaagatgattatcaaactgtcattttaaggagggtggattcagttaatgttagttaactactgtgccattctgaatggggttgaacctcaaagaggtgaattactactaagcttcttcagataaagattaaacaactaatactaagtagaggtttggaagggtgccagtttattagctgactagggttgtcccttcttcatctaagagtatagcagaatattggtgtaagaatacactcctggtggggcgtggtggctctcacctgtaatcccaacactttgggaggctgaagcaggcggattgcctgaggtcaggagttcgagactagtctggccaacatggtgaaaccccacctctactaaaaatacaaacaagttagcgagacgtggtggtgtgcgcctgtaatcccagctacttgggaggttgaggcaggggaattgcttgaaccagggaggtggaggttgcagtgagccgagatcatgccactgcactccagtctgggcggcaaagcgaggctccgtctcaaaaaaaaaaagagggaatacacacctgtgtagtaacagactgttcctggaagtgtccttatatttgtaaccgcccaaagggttcaccttgcccactgcctagacagagctgatttatcaagataggggaattgcagtagagaaagagtaattcacgcagagccgagtgtgcacgtgaccagagttttattttactcaaatcagtctcgccaagcattcacggatccgagtttttaagaacaatttagtgggtgggaggaagccagtgagccaggagtgctgattggtcaggtcagagatgatatcatagggaatcaaagctgtcttcttgtgctgagtcacttcctgggtgggagccacaagatcagatgagccaatttatcgatctgggtgttgccagctgatccatcaagtgcagggtctgcaaaatatctcaagcagtgatattaggagcagtttagtggtggtcagaatcttgtagccttcagctgcatgactcctaaatgataatttctaatcttttggctaatttgttagtcctacaaaggcaatctagtctccaggcaagaagggggtttgtttgggaaatggcttttattgtctttgttttagactataaactataaactaagttctcccaaagttagttcagcctacacccaggaacgaacaatgacagcttaaaggttagaaccaagatggagtcggttagattagatctctttgactgtctcagtcataattttccaaaggcagtttcatattccttactgatgggcccttcttatgttgctttattgttagtggaagatggaacttctgtaaaaacactggaaacactccagcaaagagtgaagcgtcaagagaacctacttaagcgttgtaaggaaacaattcagtcacataaggaacaatgtacactattaactagtgaaaaagaagctctgcaagaacaactggatgaaagacttcaagaactagaaaagataaaggtaaaagagcagatgagttttgttctaatttaatctataaagttagatccacaggctccacagcatggcttgtacctccgggagaggagagtggatggaaagggcatttttgtttgccctggcctacataacaccaaaccttgagacttactgtgtacttttttccttctgcactgtaacatgtatataaattagataaatgtttagagttctcaaatgagaagaagctttattagagatggaaatgaatttaaaaattttttttaggaccttcatatggccgagaagactaaacttatcactcagttgcgtgatgcaaagaacttaattgaacagcttgaacaagataaggtaaaacaacaaaacctatgatactaaaatttgtcaagaggccccaacatttacttttggaaacagttggaaacattcatgcttgtttctgttttctaaaaattattgcagctttttccatgaaaaatctttaatttctagatttttgtaactactagcattagttttgtgtcatgtaaaactgattctctgatttcttgatcccagtcagcattatgatttgtagactagaataactgttgcaaaggaagtttatatttatagtacataactactttacagagaaaagttatttatagttaaggcattataaatgtgaatgatatcagtatgttctttcagataatatggaaacagattaatctctcagataagttgcctaacaaataaataaggggctgggcacagtggctcatgcctttaatctcagcactttgggaggctgaggcgggaggattgcttgaagccagaagttcaagatcaacctgggcagtaaagcaagacctcctctctacaaaaaaaaaaaaaaattagctgggtatgttggtatatgcctgtggtcccagctactcgggaggctgaggcaggaggattgcttgagcccaggagttagaggctacagtgagctatggtcacactagtgtactgcagcctgggtgacagggtgagaccctgtctcttaaaaaaacaacaaacaaaaataagtgataatgtatatattagcataaataaaaatgtctacaaatgaattttagaatgtgtagatgagattagaggattgaggaaggaatgagtcttacctttggtagtttggagttggagcagcagctaaagctacgcagcaaagacaaccagaaaattcatgggtaaacagttttgacctgtctttcagctccaagttcttgggtcctttttctaagcagctcccagtttgttccatagcatccaccattttctttaatatgccgggttatcactagagtattttaagtggtcacgtaattaagaacatgtcagagctgtcctgctgttaaaatgtattggcaatctttttcatccttttgataatactgctttgctagattatacacttcttgagggcctacttaaattgtttttttttttaaatattataatgaagaacttaaaacatttacaaaagaaaagctgctaaaatgaatttctttgaacccaccaccccgcttcaacagttaacatctcatgactaatcttgtttcatctgtaccttctcaactgtcattgtcctactcacccagaattgttttagagcaaatccaagaaattttatcatttttttccaaaagtattttaatatatctttaaaataaaagacattatttttacaatactataaccacattatcatgatcacatctaaaaatttaataattttaaaatatgacctgctatctagtcagtttcagattttctctagtttctcatatattttttgctcttttatgaatcagggtccaaataaagttttttcattgcaattggttgatatgactcttaagatttcttttaatttactggtttgattatcttctctccttctctttccactatattttggtttttgaagaaactgaaagcccatgattttgttttgagatttcatatagcagtgcctcacttacgtggttgttatctctctgtctctccattaatattagccatctggaagagtcatattctaaagcaagggttggcaaaccctgtggagagggtgctaatcttaagaccatgaaattgttgtcacaaagtctgaacattttttcaagagacaagtgaaccacctcattttttgttagtcctaaatgacttttttactgtataccatttagttgtctttttcccctgccgacctccatttctagtgtagattatccagaaagagggaacagaagtaactagcaagttggaggaatggagatgccttacaaagtaaggaatagtggtggtaccagagacagtcacaggaagaaagagaagaaccaggtagatgtgtcctgggattttgctttatccagtgtggcagcaggcaccttccattctcaagtgtctggggttatccccatgttatagtacagatcaatacttgtagtttattgtagtgccaagccaggttcagaagactatattttgttcattataaactgtttactaagacagatagcacatttgtagaaaggctataaaataaatcttttaagtaataatgttttaatgctttaaggattaaactattaaaatttttaatgtaaaaaatactgttatgctaggtaataggattagagcagaaaacagacctcagtttgtgaagtattgaaataattgttatgctgtacttagcaagaaatatcattttttctgccttttattttttgttttttaatttttaatttttttttgagacggagtctcactctgtcacccaggctggagtgcaatggcgtgatctcagctcacttcaacctctgccccctgggttcaagcaattctcctgcctcagcctcctgagtagctgggattacaggcatataccaccatgcctggctaatttttgtatttttagtagagacagggtttcgccatgttggccaggctggtctcgaactcctgatctcaggtgatccaccctccttggcctcccaaagtgctgggattatggacatgagtcaccatgcaccatgcccggcctttttctgccttttaaattaagttttatctgtgctgttgatgatgcagttttgttatgcaaatgttttagagtcttcacttctattcagggaatggtaatcgcagagacaaaacgtcagatgcatgaaaccctggaaatgaaagaagaagaaattgctcaactccgtagtcgcatcaaacagatgactacccagggagaggaattacgggaacagaaagaaaagtccgaaagagctggtaagaacttgagggttacttgttttatgttggaactcaaaagttatttaaagtgcttgaccagtatttttaaaaatgagttaaatattgataaaaattcttaactatagaggctcctaataagacacccatctgctcattagaggaggcagaggttggcaaactgtggcctgtgggccagatccagcccacagcctatttatgtacagcccttaggctaaggatgatttttacatttttaaatacttgaacaaaagaaaaatatatgacagagaccatatgtggtctacaaaacctaaaatatttatcatctggccccttacagaaaatgtgtgctgacagagtatcaaaattcagatttaaaattgtagaacttcccagtaggtacagcatggtacttattaaataattgctaccttatagatgctttagggtaaacaaaaagtctaagttatagtctgcttttaaagagaataatgaacacttcagtgttaatagcatgttttgacacaataaatgctgggctataaagtatagaaaccagcatagtattcaacaaggtacaaaatcgactaaagctaggaaaggagggatgtttgaaagaggagagagcaggatgaactgtgccttcacatcagtgaagatgtgagttttgaattggacctcaaataatcaatagaatgggcctaacaagagaggtgtgggcagcacacatttcagatgctacaatgccgtaaacaggcacagtgatcatagtgggtgtgtgaatcagctgaaaaccattcttgctgaagtgggaaatgcagttggattgtaaaggaactgactattgaaatcttaaaaggtaggtagctgagtttagactttgatatacagagtaacaggaaaccagtaataggaaggcataatgtgatgggagctagggttttatgtagaaaagaaatgaaataggaagtcaaacttagaagcaaagacagaaatccagtttgagggactgtgagctttagccgccttgctaggatggtggttctgggaaggagaagaaaggtagaatctgtagaatttggtatctgatcaactcagggaggcagaagaaaagtaaggactctaaattgactccaaagttttaagcttaggacacttaatgaatagtagtgtggaattagaataggaaatctaaatggggaagttgagaattggagtgaaatgatgggttttttagatacactgaatttgacccagtcatgagcttttcaaatggaattgagttgcaggaatttggaaataagaaattggaacatctttcaggagtcatcagcctaggatcgaagcctgtggttaaatctgtaggagaggcggatttctacaaaagattaagttttacagtagtagtaatagtcatagtggtaacagcagcagctgcttctgctgacgcttatttagcacttgttgctgctactactactgctgctactattgttaatactactgctagccattacttactttagtaatgctctgctctaagggctttgcttgtatttacttgtattgcatcctcacaagtgtatgaaataatactattatcttcattttacaaataagcaaacctaagaacatagaagttaagtaatttacctacatttatgcacagagaataagtatatactcaagatttaatccaggcattgtgactcagagtctgtgctcttaaccatatagaggtcttgagtttggcaatgagacataaatgagaaaaaaaaagttacctcatgaagtcataggaattgtggatagttttttgggggaatataagatatgtttcaagaaatggagaaggtaagatgaagactttgaaaaggtccttgaatttggcaaggatttgatttggaggatgcagttttgagaaatgattttataaaccagattttaaggtgttaaggaggggactgggtctctagacagagaaatagttgactatttcataagtatctccccatcttcttggacttattttatggataaagtgactggggaatttagttaatgaatttgttctcatcaaacctaagaaaacttccctttagagagagtagatggcatctttcagaatataatctttgaagactgacttgaagcagtttgagtgttgtaagacattggttcaacaggtttgctttcagtgaacagaaaatctaatgcatagcctcagcttctcatatcaagcctttccatttttagaactgctttctgttgactgttgtagccagtagagagaaaatgttggtcaggggattacatttcttttaaaattcagtgtacttaatgaggagatagaaactgattaataaatatcaagttgaaaagggtaaatgatgaaaaggtagacaaaatatatagttcatttacatgcggataaaattttctggtatatgttccagttaaacctttagtagaacagctttccttcccttgcttgcttctccaaaacacaggtatattttgtctttcagtgtgattttcataaaccatatttttttaatatttgatagcgtaaaggtttaaaattttttctattaatactgtcaaaaataaaaaataaatactaaaagaattaagatttaaattattattactttttttgggcacaatctcggctcactgcaacctccgcctcctgggtccaagtgattctcgtgcctcaggctcctgagtagctgggtttacagatgtgtgccaccacacttggctaatttttgtatttttaatagagaccgggtttcactgtgttggccaggctggtctcgaactcccaacctcaggtaatccaccctccttggcctttcaaagtgctgggatgacaggtgtgagccactgcgccctgccagatttaaattattaatggatacatttattttggaaagtctttagataacaaagttgtaagtgcttttatagatttcttaaaaattatatttgtagtcataataattgagggctatgatgcaaagttgtaacaaactgtctctacattgaagataatgccttttacatctataatgaaagctagttttgcacacaaactgtatttcatttaatagtcttagttgagtctaaacagaactgttcaagtaggaagtgattcttagttcaaatgtaaaggtatatgccaattgaaagaaaacttccaattaagtactaaacataagaaaaggtcaatgtaaaggaagtaggatttctataaatagtctggctattggaaaattcaattgctctattaaatatttgttttattctttgttagatttaaaattcaaaggctaaatataagaactggccatgtgaaggaaacattaatatcattacagcttgctattaggattttagaagtagatatgtctacataaaactcttatctagaaaataaactctccaaatgcattttcaactgtgaagaaatttaattctgatattgctggtaattcttgatgtgaatattagtagacaaatcactaattcctttggctcacttattctggatgtcaaaatcagctcaagaacgttccccactacttttcttgggaaacagtctcttaagctgctcctcatatttttttctagatgaattgtggtgcctttcatatgttggaggacagaggaaatctgaatgtctttgattttaaacagaatgattgtttattttctttgttttatttttctgtttttgcatgctggcataaaaagaataattctgttataaaatactgagactgtgaatacagtggtgtaccgatttcaggatggtgtatcaacctgcagttcttaaatagtctcctctctagtagaaatgttaggcatagtttttgacgtatgagagcatagcattcttgttttgttaaaaatatgtattttagtggataaagaaaacaaaaaataagtttattggttataagcgcttctgtaattgttgatagtgtttctttctagttgttacttaagaacagatggtcatatcttctattaaccagattttaaacttggaaaagtttggtggttcagcttaagtacataatgctgtattttaactctccaggaaattatatcctcagtgtagcaccagtgtagaatgttaatgctaccgaagttcacactagttcttggctgttctctgtgtgtgtgtgtgtgtgtgtgtgtgtgtgtgtgtgtgtgtgtatcaggataggagataggggtagctaattattaatgcagtgtattaccaaaaaattggaaaatagagaaaatcacatcactgttgttttagtaaatttccatttagtgttttctctaattttttttaattattgtaataatacggcacattcaattttgtatgttcttctcccccatttagcattatgttattgacacttttacgtgttgctaaagttaatatattttaatggctgtgtcaaagtgcatgtacatcatttacttggttatcatttccttattgtttatcatctagattattatatatttttgttatactattgtgacaattttgagatatagcttattagatctttgaattttatcttaggataaattcttaaccatagacttttagtcttttttgttagctacttttaagtgatttaaatatatatagccattaaaaaagtaacccatgccacaatgttaatcctccctcccattaaaatgttttttcctacaattatgcaacatgaataaagtattttgcttagattagggaagtttctagagtatagtaacttttgtaaaccccgtttccctttcatgtaccttgtctttgctgaagttacttgttttatatgattggtggcatttaaaaacttggactaactcataacattctttgcttttttattgtcatgttgtgtttgtgcaggaaatatgttttttattcatttgtatagtataggtctgatacaccaaaagaaattcattagaacatatttatttgatgtttgaaggactctttaaaatagtttatctgtttaaataatgtgtaagatttatgcatttttatataacaaaccaaaatcacatgtgtatttaactgctttgttagttgctgataatttatgtaacaaaattttcttggagtcttaagtctcacaaaacatcttatttttgtgcatccacacatgccaataagtgaatcatggtgcctttcccaagccttgtatgaacaggactggggtaagggctattttttttcttatcatgggtacttagaataagctttacaaagaaaattccatgtttctcaggcaaaaaaaaaaaagtatgaatgaaagtagattttaagtatgccatgttagataaataatacgtacgtattttggcactaaatgaataactgctggaaaaatttattttaagtggcttttaaaatgcaattatttatgtctccaacaatgtcactattacttgaaaccatcagtaatttaaaaacacgtttctttggtgcgggattatatttctaatttaatcaatgtacttagctttagcttaatatttttcaacattagcctgatgttttcaaggtatttgatagataaatatgtatgtaaagtgtacatgaaaatttggggctgggcgcggtggctcacgcccgaaatcccagcactttgggagactgaggcgggtggattacctgaggtcaggagttcaagaccagcctggccaacatggtaaaccccatctctactaaaaatataaaaattagccgggcatggtggcgtgtgcctgtaatcccagctactctggaggctgaggcaggagaatcacttgaacctgggaggcagaggttgcagtgagccgagatcctgccattgcactccagcctgggcgacaagaacgaaactctgtctcaaaaaaaaaaaacgaacaaaaagaaaaagaaaattcggataaattggtaaattttttgaaagtcaaagcatagtcagtttatagaatgaatcttgttatatattttgtagtatggcttaaaatgtagttttccattgcaaaagtgatatttattaaatctctgtgaaggccctaatttatagataagcattgcactatctaatttatgccaccgggtggtagtattttattttcatttatgtaagctctagactagtagctttcagactttttgatctcagggacctcttaacactcttaaaacttattggtgattccaaagagctttatttatgtgggttatatgtattgatatttactgtattaataattaaaagtaaatatatatatatatttttttgagacagagtctcactctgtcgcccaggctggagtgcagtggtgtgatctcggctcactgcaacgtccgcctcctgggttcaagcaattctcctgcctcagcctgccaagtagctgggactacaggcgtgtgccactacgcccagctaattttttgtatttttagtagagacggagtttcaccgtgttagccaggatggtctcaaactctgacctcgtgatctgcccgcctcggcctcccaaagggctgggatttcaggcgtgagccactgcgcctggctaaaagtaaaaattttaacaatatttgtttaattcatttttaaaataacaattataggccgggtgtggtggctcatgcctgtaatcccagtactttgggaggccgaggtgggtggatcacttgagagccaggggtttgagaatagcctggccaacatggtgaaaccctgtctctactaaaaatacaaaaattagctggatatggtggcgcgtgcttgtagtcccagctactcgggaagttgaggcaggagaatcgcttgaacctgggaggtggaggttgcagtgagccaagatcacgccactgcactccagcctgggcgacagagcgagactctgtttcaaaaataaaaataacaattataggccgggcgtgatggctcatgcctgtaatgccagcactttgggaggccgaggcgggcggattacctgaggtcaggagtttgagaccagcctggccaacatggtgaaccccgtctctactaaaaatacaaaaattagctgggcatggtggcacacgcctgtaatcccagctattctggaggctgaggcaggagaattgcttgagcctgggaggcggaggttgcagtgagccaagattgtgccattgcactccagcctggctgacagagcgagactcttgtctcaaaacaaacaaacaacaacaacaaaaaacaaacaaaaaaaaccagttataaatccattacatgttagcataaatactttttcattctacctatattttccaaaataaggtttagtgtgaagaatggccttgttttacatttttgttatctcattgcttggcttaataaaatgcagctggattttcatgcctgtttctgcatttaatccgttgtgatgtattattttggttgaaatatgggaagaaaatctactcttacatagacacgtatttggaaaagggagaatctcacagatcctctgaaagggtctcaagaccccaggatctttggaccacatattgagaactgctgctgtagactttgattttatttgccaaagaggcttgatgattcagtgggaattctgataaaattctttttgttgctttttctgttaatttgcatttcattcattttgtagtgcatttcattcactcattttgtttgtttgtttttgctgggataaagacaggcattggcttacttactcattcttcatgtcattaaccagcttgttaggatcatcagttaatctagaggttaacagccttttcacacttctgcatttttgtttatttcctacactgggagtagaagtgggtcttgttaaccatatagtgaagtgttctctggggcagtgtaacaaaatagtaatgctgcatgaaacctcagaattctggcatttcttattataattgattaggatactcaggatgaggagtatcctaagaagtgctggagtagcaaaaacaatgccacattcttcctagctgtatctaaggattagttattttattcccttttcttactacttcagctatctttttgtgaaatattttctttgtcacttaatacctagcatatgcttggcagttggtaaacagctgctaagtatgtatttgatgactgaatggttggattattgagctacagattgtcaacctttctcatttaacccttatagagagcatttgtccatttttataattcccatggatgtgagtgaacctcatctgaactggaaagtgaggagctagcaataaagggtctgccctgcattttacttaactgacagaggatcatacttacagttcattaaagattgacctaaaagtatttttaaagtgtgtgtgtgtgtgtgtttttttttttaaataaaaattgcctgagatacattgaattttgctttggaagaacacagtgtgttcttgcaacattctgcggcagttcgtgcttagccttcctattgatgtgtgccgtgactgtggttttcccatgcactcttgcatgttggcagaagacttgtcagctgtgactgatgcacgctttatttctccccactcacttatcttttgttgggaatttgaaagataaattgtctagacattttgaacatacttttttagtacttacattaaaatcctagtttcactttggaaagggtagggaattcacttttagaatattagtaggctgtgggcaccatttctaggggttacaaggtcaggtgagatgtttctgggtagtaagtaaactctcagtatatcctctttaaacatagtgatgagactcagtgttggaggcagatttcctgtgaggaagtggcttcatttgtgatacagtgtagaatccataatgggtttgaaatacgttttctgtgtttggatattataaatatataaaatataaatgcctttccccaccactgtttttggccagttaacatttccttaaagcacgatggggaggcagaaagcagtgagttttgtgtcagaaagaagtataacatactgcattttgttgagagttaaaagccattagtaattgattggctcagaaattctgctttagtaagaaacattattgcccaatggagctcgatccatttcagcattcttagtttttaaaaatatggcaaggtatggatcgttgcttaaagccaattttaaagttctatcatcaggcttatatattcaagttgatttaacatctgaaggaaaatttggatgcttcagttaccatatgtcaatgaaagatttcaatggtttctttctaggtgtgaaattatttggttccctgacatggtactggaaagtgggagagagggttaaatttagatgaaaagaactgtgaaaccaaatccatcctactttcattgttgtatgatggataataaattgacttggacaaacttttagtggattaaacactaaaattcgactgtatatagaagaatatcctgaaatttactgactagattagaaaacttaattagcagaaaattatatctaaacaggaacttgtggcatggattttttgttgtttgaaaaggtgagaacattacatttatttttttatactgtgctggattctggaatttaaaaaatgaaaacagaaaattcactagtattgactacatagttttgttttattttacttaattgacaaaaggttttcatttaaactcttattttgctgaaagggtatcaaaactgtcttcagtttctccagagcctgattgaagatatttctgtgaattactcagaaatgctgagatgcaattttatatgctggataataatgaaaaggggctgatgacacctaagcattaaaagacattgtcataaccttttttcattcctccagcgtttaaaccttcaacacaaactaattaggcagtaagcactttgtttcagaatctttcccataattagtcactttacttgactgatttttttaagtgagggaactaatttcttgttagtagtaagcgttcattatttccgtattttctgtatgcttaacgttagaatttatagtaaaagaatatgtaaaacaaagataccatttttgtttccaacatatttgtatctaaggattatcatcttggggtttgcaggcaaatgccagtaaagttagaataggaatcttttttttttttttttgagagacagggtctcacttgtcacctaggctggagtgcagtggcacaatcactgctcactgaagccttgacctcccagacttaagtgatcctcccacctcagctgctcagagtagctcagactacaggtacaagccacggctcctggctaatttttaatttttttgtagagatgggatttcactgtgttgcctaggctggtcttgaactcctaggctcaggcaatcctcccaccttggcctcccgaagtgctagaattataggcatgagccccccactgcatctggcaataggaatctttataaatgatttcagctaattaatattcctttgaaatttagaccttatttgagtatcagttttatactttggacatataaaataaattggatagatttgcttttcatataaaagataatcactttgggaggccagcgcgacggatcacgaggtcaggagtttgagaccagcttggccaatatggtgaaaccctgtctctactaaaaatacagaaattagcccggtctggtggcgggcacctgtagtcccagctactctggaggccgaggcaggataatcgcttgaacctgggaggcggaggttgcagggaggggagatcgcgccactgcactctagcttgggtgacagaatgagactccatctcaaaagaaaaaaaaagatatatggttgccagataaattattttttaaactattgagcaaactaagttgcatttctctgttgttaccagaattcacccttctcttggcaatttgcctttaataaaatgctttagaatagatgtttgtcttcaagtttgcaattcctgtgcccaaaccactgtgttaaaccaaattgttaatgaaagacctttttttctgagctgccataggttgaagttcccacatttcttataccactggaagtgaaaatattatatatgtcggtgaacaactgtctccctgggacatacgtttcttggtaggattacacacccatcttgaaaactgagttttgtttatagtctatctcaatggtagagggaaggctggagacttctgtgaggactaaaggaaacaatctaggatgacagtagcagtaggattttcctagggtatcattatgcaaataatgcatgtgtgtgtgtgcatgcatacatacatatacaacccacatatatgtacacatatacacaggcatatacagatcctccttgacttatgatggggttagaatttgataaattcattgtaagttgaaaataccaatatcaacttgtgaagggcttatccagacataactttattattaagtggaggagtgtactgaatgagtattgcttttgcaccattgtgaagttgacaaatctaagaccatcataagtcagggaccatctgtatacacaaatacacgtaaacacacatgtattttttttttttttttgagacaaaagtcttgctctgtcggccaggctggagtgcagtggcaccatcttaagaagcttgctgcagcctctgtctcccagactcaagtgattctactgcctcagacttccaagtagctgggattacaggcatgtgctaccacaccaggctaatttttagtagagatggggtttcaccatgttggccaggctggtcttgaactcctgacctcaggtaattcacctacctcagcctccaaaagtgctgggattacaggtatgagccaatgtgctgggtcacatgtatgtatttttggtgccaagttacacacctgttgcacccgtcctatctgattttgtttgataatgttgagctgtttggcttccttaaagacctggccagatgcagtgtctcatgcctgtaattccagaactttgggaggacaaggtgggtggatcacttgaggtcaggagtttgagaccagcctgaacaatatggtgaaacccaatctctactaaaaatacaaaaattagccaggcatggtggtgcatgcctgtggtcccagctacttgggaggctgaggcaggagtattgcttgaacccgcgaggcagaggttgcagtgagctgagatcgcaccactgcactccatcctgggtgacggagcaagactccgtctcaaacacacacacacacacacacacacacacacacacacacacgaaaaaaaccttactactctagccaagatgattatttttgcagagcctgaattcttccttatcttacccaaaaactccctgctgtggtagtgcctttctgtaatactgttgaatcaggtaaagatttctttctggtcacctggaaacaactctggtttgaaacttatacaaatagtaagtttcatttcaaaatattcagccagtaaatgtttaaaaaagaaacaaaaatctctgctcttttattatatagttaagaagtttttaaaaataaaatatgcctaagaatagtttttccattcttaaaagtgtcatagtgagtatataatagtgttacataattattgatgataagaactttagagcaaacgaaaaacaattgaaattatacagtacagaaatagggacatatcttcatttctttaaatgtactatccataaggaaactggtagagaatggagagccttcagtaatttattttttccaaacttctaagcttaggctcatataaacaagtcttaatatcctaatccagaactcagtgacaagttggttttggtgaccgaacgtttcttgtggctttgttcaacaactccagtatctcttggcttagaacagtgatgagttttttaacctatcctgctactgctgctcttagttctcaaaaattgaatgtaaaacactttagctcaatgataatatttcttgagatacttgttttctgttgttttcattatagcttttgaggaacttgaaaaagctttgagtacagcccaaaaaacagaggaagcacggagaaaactgaaggcagaaatggatgaacaaataaaaactatcgaaaaaacaagtgaggaggaacgcatcagtcttcaacaggaattaagtcgggtgaaacaggaggttgttgatgtaatgaaagtaagaataattctgtaatgaaatgggctacaacaaatttgaaatttaagtgtatttttccttacactctttgactgtaaagaagagtttgtttgtattttagacattgactgttttctgatattcaggttgtaaaatttttgatagataaatgcatttaatacttaggtaattctttggaaccttttaagctttgctttctctccagtggactatgttataaactgagatgtgccttaactgttctgtggctccccgactcttaggcaccttgaagataggctacttagctgcttcagtagtatatcctccagagaacttggccaagaaggtacttgcctaatgtgtgttgagggaatgagggagtaagtgactgaggggctagattgtttaaatgttttaaaggatcattgttacttaatgttctgattactcttaatatagatagacctcactttaaaagttagctttttggaaagatctcttagaaattaatgaatttttaaaatcccatagattttcaatttttcagaaatatgaacatgtcatcatcatggcccctccctgctcccagcttccttcctcacccatttttttctgcttttttttttttttgcttgtttttcctcctgtcatgtttgcctttcttgccactttgctcattttatcctatttctttactgactccccatttatattcttgatatttgattatggccactaaaatggcttaagataaattatagatctgaatagatgaggcttggatttcagagtttcaatatgcatttctataactcatggtaaggtttctgtgcttttacttatgagtgcataacaggcattgaggggggcaaattatatttctttcattttcttcttcctgctgaactataggtaatttgcaaagcagaaattatttgtggccaattattggatatataagaccttaactataactgcctgactatattttaagttttaaaatagtcatatgatgtgataagtaatgttatcatggactccaacaacttaaaaataatgtattattttgaaaggtgataatatagacatatggtataaaaatcagaagatatgaagtatgtagtgaaaagattcccattttcccaaagaaaagtggtattttcctttttgagtatatttcccagagatagcctgtgtatataatttctcttctctgatttttttttcttttccttatagatggatttattaggctttcctttaaatggtatctgaattttttttttttaacttaaaaaccacatggacaatcctgacatcgtttttaaaaattcagttttttctttttttaaacacaaaagacagcatgttatatagaatgttctatattttgcttttccacttaataatctttctaggagattgttccttagccattggtagttgataattcatagtgataccccatttattttaaaggctgctcaagattctattgtatgaatgtcctgtaatttaatcagtttcctattgatagatatttagattgttttcagtttttgctattgcaagttatgaattttttttctttttctttctttttttgagacagagtcttgctctgtcaccaggctggagtgcaatcttgtgatctcggttcactgcatcctccgccccccacgttcaagcaattctcctgcctcagcctcctgagtagctgggattacaggcgtgtgccatcacgcctggctagtttttgtatttttagtagagatggggtttctccatgttggccaggctggtcttgaactcctgatctcaggtgatccacctgccttggcctcccaaattgttgggattacaggcgtgagccactgtgcctggcctgtgaatattcttatccatacttgttcacatttgtatttatttagggtagatgcctagaagtggaatattaactcaagcaaagattacatgtatttttaattgttgcctagttgctgtgaggtctgtggaagacaatttataccctgacaagcaatgtattagaatatatttccccccaataaagatggcattatctaactttatctttccaagtttatgttaaaaaaattaatatatataactcttagcagtatgataaatatttttttctatttatttggcgaaatccttgactcacttttctattgggctgttggtcttttatggatttgtagaagctctttgtttatagtgagaattaggcctttgcacatacgtccttttagccaaataattttctcagtttgttatttgttgactttatttacaacttgttttcgtagaaaattttttttttccttgtagttgaatttataaggcttttctttaaatgctatgtggatttttttttttaatttaaaaacacatgttcggtcctgagatcagtttttaaaaatttgattttttcttctggcacttttatggtttcattttttttttactgttaacatctttgatccaactgaaacttatttagtgtaaggagtgaggtaaggattcaacttaaatttttcccagatggctaccaaatggtctccaaatcatttatttagtaatccacatttctccttctgatatgccatattatcttttttttgtagagacggggtctgcctgttttgtccaggccagtcttgaactcctgggctcaagcaatcctcctgccttggcctcccaaagtgctgggattacaggcataagccaccatgccccacccatattatctttaatacacactaaattattaaagtattaaatgtgagtttttctttctgcattctctgtgctgttctattgctttgtctgaccatgtgcagctgtttaattttataatatgctgtttggtagcttcttattattactcttattttttgaaatagtgttggttattcttgcatgtttattttgtccagtgggctcccccattctgtttttttttaatatatattaactttttagatttatataatgagatttgacatttttatgagattgaggtttcctatccaaaaaaagaacaaggcctgtaccttttaataaatagtacatgcctggaaagctggccataatttgattggtgcagcgagggcgcaccttcaccagtgtagtgccctctctgagagcatccttattccccagctgtgctcccctatcctgacttgtagggaacatccctgcaagatgtggaaatggagtctattgtagcagtagcagcacttgtcttaaaataagaagaaaactactggttattcttttaactatcatggctttgatgactttgatctatgcaggaaatgtgttttctcttaggaatgtgattttttcttcttaaaaacttattagtttgagtaaattataatagtattatttagttgtggagttacatattttattctgggtgtccttatattatctatttggctcattttcagaaatcctcagaagaacaaattgctaagctacagaagcttcatgaaaaggagctggccagaaaagagcaggaactgaccaagaagcttcagacccgagaaagggaatttcaggaacaaatgaaagtagctcttgtaagtgactatttttttttttctgctataggtatacttctcagagttacaaagttatcatcctctcactgttgcattccagttggaagtcagactactggcagtcttgacgtttgggtataaagagaggatagagagtaggcaagctgtcagagcttattagcttggtattgtgtgaaaattaaatttactgatctaacacactttcttttttttatgagagagagtctcgctctgttgcctaggctagagtgcagtggtgagatcttggctcgctgtaacctccataatctccatctccgcggttcaagtgattcccctgcctcagcttcccaagtagctgggactacaggtgcacaccaccaagctcggctaatttttatttttttatttttgtatttttagtagagatggggtttcaccatgttggccaggctggtcttgaactcctgacctcaagtgatccacccacattggtctcccaaagtgttgggattacaggcgtaagccaccgcgcttggccacactttctttttaaaacatttaaaaaattttaacaatttctttcaatatttatatttctctttcattgttgatgttcagtataaccaacacactttcattaagcagtttgtttatccatccctcccacctggcagtaggctatgattagggacaaaaaaaggaaaagatagattaattgaagcagtgactgcataattcaagaagagagtgcataattcaagaagaatgtcgaaaatctcatcagactgagtgtacccagagctcaaggctgagaaaattttggctgacttgcattttacagaagaagaaataaaaatggccaagtaatttttattttaagtggaataatttcagtactaattttcagtccatacgatggcttaaaaaagagttaaattaaaaaacttcctgagctaacaaaaacaaccagaaagcagattgagatttttgttgaaagattttttaaaatagcataatttgaaagtttaaaacaaaaaatatttttcttcacttatgaaagccttttatataagttgccataaaaaagtgttagtgacaaaaatgtaatttgtttttgtatgaaattattatccgtaagataatatgtgtaactcaaaaatgctttccgtgtaaaaggataataaatagtattttagattttaatcttctttcttacgtgtattgttgttttcactcttagttgcatctggggccccgagaatttctagcagcagtgattcttgaaatgagttaacaagttctctacccagctctgtgggggcacatggatttacagtatgattgggtgtctgtggtcatgaaatttacacatatatgggcacatatttgttttctttgttgatccagaaaagaattaaagcattttacaagaattcttaaactgtaacagtacaacataaattaaaaatgggggcaagaaagttaaggaacaaagtgggaaataaatagtgctaaaaatgcctgtcataaggacctactctgagttttcatgctggggtaactgacctttggggacactgagctagccttaatatacacatgcgtgggtacctgtgcctgcccttttcttaattcagtggactattaaaatttcctcctttatgggcatatagagatatatttaaaatatagtttacattaaataatatagtatatttaaatggatattttaaaattaatgctatggaaactagtattttcttatcaacctactcataacatggtacaaaatctttccttaatttaagtagtgcacttgagtatagtgaactgaaagtattgcagttggcaatatctgctctaagcaataggtatggataagtacacttgtcttaattggagttcaattaagaaattaacatttaatatgttaattgactgttagaagtactgtctagagcttctcttcttaaaacactaaacactttaaattgaatattgatacatgaaaggacaatcagagaagcttttcaggattgatggggtggtagagccaatgtagctttgttttatagatattgtcttgatcttccccatatattaacaagtaatcttctgatttcagtttgattttccttgtggggtctctttctaaatgagatattctcacaaactgtataaacttaaaatctagtttctagacttagagtagaaatatcaaactctggagtgtagagatgaggtagtagcaattgtatgacctttcacattcagcagtgtttcgtaaaacaagtagtggaaaaatagcagacatagtggggttattggaacaaaatttttcatatcagtagtaattgtggcaattaccccactggaaaagccatagtgccttgtttctgcagactagagcatgggaggagagagatgatgacgttacctatccaacagggctgggtgcagatcaaaagaaatgaatgattcctggggaagtactttgcgaatgctgaagatttatgtgcgtttaaggtggtattaattatttttggcacaggaaaagagtcaatcagaatatttgaagatcagccaagaaaaagaacagcaagaatctttggccctagaagagttagagttgcagaaaaaagcaatcctcacagaaagtgaaaataaacttcgggaccttcagcaagaagcagagacttacagaactgtaagttttaataatattcagattctggagttgtgaaattatttgcatatgaaaatttgttgtctctagtcagtataaagtttcgaagattactggattagatttatgtatacatgcccttcatttttaggtagtgtgagctatgcatgggagtggatttggctttaggctctgtgtttattacatggtgctcctggttctgcctttagctggctgtatttctgtcagccactcagtctgctgcttttcactgaccctgcagcatctccattgcatactcacccttgatgtctaggaagtgggctcattttgtaggcaatacttgccctggcacctttctgcttgtccaggtttatcttatgccatgtcctgaacgtaatccagcctctgcttatatcacagtttaattacactagtgtgtggcttttgcatttggtttccccagtttttccatactaaacatagtcccgtaatgaacatatttgtgtgtatgtcccagagtgtacgtttttttaaaggccctgtctgatcctttccttagcagtatttgaaatgtacaacctattttgaaaactaactgatgtttagacttgttagcttttttgctctgatttagatagtaaaacagtcatacttcttactcatagttctaaaccatgcttaatttttccatcactaacacttgcaaaaggttccatggtgggtgaaatggacacttaggaggcctagatcttccacttgttagatttttaaattaattgtactttaatttcgtcacctgtcacatgaagagattagattcagtaattccttaggaccctaggacctttccagctctgacattctgtggctctgccttatttaactccttcagagtcaaaattacattttcatgagataataataatctttgttaaaattcatataagttccttctttatgaaaaaaaaaagaaccttccaaatgataattttgaaggtggaaaaatcatacattctttttcttctaaaattatgagaataataaaatactatgtaggccttaaaaattggaaaaaaccccaatcttcctaccagaagttactgttatgaattttatggtttatttctttttactatccagttaaagtattattgaaaatgtaggtagctgaaaaggttccccaagtaaatagaaagaatctgaaagtatgagttgggttaaacatgtaatcttttctttccttttgtctttttttttttttttttttttttccaagacagaggagtctcgctttgttgcccaggctggagtgtagtggcatgatctcggctcactgcagcctctgcctcctgggttcaagggattccccaacctcagcctcccgagtagctgggactacagccgcatgctaccatgcccggctaatttttgtatgttttggtagagacagggctttgccatgttggtcaggctgggtctcaaactcccggcttcaagtgatctgctcacctcggcctcccaaactgttggactgtgccttgccataatcttttctttgttatatgattcctttagtaattgagcatagattctttgtcttttctagtgtttggtatgataattttgatcttcaggtaggtggtagacatcatgtctgtgtatcattgttagtagacaagtacgtactttaataaaaatgcatctgtttttaattaacagagaattcttgaattggaaagttctttggaaaaaagcttacaagaaaacaaaaatcagtcaaaagatttggctgttcatctggaagctgaaaaaaataagcacaataaggagattacagtcatggttgaaaaacacaagacagaattggaaagccttaagcatcagcaggatgccctttggactgaaaaactccaagtcttaaagcaacaatatcagactgaaatggaaaaacttagggaaaagtgtgaacaagaaaaagaaacattgttgaaagacaaagagattatcttccaggcccacatagaagaaatgaatgaaaagactttagaaaagcttgatgtgaagcaaacagaactagaatcattatcttctgaactgtcagaagtattaaaagcccgtcacaaactagaagaggaactttctgttctgaaagatcaaacagataaaatgaagcaggaattagaggccaagatggatgaacagaaaaatcatcaccagcagcaagttgacagtatcattaaagaacacgaggtatctatccagaggactgagaaggcattaaaagatcaaattaatcaacttgagcttctcttgaaggaaagggacaagcatttgaaagagcatcaggctcatgtagaaaatttagaggcagatattaaaaggtctgaaggggaactccagcaggcatctgctaagctggacgtttttcagtcttaccagagtgccacacatgagcagacaaaagcatatgaggaacagttggcccaattgcagcagaagttgttggatttggaaacagaaagaattcttcttaccaaacaggttgctgaagttgaagcacaaaagaaagatgtttgtactgagttagatgctcacaaaatccaggtgcaggacttaatgcagcaacttgaaaaacaaaatagtgaaatggagcaaaaagtaaaatctttaacccaagtctatgagtccaaacttgaagatggtaacaaagaacaggaacagacaaagcaaatcttggtggaaaaggaaaatatgattttacaaatgagagaaggacagaagaaagaaattgagatactcacacagaaattgtcagccaaggaggacagtattcatattttgaatgaggaatatgaaaccaaatttaaaaaccaagaaaaaaagatggaaaaagttaagcagaaagcaaaggagatgcaagaaacgttaaagaaaaaattactggatcaggaagccaaacttaagaaagagcttgaaaatactgctctagagcttagtcagaaagaaaaacagtttaatgccaaaatgctggaaatggcacaggctaactcagctggaatcagtgatgcagtgtcaagactggaaacaaaccaaaaagaacaaatagaaagtcttactgaggttcatcgacgagaactcaatgatgtcatatcaatctgggaaaagaaacttaatcagcaagctgaagaacttcaggaaatacatgaaatccaattacaggaaaaagaacaagaggtagcagaactgaaacaaaagatcctcctatttgggtgtgaaaaagaagagatgaacaaggaaataacatggctgaaggaagaaggtgttaagcaggatacaacattaaatgaattacaggaacagttaaagcagaagtctgcccatgtgaattctcttgcacaagatgaaactaaactgaaagctcatcttgaaaagctagaggttgacttgaataagtctctgaaggaaaatacttttcttcaagagcagctagttgaactgaagatgctggcagaagaagataagcggaaggtttctgagttgactagcaagttgaaaaccacagatgaagaattccagagtttgaaatcttcacatgaaaaaagtaacaaaagcctagaggacaagagcttggaatttaaaaaactgtctgaggaactagcgattcagctagatatttgctgtaagaaaaccgaagccttattagaagctaaaacaaatgagctaatcaacattagtagtagtaaaactaatgccattctttctaggatttctcattgtcagcaccgtacaactaaagttaaggaggcactgttaattaaaacttgcacagtttctgaattagaagcacaacttagacagttgacagaggagcaaaatacactaaatatttcttttcaacaggctactcatcagttagaagaaaaagaaaatcaaattaagagcatgaaggctgatattgaaagtcttgtaacagaaaaagaagccttacagaaggaaggaggcaatcagcaacaggctgcttctgaaaaggagtcttgtataacacagttgaagaaagagttatctgaaaacatcaatgctgtcacattgatgaaagaagagcttaaagaaaaaaaagttgagattagcagtcttagtaaacaactaactgatttgaatgttcagcttcaaaatagcatcagcctatccgaaaaagaagcagccatttcatcactaagaaagcagtatgatgaagaaaaatgtgaattgctggatcaggtgcaagatttatcttttaaagttgacactctgagtaaagagaaaatttctgctcttgagcaggtagatgactggtccaataaattctcagaatggaagaagaaagcacagtcaagatttacacagcatcaaaacactgttaaagaattgcagatccagcttgagttaaaatcaaaggaagcttatgaaaaggatgagcagataaatttattgaaggaagagcttgatcagcaaaataaaagatttgattgtttaaagggtgaaatggaagacgacaagagcaagatggagaaaaaggagtctaatttagaaacagagttaaagtctcaaacagcaagaattatggaattagaggaccatattacccagaaaactattgaaatagagtccttaaatgaagttcttaaaaattacaatcaacaaaaggatattgaacacaaagaattggttcagaaacttcaacattttcaagagttaggagaagaaaaggacaacagggttaaagaagctgaagaaaaaatcttaacacttgaaaaccaagtttattccatgaaagctgaacttgaaactaagaagaaagaattagaacatgtgaatttaagtgtgaaaagcaaagaggaggagttaaaggcattggaagataggcttgagtcagaaagtgctgcaaaattagcagagttgaagagaaaagctgaacaaaaaattgctgccattaagaagcagttgttatctcaaatggaagagaaagaagaacagtataaaaaaggtacagaaagccatttgagtgagctaaatacaaaattgcaggaaagagaaagggaagttcacatcttggaagaaaaacttaagtcagtggaaagttcacagtcagaaacattaattgtacccagatcagcaaaaaatgtggcagcatatactgaacaagaagaagcagattcccaaggctgtgtgcagaagacatatgaagaaaaaatcagtgttttacaaagaaacttaactgaaaaagaaaagctattgcagagggtagggcaggaaaaagaagagacagtttcttctcattttgaaatgcgatgccaataccaggagcgcttaataaagctagaacatgctgaggcaaagcaacatgaagatcaaagtatgataggtcatcttcaagaggagcttgaagaaaaaaacaagaaatattccttgatagtagcccagcatgtggaaaaagaaggaggtaaaaataacatacaggcaaagcaaaacttggaaaatgtgtttgacgacgtccagaaaaccctccaggagaaggaactaacctgtcagattttggagcaaaagataaaagagctggattcctgcttagtaagacagaaagaagtacatagagttgaaatggaagagttgacctcaaaatatgaaaaattacaggctttacaacagatggatggaagaaataaacccacagaacttttggaagaaaacactgaagaaaagtccaaatcacatttggtccaacccaaattgcttagtaacatggaagcccagcacaatgatctggagtttaaattagccggggcagaacgggagaaacagaaactgggcaaggagattgttagattgcagaaagaccttcgaatgttgagaaaggagcatcagcaagaattggaaatactaaagaaagaatatgatcaagaaagggaagagaaaatcaagtaagttttatttcagcttgaatatttttatggcagtccttcttaattaagtctcctttttttgtgcctaatacagttattttaaattatttggataagtttcaccaacccaaaatattaaacataaatccaatatgttaaatatgaggagaaataaaaacaatttagggcaagtggcagtgttattccatgtccatttaggagagaaaaaccttttcttgcatataagattctggttattagggacatatccaagtaattattttctttttgttttgttgtttttagtattagcattattattatataacatagatgtgttttgaaaaaaaaattaaagtggaaaacaaaaattctctggtccccaggaccactacttagaggtaatcatagttgatatgtacctggacacacacacacacacacacacacacacacacacactcactctcacactctctctctctctctctctcaaaaatgttttcatacaatgaactcatactgtatgcactgttttaaagaccaggtagctccttgcagcttgttctttgtgtggcagcagttaacggtacatttttattactcagacaggagcaggaagatcttgaactgaagcacaattccacattaaaacagctgatgagggagtttaatacacagctggcacaaaaggaacaagagctggaaatgaccataaaagaaactatcagtaagtaaaattaagttccataaggaacaattatatcagcagaggctataatttaagcttatcatttttgcagtggtggtaagtgcattaagtcattaaactggggaagaaataatccttgcccaataacattctctaatgggaacctgccctgcttggcaatgacttaccttaaggagagagggagcaggtaaaacaatctgaaagtattagctaattaattaccttgtaaagacacttttgctcagggagaggatacatttgatcactgttgagctagatgtctcattaaacatcttaaaatgcttatataaaattaaatttcatcaaaattaattggaatgagagttgttactgaaattgagatacaaatattaactcttgactaatgtgttttcttgtgtgtgttcatttttatttattagataaggcccaggaggtggaggctgaacttttagaaagccatcaagaagagacaaatcagttacttaaaaaaattgctgagaaagatgatgatctaaaacgaacagccaaaagatatgaagaaatccttgatgtttgtaccttatttcttctctctcacttttgaaatttagctgtaatagatttcatggtagtgccaaagatttccttttcaaatgtgttttttgaacgaaaagggtttttttttttgactcaatattattcaaattagtactgttatatgcagatttataaagttgagttgatttctgccaggattgtagtttcctgatgagattctgctaactaggcagcacagtccccttgctagtattgaagcaacagtagatactaaaaggaagaatagattctttcccatctgcctcacagattctgactgaactgtgaggggaaccagactaagaatcaagaccctgtgcttcggtgaagtctaagtaatgggatagtgagtgtgtatttaaatgtggctgcttaacttagctggaatctttctgggagggacaatcaactttactcttatctctacccagtgtgtggaggttgattggtctcaagagaagaaagctgggaaaaaatggaatgcataagccaaatcttttatatttagtggaaggttatttcaaaatacttactctactaatgccatgttgcaattcacagaatatgccactaatgcattgccattagcaaaataagataagccatgaagatacaccatgaagataaatcataaatgctagttagtactttggactaacatttgaaaatgttttcaaatgtaatacaatataaattgttcttggttgggttacagattctgtagttgctctaagccttatttcactatatgctaagaatcttttggtgattaagaattcataaatcaaagaatcatacctcagctgactatgtcagcagaagtctgagtcgggaacagattctaataattattttaaatgtaattgaaatggctagaattccaagatataacacatgcctataaatgccaccttttataattcttgagctttatatgtcattatgaaaagatttaaataatttcacattttcttatacttccatagaggatatatgtgctaaatgaaaaaaaaaaagtattatttcttgaatgcctagagagtgttggaagatacagtaaagctagtttagttctactttttttttttctgtttttgtttttcagaaggaaaagccagttcagtgtagttaagtaatttccctaaaactacatagtggtagagcagtgattcttcattagctttacacattttataaaaaaagacttcttcctaagaaaggaacttagagaaggcagttatttatcatggataattaagtcagggagattcatttgcagggagtaaattgtgccatagctctagaattcccttttgtgaactatttctttgtctcgggatgtgtggggtagcagatggtagacttttctagactcatgacagaccttttaggtagaagggtgagggaacagagagacaggttaccgtataccctttgacatggttcctccttaaaaatctgctgtattttagggaagttaatgaaattgtccttcaagcttcaggctttgagtagtacagcaagtggacaggaagtggagggtgggcaagggagtggcatggactcttttccaagttccttcctgtgccttggaccagcactgccactggaaatataatgcaagccggccaggcacggtggctcatgcctgtaattccagcactttgggaggccaaggcgggtggatcacctgaagtcaggagttcaagaccagcctggccaacatggtgaaactccatctctactaaaaataaaaaaaattagccaggtgtggtggcatgtgcttgtaatcccagctactcagaggaggatgaggcaggagaatcgcttgaacctggaaggtggaagttgcagtgagccgagattgtgccactgcactccagcctgggcgacagagtgagactccgtctcaaaaaaaaaaaaaaaaaaatgcaagccacaaatatgagccatattgtaatttaaagttttctagtagccacatttaaaaaaaaaggaaacaggtgaacttaattttaataatatatgctaccaatgcgatataaccaaaatactatcatttcaacatgtagtcaatattaaaaatatatacatacatataaattctttgaaattcactgtgttttttacatttcatctcaatttggaatagcaacatttcaagttctcactagccacagttttagggtagctagtgcctgctgtattgaatagtgtagccttagactttcaactgctaggactagggctgactttgtaattaaatagccagtccccatccagacatccccagatatactttatcccaaagaaattttttaaaaaatgcaaatactactaaaaagggctattagcaattctcagcaaacaccatattgctttgattcaaatccatattctctatgattctcccatttaaaaatttctgggattggagtttcatatgggatttgtatgtattatgtagtagtgttttttaccctttcttaaaagctattatcagatttatgatttgtctcagtgatgacattgtagaatgctgcatttttgtcacctattaaaataattatgtgatttgttaatagcaagtttgagcacagggacactttcatttttctaccttgaatgacattcttaccattcctccatttgaagaagctggaaacttttgacatctttaattcccacttcctgtgtctctaaacaccatacacatatatattaatgtacctattttgtcattaaatctgcttctctccccagcacaattacctgacatataacgggctcacaggatatggtttgaaacatcctgagaatcatgttgcttgttcctctcctctgaactccactgctgccaccacagtctgtgctaccattttttcatctggcccgatctgttgtattaatgtcctacctagtccccttactgcagtcctttttccctaacatagtcatctgtctgtcagagttattttctgtctggaaacaaaggtgtgatttattacttctcctcctaaatatgtgcagtggtttcccattgtcacagtgatacctcgtctagtttggtctgtgttccagccaaactcaaccatagcttgttcttcactgtgtgtttcctttgtacatgcttttctgtgtgcctaaagtcacattctcaagcttcataagttaatgcaagcgttaccatctctcttttggctaaaaaaagatcggggcagcgggggtggtgtggtgcatggccacgcccagtggcttatgcctgtcatcccaacactttgggaggctgaggcaggaggattgcttgagcttgggaggtcaatgctgcactgagctatgaacgtgcctctgcattccagcctgggtggcagagtgaggccctgtctcaaaagaaaaacaacaaaaaaaattaaataaaatttttaaatttaatttttatttagaaaaattttgaatcaaatgtattcacatggcttaaagattaaaataatattaaaaagtattcttggaggcggtatacatgtataatgaaaattgtacccattcctcctgtgttctgtgtcctctccctcttctccctccaccggcaaccattagtttcttatactccagtgtttcattatgtaaacaagcaaaaatgaaatatattcttattttttatttttttcccctttcctactcaaaaggtagctttttgaatatacttttctatgtcgttttttcacttgttcttttttttgaaacctcttaaatgtaattaattgcatctgtgttccttgttactcatatatatttgttacttatgtgatttttgtcatatacacatgcgtgtaggagtgtattaatgaatctgtcctctcccttagactataagcatcactctggagattttgttcttctctagtcgtgagaatctggcccagtgcctggcacatacgagcacttgataaatttgaaggaggcaacacatggtaggcagggaagaattcatttgggagaagggcatggtgacttgcaagttggagactcacaagtaggggtgcttaccaaatagcctaatcccaatctcagagcagtctcacttgcagagtagctcgtaaggctatattagatacaaaattggtttctttttaacattgactgtattttagtgattttgttttggcataataactagtcttcaaaacataacctgttatgtatatacataaagattcaacttagtttttcttagtgtttttacttcaaagcaacaatatactttttttttaaatcttaaaataagactagaaggcttttataaaggaaattacataactgttccttaaattagaaatgacacatcaaagattcttttctaattattgggggggcttgctttagattagtatcccacagatgtcaaaggaaatgtcagacatagctaattgtcatattagaaactgagcctgactaaataagtagctatagaggttattctttcaaacaaggctaaaccacattgacacagccatacaagaaatgtcaacaaaccaagacagagaacagtgatgcatttacaacaattttcggttgatggtgttttagaggtggaggccaaattcacgtgtgcctcggtgggaagatatctaagatatctaaggatatctagtagagatctctgctgtacttatgttgagaaaagggatttgtttttgcaattaagtctaagaaaatttcatgacaagtggtatttaaaattagattttctaaatgtcgtatgattcattgccttattttgtgccatagggcctaactatgtttgcatttgtttttgagaatggtgtttctgtttttggtaagtcaatgtctattaaatcagatacctgtttgtggttatttttcctgttaagtctcttgctcagcaaacacttgccctcattactcaaatcagatcaatattccaattccaaatattattttagcacaaaggttattgcagggtttataagaataaagagaagtctgggttgccctgtacaataaatcatggcaatgaccaagacaaatgagggaatgtaaggatggaaaacagccttttaccagggcagtcaagacaagagaggacaatttgtatgccaaattttataagtaggaatattggatcagtaagtcacatattgctctttctaattcagcctcgtctgttttttgcagtttgagacaaaggaagtcattacattgattaccagcacgttggacagtaactcattttttttttcaaaaatagattttagtagaacattttacctcagagaacaactggtgggggtaaatacataggagatgtgcagccttgtcaaattaggacaaaggaccatctgttgatttacacagcctaactaaagagggtgagaaaaactgaaaaccccgtaacttctgtgatcagtaaattgccatctggttgggtagtgctctgtataaaaatacctactactttattttaatgactattttctagaaatcaaattccaatatagaaaatgctgaagtcttaaaacacaggatacgtattgtagttctatcacaattctgttatatatctaattgttgcttaaacctgggaaccctagtttaaggggaaataaacagcttgatgagctttttgggatgaggagagagggagtgagggtgagaaaaatgatatcctaggaataatgagcattggaaagggcttggagtttaaagtgaggcatgaaggaaagtgtttagagcacaataatgaattaaaataaaaacagtagtgtgtgtctcaaaaacttaaatgtttatttccctacagaggtagttttctctataccatgttgcctctccagagtgcttttttgatgtgtttgtttactaatgcttcttttttttcttttcctttttttctttttttttaaatcctaaaggctcgtgaagaagaaatgactgcaaaagtaagggacctgcagactcaacttgaggagctgcagaagaaataccagcaaaagctagagcaggaggagaaccctggcaatgataatgtgagaggagtttgagtttgctgcacatgtttcttgaaaacattgtcatttctgtgatttgactagcctactaacatacatacatatttatctcatttaatcctaatgaaaaccctttgagatttttacctccgttttatagacagataaactaaatgttcaaagagattaaataaaatgttcaagctcacacaataagtgttgtggtgaggatttaagccaaatctactagacctcaaagcctaggcattttgttattaccagtgcttctccatcttttccatggaaacaatagcagaggaaagtgaatcttataaccctggagcatagctaaaaatggtccattgtaaatgtgatacttttagatttttggatttttgtgctaaaaattcacgttaattttatatcctactctataatacatccttagttgtagtcacataaaagtggtgtttttagttgtatatcattaagaaaaacaatttctatctttgttttggccagtggaccagatgcaaatacaatgcaatgatttgggaaaattggactgaattcaaagagaactggcctgaagatctaagcttttttttttttttttctttttaagtcctaatccttaagtaaaattgacactatgaaaggtagaccatgtttactccatggcttcttgtcctgctgtgcacctcagcagcacacacccacagttggggaaggctggcactgtacgtttctactgcctaaaatgttctcactcatccaggatggtcttttcatagcccagtcatgggggtaatgggaaagtgggtggtcactatgactttatcctggagaggattcgttacagaatgtcagttaccaggtaacaattttttacaccaccagttacatggatgacttacccgcagtgcagagaaagagcctctataaagagctttgctactctgtgtcacttggtaggcatatgtcaggtgtaagcactgagcaagctgagaggaccattttctgtttctttaatagctaagttagttctgtttaaattttctttactttctttttttctttttttgccatttagtcatgtagtcatgacttgagtattccaggtgctattatatattacttcttttgagaaaatacatgtatttaactgtctaacatgagcgtttccttagtatcaaagtattaatattgcatatagtaacattttaacttgtgtcaggatgccatagaatattgaaacattatgaaataagaaggacttctgagtcctttaccttgtgtcctaagaaaggtaagaaaatagccttaatttggccgggagaggtagctcatgcctgtaatcccagcactttgggaggccgaggtgggcagatcacctgaggtcgggagttcgagaccagcctgaccaacatggagaaaccccatctctgctaaaaatacaaaaaaaaaaaaaaattagctgggcatggtggcgcatgcctgtggtcccagctacttgggaggctgaggcaggagaatcgcttgaacccgggaaggaggttgcagtgagccgagatcgtgccattgcactccaccctgggcaacaagaagagcaaaagaaagagagaaagagagagagagagaaagagaaagagaaagaaagagagaaagagagagaaagaaaacttaatttttatttctactcaacatttttttttctcctttattcttcataaatttgtatccttctggagcatcttctggtgcttctgtatatcttaaattgcaatatgtatttagagtataatattttgtaaaacaaaacagaacatttgtttagaagcacatatttaaagttgccttacctcaagtctgaccactcccttgagactcttaaccctgacttcctttttccttatatctttatattgctttgttttactgtttcttatagctattattgtatacactcatgttttttctttccattttttcaggtaacaattatggagctacaggtaaggctagttcttctttttttttttttcttttttttctttgagacagattctcactctgttgcccaggctgttgcccaggctggagtgcagtgatgcaatcttggctcactgcaacctctgcctcctgagttcaggtattctcatgccttagtctcccaaatagctgggactacaggtatgtgccaccacgcccggccaattttttttttaatttttgtatttttagtagagatggggttttgccatgttggccaggctggtctcaaactcctgagctcaggcagttcccctgcctcggctttccaaagtgctaggattacaggccccagccaagactagttattctttgaatttgtctgaaagtcatgcattttaggggtattcagtgttataagttaaaacttaaaaagactaacaaaaatttccaagcagtgcagaaatgtgtctgggcaataatgaaacctatgtgcatttcagatctgactttttgttctttcagacacagctagcacagaagacgactttaatcagtgattcgaaattgaaagagcaagagttcagagaacaggtacaggcctaattggtaccttttattttgaactaaagtttcgttaatatgtacttggatctcagctactttttaaatagttggctttgaaatttttcagtcttacacccaggaaattttatttccaaatccaaaggtactagaggttttctctctaaattcatgatcatatatatttaagcaagaacatttgtatcatattatttttaatgcttaacattttttataacaatttgtgatcgtataatgtatagtaatttatgttctacaaagaagttattttttgcttttatcggagagaaaatagtcatctatctttggtactttttccaagtggtttaattgtcctaatttaattttcccatatattattgatggacaatatatgtaagtcagtttaaataggaccatgtgtgtacaccttcaaggatgcacagtacacccataccaggatatgtggtatatgatctttagtaaagtctttttctaaactctgggagaaatagtggctcaaatcagcaggctaagtttgaaggctaaatctcctgggattttcccagttcttttaaaattcatacagacaaaaatcttgataattgttagaactgagtgatggatgggtatatgagcattaattgtactatattttcttggaatatgtttgaaatttttcataatatttctaaaatttcataaagataggtcccaatgtgactttatttttttgtttcactagtgatttagcttttcccatctattctcaagattactgctttaaaattcttaagatcaaatcttgaaaactgccctagcataacagtttttgtattagttatttttactgtgggaatatacacattaaaagttaacattttaatcattttagagtacacagttcattgacatttagttcatttacagtgttgtgaaaccatcactgttacccagttccagaatatttcatcaccccaagaggaaactccatacccattaagcagtcactccccattacctcctccccgtaacacctagcaaccactaatctgcttcctgtctctatggatttgcctattctgggtatttcatataaatggaataataacaatacttgaccttttatgttaggcttttttttttttttttttgagttggagtctgtctctgtcatccaggctggagtgtagtggcacgatctaggctcactgcaagctccgcctcccggattcacaccattctcctgcctcagcctgctgagtagctgggactacaggtgcctgccaccacgcccggctaatttttttgtatttttagtagagacggggtttcaccatgttagccaggatggtttcgatctcctgacctcatgatctgcctgcctcagcctcccaaagtgctgggattacaggcatgagccaccgtgcccggcctgtgtcgggctttttttcagcttagcgtgatgtttcaagattcatccatcttaatagcatatatcagtatttaatttcttgttatggctgaataatataccatcgtatggatatactacattttgtttatccattcatcagttaatggacatttgggttgtttccttttgcctatagtgaacagtgctactaaaaacattgatatacaggtttttgtttaaacacctgtttccagttcttttgggtatatacacaggagtggaattactggatcatacagtaattctatgtttaactttttgaggaactgccaaacttttctacagtggctgtactattttacattaccatcaacaaagtataagagttccagtgtctccatatcctcaccaacaagttttttgattattgccatcctagtcaatatgaagtgatacctcgttgtggttttaatttgcatttctccagtgactagtgatgtgaaacatcttttcattggcttgttggccatttatatgtcttctttagagcaatgtctactcaagtcctttgtccattttttagttggattgtcttgttgagttgtaaatgctctttatatgtactagagacaagtcccttatcagatatttgatttgcaaatattttctcccattctgtagcttgtctttttacttcattgatagtgtctgttgatgtacaaaagtttctaattttagcaaagtgtaatttatgtatttttttcttttattctgtgttcttttggtatcatatctaagaaatctttagttttagttttttttttcgcagaaacaattcttgctctaaaccatttgtcttaattttatttgcctatattctgtcttcagcattaaaaaaccttgtggtgacagcaatctttctttttcttacatacagtttccctgtgaatcttatatggtctgattatttgttatttttagattcacaatttagaagaccgtttgaagaaatatgaaaagaatgtatatgcaacaactgtggggacaccttacaaaggtaaggatgatctcgtgtcatgttattaactgttatcttttattggtggatttgtgcatgatttttatttttgtttttgctaatttatatttttttctcattttaaaatttttaatgattttattttttcttaattgacaaatgcatatatgtatagtgtgcaacatgctattttgagttatagattcattgtggaatggttaaactaagtgcattacctgacatactaccttttttgtgtgtgtgtgatgagaacactttaaaatctactcttttcacagttttcaagaatacaataaattgggtggggaataatacaatacattaactgtagtcaaccgtattttacaatagatctcttgaacttattcttccttattgaactgaaattttgtatcctttggacagcatctcccaccccccacagtcccttataaccaccagtttacccggcttgagttcagctttttagattccacatgtaagtgagattatgtggtatttgcctttcttcacctagcttattccacttaatataatgtcctccaggttcatccatgttgttccaatggcagagttttcttctgtttggaggctgaatagtattccatgtggttaatctgttttttacaatgaatatattttaccttttaacagctgactttaaggaaagaaagatagtaacctggcgggcgtggtggctcacgcctgtaatcccagcactttggggggctgaggcaggtggatcatgaggtcaggagatcaagaccatcctggccaacatggtgaaaccccatctctactaaaaataaaaaacattatctgggcatggtggcatgcgcctgtagtcccagctacatgggaggctgaggcaggggaatctcttgaacccaggaggtggaggttgcagtgagccaagatcatgccattgcactaaaaaaaaaaatgatccacctgcctcccaaagtgcagggattacaggcatgagctactgcacctggcccaaaggattttaaagatgagcttgagtctttatgtggtaattcccttgagataatcaagatcattgaataatcttatataacacttatccattctctaaagttcaatttcattacctcactgtattaagaatagttttattttgctacatgttttgtaaacctttctgctttcctatgggaagcatgaggacataaaaaccatttggcattctcttcttttgtgtttttgaaagctctcattactatcaaataatgtaaaatactacacaaattttaactaaattaaaggacttgctgtggatcctgtccaaactggagctcctcaaaaagaagtaaaaaccagcctggaaatttcctatgctcactgcggagatgattcttgctgcaaagattatttactatagctaagtcactgaatatctcagcatagaactagactgaatcagcctacagccataccaccgtgaatgctcccaatctcatctgatctcagaagttaagcagggtcaggcctggttactacttggatgggagaactatactaaatcaatactcagcagtgcatagagaatagtgtcaattccttttgttattttccatgtaagaatttcctacataattaattttttctcatatttatgaacacatatatacaatttatttaatagctaactcataatactaagcgctaaacacttacaaacacgtttttgtcttttttaaaacattatttttctcagatttctcaaggataatatagcttatctgctcatttaatcctcttaaaaacccaagcattgtggtgcagtatgtacattaatctcttcgtcatgctgcctctttaaagagtaaaatgaggccgggtggggtggctcatgcctgtaatcccagcactttgggaggccaaagtgggtggatcacttgaggccgggagtttgagaccagcttggacaacatggcaaaaccccatctccactaaaaatacaaaaaattagccgcgtatggtggcgtacacctgtaatctcagctactcgggaagctgaggcaggagaatcgcttgaacctgggaggctggggttgcagtgagccaagatcacaccactggactccagcctgggcaacagagtgcaactctgtctcaaaaataaataaagagtaaattgagcacctatcttgcagtacaaaataaaacattcctagttctttagaagcccctgtgtgtctgcctttacaatatctttatccctctcatcatttttactgtttcccctgacttttcttaatcattatcttgttctttatcatttaccacctgtatttatattttcaagcaatattttgtttagattttgtttgctttgtgaatttatgtaattcagtcataccataagcattcttgtatgacctgtttcttttgcttaatataaggtttgagagttatccagattgtgtgtagttgttcatttccattatattaattttgtacattctttttcatttttcctaggacatgtggaaatttttctctagaatatataagaatggaattgctaagtcataggatatgaatatttttgtgcatatcccatattaggttaagccaaaatgtttgctatattttttgtagtaatttccacttccatcagcagtgggtgagatttctcaccactctagcacctcatcagtgctggatatataattttttttcttttttgagatgaagtctcgctctgttgcccaggctgaagtgcagtggcatgatctcagctctctgcaacctccacttcctgggttcaagcgattcttctgcctcagtttcccaactagctgggagtacagggttccacacccagctaatttttgtatttttgggagagatggggtttcaccatgttggccaggctgggttttttgtttgtttgtttgtttgttttcaagacagagttttgttcttgttgcccatgctggagcgcaatggcgcgatctcagctcaccgcaacctccacctcccgggttcaagcaattctcctgcctcagcctcccgagtagctgggattataggcatgcgcctccacgcctggctaattttgtatttctagtagagatggggtttctccatgttggtcaggctggtctcaaactcctgacctcgggtgatccgcctgcctcggcctcccaaagtgctgggattacagacgtgagccaccgtgcccagcctggccaggctggttttgaactcctgaactcaggtatctgcccacctcggcctcccaaagtgctgggattacagacgttagctgctgcgcgcggcctggccaggctggttttgaactcctgagccaaacagtgcccatacattgcatttgattgataaattacttaagtctcttttgaactccaggtccttctccacctttgcttttatcatttatttgatgagaaaaccaacttacttgtcatatagagtggaccacattcttaattttctggattctgtctccctggagtcctctgttccctggtaggtagaactagaggcttgagcagagttaggtttgattagatttagctttgcatggacaatagtacttcataaaggaagttgtgtaattcttgtcttacatcaaacgttcatgacatatttacgattttaagatctgtcacccagttccaggtgtgatccatcacttttcgccagattttagcatccattggtaaattccctgatctgttacttcagtagtgattgcataatggtgttagtaaaattccaccatttcttgtgcatatattaattggaattcttctataaataggaacttttccacattatctatatggttaccttgaggtacaactcaaacaagaaaagcaggataaattctgtctgtttacccatttcagactaactgaaactggtcagtgtctcactctgtcattcaggctggagtgtagtggcgtagccttggctcactgggacctctgcctcctgggttcaagcgattgtcatgtttcagcctctaaagtagctgggattacaggcgcacaccatcacacctggctaatttttgtatttttagtagagatggggtttcgccatgttggccaggctggtctcgaactcctgacctcatgtgatccacccgccttggcctcccaaagtgctgggtctataggcatgagccactgtgcctggccagttagtctgtatttttgaagatctgtttctgctacctctagtgtgtttcattgatccgtttgtctatgcctgctctaatacctcactgtcttttttttttttttttttttggtagagatgaggtctttctatgttgcccagtctagtcttgaactcctggcctcaagtgatcctcctgccttggcttcccaaagtgctgagatttcaggagtgagccaccatgcctaaccttcactatcttaataactgtcacttcataataagtcttgatgtctggctggggaagctgtcccactttttctttaagaattgtttattcttaactctttgaatgtccatagaaattttaaagtcatcttgttaagttacttaatgcatacatacacattcctgggaggattttgattaggcttgcatttaatttatagaaaaagagaattggcatttatatggtattgattctccaacccataatcacaatatacctcaacatttatgtaggtatttaatgtctgtcagtaatgtttcttggctgggcacagtgactcatgccaatagtctgaacactttgggaggccaaggtgggaggatcacttgagcccaggagtttgagactaacctggacaatgtagtgggaccctgtctctagacaaaaacgttagctaggcatggtgacatgtacctgtagtcccagctacttgggaggctgaggtgggaggatcacttgaatccaggaggttgaagctgcagtgagctgtgattgcaccattgcattctatcctgggtgacagtgagaccctgtctcaaaataataataatgttgattgttctcagtagtaatcttgcaccccttttattacgtttattcttagatgtgattgtaaatgtaatatttattttctaactaaatgcatattttaaaggcattatgcattatttgaggaaactccaagcaagcttatgttataaaattatctgtaacacacaattaaaattgtgttaaatgtcaagtggatttttcagttatacactttggaatttggcccagataaagtgtgggttttaaaatgctgagtgatacctagacgaagttatttgggaagacccattagaggcaacgagtagacaatttggaaagcctctttatttgaacaatagctaatttcctcgcataattgcttaaaaccagaaataagagctataaagtcttctgtacccactgtttgggagaagtcaagaagagacacaagtattgaaaaataatattaattctgtctcctggaaaatagctatcccagcactttgggaggccaaggcaggcgaatcatgaggtccggagttcaagaccagcctgaccaacatggtggaaccctgtctctactaaaaatacaaaaattagccaggcatggtggtgcacacctgtaatctcagctgctcggtaggctgaggcaggacaatcacttgaacctgggaggcgggggttgcagtgagccaccatcgcgccactgcactccagcctgggcgacagagcgagactccatctcaaaaaaaaaaaaaagtaatctgcctatttaataaaattgcttattttctgaaaagtgaaaaagaggtgcgttttgtatagatctagaggaataaaatactcaaatatgatatatagaaggatatattactcaggggaaataatgtgttttcattatttagttcttaagaactctatacttgcaaagtataatttgagtgagttgagtcttctaaaagtatgcacttaaaaaaatattccaaatgtgagtgcatgtaatgtacatgtaatgtatggaggctatttaacacctcagaatccaccatccagaacattgccatttcttttgaggcttcttgtgctgctctgtagtccttatatctctgttgtttcccagtagtaactgctgttattatattacaacataactagttcctttaaaaaaaatcgattttaatgttttatatgttttgggctgtatagaaatgacatcatactgtatgtgtcctatgtaaattactttttttatctaatattattttgagattcattctaatgtgtgaagctataatttgaccattttcaatgctgaatttaataataatacattatatctttatgtcacagtatattctcttgttggtgggcattttagttgttgcgattttgcttttataaacagtgtaagtaaacatcgactcctactgtacatatgaagtgtttctctaggttatattgctaataattgaatttctgtgtcatataatatgcttgttttctatgttacaaagttttaaaagcagtgccaaattgtcatctgtagtgcttgttttcagtttcctctcctagtagtacacgagtctccattgtttcacatcctcaccagtgctttgtattgtctgacttttaagattctgctcatcagacatatgtaaatgacacataacacagtttgttttcacagaacaaatggttatttaaattctaaacccaaagtaatgtacaattacaataaaaggccagaagaaagaggaggaaggaaaaagatgtgagaaataaaattgttatagtaattcttgttttcgcttccaagcataaaatagtaattggaatgtttagtgtgcatgtgtgtatacaatgcaatatgatacaatataaaagcatgcctctctttgttccattggttgttttttaaatctatttttataagtaataagtagtttacctggttttgtctttacagtttgatctatttttttatttggcaggtggcaatttgtaccatacggatgtctcactctttggagaacctaccgaatttgagtatttgcgaaaagtgctttttgagtatatgatgggtcgtgagactaaggtataaatcatgtctcgtgatttggtgtgtggcttaattttaaaagaaatatgttccacttttaatacacatgtgaatgccatatgtttactattagcaaatcagacatgctaatagtaggtaatagataattattttattgctcttagtttacaaagtgaattggtggatcttgcttatatttattacatttataaaacattaattttgaaaatactattgggtaacactgaacgctaaacattaaaatttcattaacataagaataatttgtgaaccatgtggctttttttcttcttcatatctttaagttagaagaatagatttcattttcaaggagactttaggatattatggataatattggaaatagtcataattattagctacctagagagatttagaaacattatgctttatagttactgtaagaaaatccttctgcacttgtggaatatcgatcatttaaaaattaccccatgtaagtaataatgcttggctaatttgttttctagaatgttgcatttattgtaaggttcttaaatgtagagtcttgtcttattcttatttgtatcccttgcagtgttttaaaaagagccttattggacatttggtaaatatatattgaattgagttaaatgcttctagggaaattcatgagcctttcttcaaacaaaatttttcatttaaagcagtttctgtttttttgacattttttaccttcatggaattttaattgtctgtgtgccgtggctgagaatgggataatgaattttctatgctcgaaagcaatcagtgttttaatgtatgggtgtgtgggagttgctgagtcataggatactaagcaggttcaagcactgatttggcaaatatatttaaaacctaaaaagcaaatatcttaaaataatattataaaaggaaatatcttaaaagaatatgataaatgtatagattggagattcagctaaataccaggagtgggttagaagtcatttgaatccttaatatctgtagaaatcacatttcattatatcaagttaaagtaatatctaatattgtgaacaggtatcacagaagggagatattaaatcacagcaattcagtgtctttttttttcctcaatgccatttttcaaaaagttcaagggtagctaaaactaattttctccttatcttttaaaaacaaaactaacgaaatacagctttctcttattatgtccctatgggacatacactatctcacctcaaatacagggtatattatgtccctgtggggggatatttgaggtgggatagatagtttaaagttaccttgttattgtattgggggtggggaggagaggcatatctttaaaaaacaaaaagcttctcagaactttagctaccttggctcattagtgaatctaaagctatgatgcaaggttgttactaaataatttatttagctttttcttgatctgtaaaatggagagacagactgccttaacctgtttcttctgaaggttatgaatgtatgtgagatgagatagctacggagcttaactaccctgaagaaagacctagcataagcataagcataagaggcttatggggcagtaccagttcatccaagtctaagcttgtgcttcagggctctgcagttaatcttagagtgtgacttgggaagtagctgaaagggatgtcccatggcacaagcagccccatctaataagctggctgggaatttgtgttgaggagtagtgctctctctcctctttatcttcagcgtcgattctccttttctggctctaaaaatgaagagtagtctatcattctgccatcacattttataggcaaatagaaaattggtactaggtatttacttttaagttgctgcacatttattgagcatggccctttatcaccatggtagatagcaagatgacatttgataccatctctaactttaaggcgttcactgtgcagtaaggaagggaactgttctcattaaccataatgtgatgatgaatgcagtaagtgctgtaagacagaaacagagtcctcatatttacctgtgagaagatcaaggagaacatcatggaggaggtggtgtgtatactgggatttaagaggagatgttagattttgatagataagcccagatggtggaggggtagcccagacaggtttcaggcaggaaacatagtgtgggtttttgaaatcacaagtagcctggtccaactaaaacgctggattgatgaaggggaagtaatttaacttaaggctgcacagagaatgcagggccttgaatgttttcagagttttacctgtaggtattgggagggggtagccctgaaaattttcaagtagggatttacaagatcagagctgtttttagacatgtcttttgtgggtttgcccaatttctatacattaacaaagaatttgaaatggagaccaggttgcggttttagaataagtcggagtatgttgtgctctttgtgatttgattaccatctgcagttgtttcttgtctagcaggattcatatgtcttctcacctgtgtttcttcgtctgcttttgtacacagtgttctttattttatgaggcagatgactttttaaaagaagactatatatagtacatacgttcttgtagtatggagttaagtaagttcccttccttccttctgtccgtatactttctttttcttgggttttgatcctccatgctaatgctgaacctgaaattcagcctgttctccttttcaacataaagtgtttctcatcctaagctttattgaagatgcctctccctaaggaatacctggcaggagagatcacttgtaaatcaggtggctcatttgaacttttccttacttcccagggcctgaggatattgtatgtagagtagacagtctgatatcttttccaaggtgtggcaaagagcctgggcttctccattaaagtgttttctggcaagccagggatgagctttaactcttcactgggtaatgagctgcagattcactgatgaatttagaggtgggtttaccatttaatgttgtctagaaacacgaagagacaactagccacagctatattttttccccaaacatgcttgtgcatgcatgtatatgttgtttcttagtaaatataaatggactttttggtacttggagctttatgtggtgttgatattagagaaatgcttcctataattctgaatccctgaattttagattttttggtacttataaaaaaacctttatagatagtataccagaaactgcttcaggttattattaaaaagaaaaaactgaaatggttactacttcatatttctctttccatttcatgccacatgtttacaggcataccttggaggtattacgggttcagttctagaccactgcaataaatgaatatcacaataaagcaaatcacacaaattattttggtttcccagtgcatataaagttacatttatactatactgtagcctattaagtgttcaataggcattttgtctcaaaaaagtatataccttaatttaaaaatactttattgctaaaaaaaaatgctaacattcatctgagccttcagcaagtcataatatttttgctagtggaggatattacctctatgttgatggctcttgactaatcagagtggtggttgctgaaggttggggtgtctgtggcattttcctaagacagcaatgacatttgccatatcagttgacacttcctttcatgagcatgtttgatagtattttacccaccatagaacttctttcaaaattgcggtcagttctctcaaaattgcagtcagttctctgctgtggctttatcaactaagtttatttaatattctaaatactttgatgtcatttcaacaatgttcacagcatcttcaccaggagtagattccatctcaagaaaccacttctttgttcatccatacgaagcaactcctcatccattaaagttttatcatgagattgcagcaatccagtcatgtcttcaggctctgcttctaattctggttctcttgatagctgcactatatctacagctacttcctccactgaggtcttgaatccctccaaatcatccatgaaagttggaatcttcttccaaacccctgttaatgttgacattttgatctcttcccatgaattaccaatgttcttagtggcatctcgaacagggaatccttttcagaagttcttcactttgcccactgtcatgagaggaatcattacctatggccactatagccttataaaatatattccttaaataagaaaacttgaaagttggaattacttcttgatccatggactgcaaaatggatgttgtgttaggcataaaacaatttaatcttgctatctccatcagagtttctgggtgaccaggtgtattatcaatgagcagtaatatttgaagggaatctttttttctgagcagtaggtctcaacagtgggcttcagatattcagaaaaccatgctgttaacaggtgtgctatcatccaggccttgtttcatttctagagcacaggcagagtagagttagcataactctgaagggccctaggatctttgggatggtaaatgagcattgccttcaactgagagtcacaggctgcactagcctctaacaagagagccagcctatgtattaaagctttgaagcttttgaacttctcctctctagctatgtaagtcctaggtggcattttcttcaaatagaaggctgtttcatctacacagaaaatctgttgtttagtgtaaacatcttcatcagttttcttagctagatcttctgggtaatttgctgtaccttctccatcagcacttactgcttgtattagtcccttctcacggctgctaataaagacatacctgagaatgggtaatttataaaggcaagaggtttaattgactcacagttctgcagggctgaactaatgacatgaggaaggcctcaggaaacttataatcatggtggaaggggatgtaaacacatccttcttcacatgatggcagaaagaagtgcccagcaaaagggagaaaagcccattataaaaccatcagatctcatgagaattcactcactatcacaagaacagcagcatgggggtaactgcgcccatgattcagttacctcccattgggtccttcccacaacacatggggattgtgggaactacaattcaagatgagatttgaggtggggacagagccaaatcatgtcgctgctttaccttgcaattttatgatatggagatgtcttctctccttaaatctcatgaaccggtcttttagctttaaacttttcttctacggctttgtcacttccctcagccttcatagaattgaagggaattagggccttgctctggattagggtttggctaagggaatgttgttactggtttgttcttcagaccactaaaactttctccaaacttctatccagaccactaaatgaaataaggctatttcattctgattcgtgtgttcactgaagtagcacttttaatttcctttcaagaacttgttttacgtttacaacttggctaactggcatacaaggcctagctttcagtctctcttggctgtcaaaatgcctttctcactaaacttaattgtttctatcttttgattcagagtgagaggcatgcgagtcttccttttacttgcatacttacagaccattgtagggttattaattggcctaatttcaacattactgtgactcagggaatagagaatcccaaggaaaaggaaagagatgggggctcagcagaacacaagcaacatttttggattaagtccactatcttatatgggcatggtttgtggtgccccaatacagtgaccatcataacatcaaaggtcacagagtacagtaacagatattataataatgaaaaggtttgaaatactgcaagtattatcaaaatgtgacacagagatataaagtgatcacatgttagaaaaatggcaccaatagacttgcttgacaaagaattcccacacaccttcaatctgcaaaataaaaacaaagccaaaaaccaagaaacagtttctgtgaagctcagtaaagtgaagcgcaatagaatgaggtttgcctgtacttggtttctagacttcagtttaacacacagattctgttctgtctaggcagtacagtttaaatgatgagggtttttgtaaaatgcctttggaattttccaagagctgagttgtcttatgtatgttattgttgttgtatttttaacaacagggtcttactctgtcacctgagtgatagcggtgcgatcgtagttcactgcaacctcaaattcctggattcaagcaattctcccacctctcccaagtagcttgtaatacagacatgagccataacacctgactaatttttaagattttttgtagagacggccataaataaaatagccataatcctggctaatttttaaaattttttgtagagatgggggtctcactatgtttcccaggctagtctctaaactttaggactcaagcgatcctcccacctcagtctcccaaagtgttgggattacagttgttagccaccatgcccgactgaactttttttactaccaaaatagcagaagatgaaagataaacggaagaagaggtctgaaactaaagtcttgccatgtgtgggatttgtgagtggggagcagtattagtttatctgttagtagaaataagtattggaaatatgtgaagtgtcttgcctagacttagtgtatataataggagctttaaaaaagttagttcctttccttcctggaaataattgtgatactttttttcctaatgacgtgagtctccaaaatttttggttaactatattatcttttccttaatgaccttccccagatcacttccactcttctcccttcccccatatgcaaagtctatgtaactatgatcaaggaatgttagagtcagttttctgggctaccctcccatccacggtaggaatctttagaatactaccacctgattttgtatgtaagcactgaagttgttatcctacttatttcataagtggtatcttctttcctctctgtctccctcaaaacatctcatcttgatacaaaatagggagtttcaacctttgaggagaattttccaggagcttatgggtgacagtctgacttacggtatatttatttagatgtgcacaatttatgatcttgttttgcaagccatgtgtaatgtttcgattcatcatgttttctaccaaataaaacatcttgtgtttatttaaaatgtaatttgtatttctattaggttgatgtgctgcatgtcttgaaaaatacctactgagcatgttcatgttcatgcagtagccgtgtttatgagatatatgatgtgatttagttaaagctgaacatggggggtatttaaaatctgattatttagaacatatgttttggcaatacatcacttactagatagatttctgcaaataagccttttaaaatgaatatgtaataaagttttatttaaataaaggggccaagagcattagaattttatatagcttcatgctattgtaaatgcatcttgttaaaataatatgtgtagacattgtaaggagtccttttaaattgaaattctagtgttgttatttccttgactaataccttcacatcatacttctttgttcgtggctttcattgagagcactaaagaatcccaccagcagaacatgtcagaatgggttgagactttatatgcttcactgtctgttagtgatcatctcttgtttttcttgtagaccatggcaaaagttataaccaccgtactgaagttccctgatgatcagactcagaaaattttggaaagagaagatgctcggctgatggtaagttctggaagtgggctctagatagaagatgatttcccatctgtttatattctgtctcatttataaggacttttgagttggtaaaataaattttaagatttcaaatctttattatatcacagcctgaaaaatgagagtgaatttacactaagaaatttaaccaagggtaaatgtgaatggatgccctcaagggaaggaagagtctaatttaataccatataagagcttgacacccgtatgtatgctatatgacatttccagaacttgggctgtttatggaaaggatggaaaagacatttgttctggtatatccagtaataattttttaaaccaaattatatcatcatgttagatgatttatatattacagttctttattgcattccagttgatttccaaatacattaattctgggtgaaagaatttaagcattcttgagcttttgataccttatgggggcaatcagacaaacaatgaattatttttaaaaacatagtgtgaagtcagctgtaattgaaaaatgaaagaaacacacactttgtaaattataaaaaattctccatgccaaagttatttttgccctgggccagtaatttaataagatccattctaggcagagtatgaaacttgaaaaatttgggtcctgccttcagctctctctttctgcttcttttccttgtcttgatagtagcctgtagagccctccgtgaatacccttctcctcccaatctctttacctatttcatcataccagcactggttttattctctctctcctcactaaagcaagccaacatcttttccttaatggtgggttagcgtgtgtctgagcatctccaataaagagcataagccagtaagtcccaaagtatctcatcgtatcctaacagattgttttcttacaaaagttcttgattctcttgagcccacatctccttctctacatgatcacctatttgttctggttctaactcatagaattcaaccaaaaatctggggatggcctagatggaggggttttcctcctcccggctaaataatacctcttgcacttacagccttttatgaagttcctctgactctctgcacaaggtcagccctgaagggaccccaatatctcaggcacattctgaccacttcttcttggtctcctctaagctcatcctagcattccctgacctttgtcccaatgcttcattgtatattgtattgtattatatacttattgcctattttctgaggcatttgctattattttggttagcatttaattgttttttgtaaaaatccctcctctgccactccctggcatttagtaacctgaaaagcagtgctttagttatttctgcttataaatatttttgataaagaaatatgtcactataatgtataccattcatcaacagagagaatgttgttttaaattataatgaacatctaattctacaagcatgaaattttgtattcatgagtagaaatttttcctttactgagtaaaatatctttatgaagataaaaatttctaatgcagtttgagcctgttgacataattttgtcattatggtccagtttaagaaaataattttaaatgatataaaagggcttttatttagttatctttattcattctttcatagctgctttatcatcttgataaacatcttgatgttggaatatggcaaactttacttctactgcattttctcaggatttgctatatagtgtaggctcatcctaagtcgctgctctagcaaatgtggtaggaaacattccccttcattccatatacacatgtagtctttggttgatttgctttgatgaaaaacaaatcgaattggtaaatgtaggtagtgaatcgataaaactcttaaagcagacaaaaaaggtttgtttttgttaagtttaacttaaaaaaaaagagtctttgaaaaacagactgttttcttcctgaatacagtggtattcattctaggtagggatgaaatggtagctgatttattcttcctgaaagaatcttcctttatcccagaggttgacctgcccagaaacaatgttctacttttctactattcctttaagcaaagtctcatccatcattatctcttgcttaatgaataagttcagtcaacagtcatctactcttctagttgttatgggaaatataggaaaatagaagatatggaagacattggttgttgaccttgtggaacttttaattttagggggaaggggtaatatccattcatacatgaataaaaagatatgcttaagtaatatgattcaaataataaaaatggtgcttaggaaatatgaaattttatgatgaacatgaaatgaggaagtccccaaaatacgatatgagatgacatgaattaatcaatttgagtcaacttttgtcaatttaaggagattcttgatacttgataatgtgactcatgattgtttcacgagtataagaaagttgaagcaagagttacctttgtcagagatttccatcattcataaaatgagcaataagaatcactgtctttgaacaagtctcttgaagaaatttcagctaatttcatatccctgtccattgagctgtagctcgctagaacaaaacacaggtatgaaaatgatttttctttttccaatagaaagtgcacatgatgaaatgtgtagaaaacaaaactttaggagtttattaaataatcatttttaaatgatttaatcacattaattttaaatgtatgcttcaaatggatcttttctgtaagtttttgtaactgtgcagctatggtttcacttctattaaaatcagcaaccctaagtgttttgttatttttgcctaaggactgaaaagctggtataagaaaaccaaaacaaacctaaaacattttgccgagctgccccctcttcaaattagtatttgggatgcttgcaagagtgtggattgtactttgtgttgacagcgtgcagcccatgttagtttttacattatttattgggtattatcagaggaatacattctaaaatttttgctttttgaccatgatgattatacatttactttgtagcactaatcaaaagctttctatgactgctggtgaggtacttttcaatatatcttatctttactatacttctctctcttcagtgagttttatactctttatttaaaaaacctcattacaggatacaagttattactgttttcagagtttaacctagtctcgagtagattttatagatgagaaatcactatctgttaagtaaggttaaattacagagcataattacagtctggtttatttgagggtcttggtgtatagggaaggaatcttagtcctttgttgacttgctgtggaaactcaggcaattctcagagcctcttttcttcacaagactaacataatcttgttaggattgtccaggaaccagagtacagttgcctgcgctgagtgataatgtagggatggtggtgataattatttagcctccttttagcaatgtgtagaactagtcttttctggaaaaagagactggaaaggtaaatcattgatgtgtataagaaaaaccattaaagacctcagtaggagggtcaagtcacacggtgataccagcccacaaaatgcccccatctccaacttcggtaccttagagtgccagcgacatgcgacattgctgggatgagagcctagatctcaatggtttgactgctgtataacttagcgcaaactgttttcatatttttgaccctcattggtaaaatgagattgttggattatactatctctaaggtttctttccccacaaagtataaaatcttgttttatatttgtttcaagtaggaaaaagaattgccttctaaacagcaggcagaagttaaaacaaaatgcacataccaaatgcacatatctctgtttttcctagaacagctttttttccctcctctcaatttttagtttactataccttgctacttcattttatgatggtttaggtagcttagatggccagagtagactggatattcgagtagcacaatatgggcaagagtgaatacataagttcttggctcatctaattgttagtgtttttattgaataaaactgccctagaagtacaccctgattttttttaaaatgagagtattattacattatttaagataatttcattaggaaagtttattgtaattgggtaacaagcatctcagaattgagattcctttgttatatggaaacccctctttaaaagttttcttagacatttttctctttagagtgctagcaaaatgtaatgacataaatggacatcactgttttcttgatgactccattaaagaaaatttctctttgatggagaaggttggcttgtttgtgttctctgtccattctagtcatctttttcaattgctcttctgttgactctccttcaactttgctttcacactgattcttggtggtgtatatagttcttcatcagtccttgccctggaccagtcttgtgttctcttaacgtctcattttcttcccctgttggaattttcaaaatttcctccgaattaataaaatcagaacttttcagcattgctaggtacaaaagttttccattcccacacgaggtttaccctttccctctgcatgggctcagaagatgcatgcaaggtgggttcaggaaacacatacaaataaaactgacacattatagaaaatattgcacatgtcaaatacatatttgttttcttgagattggttttgattctggtgttggtagaataaggtaatacgtgatcactggaaaaaatattataagccagaaacatagaaagggagtccctcatgatcttcagcctccagactacttctgctatgccagtatcatctctgtgaacagtttggggaatatctccatgttttctaagccatgtaattacatatttatagttactcctttatcattcattttattttataaaaatgagagtatgcaatggcttgcttttttcacttaatatatttttatattattccaccttattacaaattggtctcattcttttcaatggctgattgtatgattatatggatgtcctacagtttagttcaccagtttcctcctcattccatttacttatgttttcaagattttcagtactttacaagcatagacatagggaacatccatatacatggattttgtatacttctgccagagaggatattaacctcattgtgttgtgtgtgttgcacatattattttctagcttgtcttttggttttgctgctttttactaactttaaatatgaaagataaataaaatgatgtttctgaggttggccacactatccaagaatagactcagattttataagcaatctttgtttttaatgctgccattttaaatcaccgtgaaggtaattaatgattttggacaatgaccatcttaaaatggggcatagaatttatttaaggtttgtcacagtaaaaactatatttgagattgagtttccttaaattgaaatttcagtttgggtcaccattcctgaaaccatttctgatacattgttgaattacaagagagttattcagtgatcaaattgacacattaggaatgagaattcaacatatagacacatggctcttcaaattcatcatcattttcccgaaaactttttagggtaaattgagattatgtaaatcaaattttaatgtgtactttcatggaattatgaaagagatccttttgtaaagcaaataattgccccgtaattcagctggtaaatatgtacttaaaatatgcagtacacctttcattacgttgtttaagtcttcaaatgaaagttgcaagtaaaatctcagctacataatattatatttacctaggatatggggggaggtattacagattccttattccttgcctgtacacccttgatttggggagatttgagaaaaatttaagtacagtctgtaatcctatgaacttcatatacacatacaatctatgtgttatattaagtcttaaaactaacccaataagctttttttcttcctggctttgtagtttacttcacctcgcagtggtatcttctgagtaaaccatcagtctgtgcttagttaacatgtggtgagtgaagaacaatgtcttgtgtcttttgtgcaaaaatcaaatgtgttgcctgatactaaccattttgctggaattcttttgctcttgtttaataaatatatgattatgctatgggttaatataagtattttctgttcattctgttatatggatcgataatagttaaaaattactaccaccagtaagagttatataattttaggaaatttcatttctttaaagagtaattgaaagtttgaaaattgctctttgaaattttgttaaagaatccaaaaaagtatttatgtaacttattttcccttttgtttttaattttccaagaatgatctttgaaattatgattgtgagagagaaatgaaaaatcattttctagataaaaatgaagtggtatattccgtgagaattcaaaatcctgtaaagcctgagtcaaggccagtcagaaataatgaaaactagtaagatcaattttaaaatatagcttcattacttcctgaaatcagacagtttaacacaagacaacacatttgtcctgaggagaccgttaggcagcctactttaattgaatgtgattcttcctgattaacatattacagtgaaatgcaggcatatgaaatgtttcaacgcagttgactgtcttcatcatttaaaccctctcccctcatctctatgtatttttcatgctattaggttgatttagcaccctctgaaaatgtaccatacatctttacctcagcctttgctagaattttcacaaaatcaaaaacagatcacaattagtagggcttcactataattaaaataaatactctcagtgattgttaatatccagctaataatagtatcaaggtttaaaatggcaagatacaacatttctccgttcttttaagcttttatttatttatttatttatttatttatttatttatttattattttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttttttagtagagacggggtttcaccgttttagccaggatggtctcgatctcctgacctcgtgatccgcccgcctcggcctcccaaagtgctgggattacaggcgtgagccgcgcccggccttatttatttttttttaaaaaataagtaaagcctttatcaccctggctggagggcagtagtgtgatcatagttcattcctgtgtcagctcctgggctcaagggatcctcccacctcagcctcccaaataactgggactctaaggcacctatttttttattttattttattttgtagtgatggtcttgcataggctggtctcgaactcctgggctcaagcgatcttcctacctcagcctctaagcttttttttttttttttttttgagacggagtctcgctctgtcacccaggctagagtgcagtggcgtgtttttggctcactgcaagccccgcctcctgggttcacaccattctcctccctcagcctcctgagtagctgggactacaggtacccgccaccatgcccagctaattttttgtatttttagtagagacagggtttcaccgtgttattcaggatagtctcgatctcctgacctcatgatctgcccaccttggcctcccaaagtgctgggattacaggcgtgagccactgtgcctggccctctaagcttttatctttaaaaatcttctgtgccttcatttgagcctccttttgattttaatatatattatttgatttgccttagcgattatccagaactgtcttatttttgtcatccacattacaatggctggcagtacaatgcatggttttattaggttactttgataataaatgtgaacattgaaaaactgtaaattctatagctaacccattaagtcttaatgttttccttttaaaataatactgcattgtacttgttattattgcagctgaatatcaattatcactggaaatgtatattgtgcagcatttctattaattgattaattgattgtctcctcaacttttagtttgaaacatttcagacataagatttgcaaaaatagtacaatgaacacccatatacccttcacctagtaatgtttggccagattttctgacttgctgtcactcttgttctctctccatttatattattccccatttgtaacatttggcaattacttgccgacatgcttgcaagcatttgacaattgtaaacataaactaagtactttagcatgtatctttaagaacaaggacatttttctacatacagtacagttattacactcaggaagtttaatattagctaatactaatatatagtacataatactcagttttttacagttttccaaataatgtctcccataattttttagaatccaggatccacttgagatttcacattgcatttagtggtcatattttcctagtcttttttaaactagaaaacgtctagcttttttgtttttaatgatgcagcattgttgaactgatcttgaattttgtttcccacaacagatcaagctacggtttcaaaataaaaactgacaaggaatttacgtataacagaagatcttgttggtgtcttctttaggttcctaggaccaacatgattattgaactagttttataaataatatactattagtagtacattatgagtagtgaaatatttgttcatttacaaattcagaagactaaaactccccctatccacttaatatatatggaaagtttgcctctattaatcttacttggtaatttatttttatgggattttaaactcatatcttgatgtgactactggttttagcattttcttttccttttcttttttttatatttgagacggagtttcactcttgttgcccaggctagagtgcagtggcgcaatctcggctcactgcaacctccacctcccaggctcaagtgattctcctgcctcagcctcctgagtagctggggttacaggtgcccgccaccacacccagcttattttttgtatttttagtagagaccgggtttcaccatgttggccaggctggtctcgaactcctgacctcaggtgatccacctgccttggcctcccatagtgctgggattacaggcgtgagccactgctcctggccagcattttcatttgagaaacattatgaggaagactttggctatgtcatagcttttttttttttttttgccccccagcatggtcacaccagcctagagtgcagtggcgtgaacacagttcactgcagccttgacctcctgggctcaaggaatcctcccgcctcagccttctgagtagctgggaccacagacacatgccaccacacctagctattttttttaaaaaaaagtttgtagatacagggtcttgccatgttgcccaggctggtcttgaactcctgggctcaagcagtcctctgaccctggtctcccaaaagtgctgggattataggcataagccaccatgcccagccagcatttctaattaatttattttttgagacaaggtgtcactgtcgccaagcctggagtgcagtggtacagtcagctcactgcagccttgacttcccaggctcaagcgatcctcctgcctcaacctcctgagtagctgggactacagacacacaccatcatgcctgtctaattttttctattttttgtagcaatgggatctcactatgttgcccaggctgtttttaatttttaaattaaatttcttaattccagatgagacataaatttccacaccaaaatgctgtttgtcttttgctattatgtcatgctgggagaattgcaatttgtagaataatcagcacactggataagaggaaagagctctttctcatctttattttttattgtttttttgaggcagtctctcactctgttgcccaggctggagagcgatggcatgatctcggcttactgcaacctccgcctcctgagttcaagtgatttctcctgcctcagcctcccgagtagctggggttacaagcaccaccacggccggctaatttttttgtatttttagtagagacagggttttgccatgttggccaggctggtctcaaactcctggcctcaagtgatctttccaccttggccttccaaagtgctaggattataggcatgagccactgggtccagcctgtcatctttaattccagtccaatatttgtgagattcagccaagtcagcgtgtttactcctgggttactgtataaactggtagcattcgatatatggtaaatggttgcagttccaaatttcacttagaaatgccattttccaggattgctgactataggttggtttgcatcattgcaagaatgttaatttttagaagatacctttaagatttagtgtttagacaatttctacttttttttttttttttcagaatggggtcttgctgtgttgaccaggctggtctcgaactcctggcctcaagtgattctcccatcttggcctctcaaagtgctgggattacagtcatgagctaccacacccagccttatttctgcctctttactgcagtctctagaccatggaatagaattttatttcaaacttgaaaaaacaaatatcccaaaaagtcaacctaaatgttttggatttttttgccccctttctttattctcttttcctttttcttttccagtcatggctccgatcttcatcttgaagaagagtgacattgggtgactgctgcttggaaaactgtccacacttgctactctttgagaatgaagttgtcattcagggcccctcatgtagccaaaagaccaagaaaaatctggcccacagataagttgcagactgcctttaaaatagattttatcagtggagaaatggtgatagttttttcttcagttttctcttgggaagagttttatgttgtttaaaagatattttgataacttaacctgctttatgggcttacataatattcctttcatccattctttttaaagaacggcttacctttcctatttatttttagggtgattttttaaaaagacttgtgcaatacattttgaggtgaaacttagtggattttttctgataaattagagcatttaattgactattttattcaggttgatctgttgaatatttgctaaagaccagttctttaagctaagacatgtaaaaaatcccaaatggcagtacctcattgtttacttagcttttgtacttatatttttcagaggaaaaaacactactgtaaattgtgaatagccaatacataactgtattgtatgcaaatctgtgattgttggcagtgtcatctctgagaaacagataaataaagtttatttactatataaca

SEQ ID NO: 588 - DNA, 359402 bp, Homo sapiens
gctttctcctgagccgtcggagggagccggagcgcttctcccgaggtaagcggcgctccggggcgtccccccagtccttcccatgctgggtcccggcaagcgggttaggctgggctgggcggggctcggggaggtgtggggtcagcttgccccgggagcccagcttcagggaggatgcagccccggttgccttggtttcccttttcctatcctctcaggcaccttcccatcctccccactgcgtgacgggtctgcccgaggggagttgcccacctggcagccctgcctccgcctttgtttcccgcctggagggttgctggcatgaaccccctccccaggtggagggtgcgggtgatggggcgcgggcgtcaggagcgctggacctgggctggggccgaggaggaggtggctttaatgcagggggacctgtcacatggggaaacgaagaagaagaaatgtagtgtcactttggccagcccgagggactcgaactaatcctgcggccgcgagcggagccgaattcctagcgcagctgtgcgaagagccctcctgcctaggtgccggcggcctcgccggggacggagcctccgtgctgcccgggaggttgctctgccggctggacctggcggttttcaccccagagttgcagcgaaattgaacgctttgagcctgctggaggaatccagagattggttcaggggctatttttttttttaagcagttgggcaccggtggagccggtctaaatgaaagtctacaaaaaccaatttcagatgcagcgtaactgatgactggtaaatggtgaggagggaaatgcctgcagtgaactgcagaccaccacactgagattcttccttaagaagataggggtttttttcggaggaaaggttgtagtttctgcaaacaggtttttctgggggtacccaggaaggttattacttattttcagcatgttactgggttgtggggagagggaaggcagggtctaaactaaacctactcacacgtccttaattctttgaaaagtgtgtgctcgatgaagaccatttggctgccaaaagaggtttgtatgggagtccgggggagatggattgttgcctttaaatcatactttaaaaaggggaaggtatgtccaggaacttaagagcaggtcaagctatggaaagtattccctgcctctcctccatttccccagacagctcataggcaaacataaaaagtcccttcaattttccacgggttaacttcttgatttgttggatacacctggtaatctactctgtaagaaatggttcaactaactcattatgaagatattactgtgttctggactttccacgtaatttattcagaactctttctggtatgagatggataagggtctctctaccttgtcccttggagacatcctgataccttcaaagccctttatagctcttacattccctgtacaacaacatgtttctttaggaaatgacctgatttcaaacctctaaaacacaccccatgcctgtgaaatgcctacacttgccaagaattcagtttactaggcaagataaatatatttttttaagagggaacacctaaatttgttaggggtatcaaattcaggtttatcagccaccggaaatcaaattttgtcggttttctgagatgaatgaaagtaaaagaacaagttgctgcaaagctcatttagaatatcacaaatgaccctagtaaagtgaaatataggttgtcacctgatagacttcacacaaaccaaattagtgggaataatttaaaaactttatcacagttttttttgtttgtttgtttgtttttttttttttttgagacggagtctccgtctgtcacccaggctggagtgcagtggtgcgatctcggctcactgtaacctccgtctcctggattcaaacgattctcctgcctcagcctcccgagtagctgggattacaggtgtgaggcaccatgcccggctaatttttgtattttttagtaaagacggggtttcaccagattggccaggctggtcttgaactcctgacctcgtgatccacctgcctcagcctcccaaagtgctgggattacaggcatgagccaccatgccggccagaaaatttttttttttaagtggcatggagtagaggggagaaaagaatgctgagggtgaggtaggtggcatagtatacacttttattttcagaggagagaaattaatctttgttccataaaccgcaaagggtatgcattgtttgtttggcctgcggaagggaggcagggattttgaaaaggttgggaaacactgattaggttatgcaagggacaacaaaaagattaacaagcttagtccatctagcaacgtacttcagtgacctataggacaaggttttattctctgattcaataaaagcccactagtgttgctttcaaagcagcaacaaaatcatttcctttctgtcgtttctgtcccctgggtcagggacggggaacatagagagtgaatgagagagattagagtccgacctgcatgcctaagcagtagtgtcctctgaggaggatctgtgtcacattgtgtaagtataagagccttcatattgagagggatctgagtaccttccttaggacacatgctgtaagatacagctggataacagagccacaggtgggggcactgggtgagatcatctgatagggaagcattggggaaagaggagagccaggaaatgtttaattcagtggggctctgctggctgcttttggatccttgaggaggcatttcaaggcagagctgcctcattggctagcctggctggctttatgtggcttccagaggacctgccattcacaagatgaaagctcctgtggtagttacacgtctcaggttgtaagcatcagttatgcttgtaatgtgcttgagaaaagaagggctcacagagacctaaatctaggctgccgttccttcacttggctcatgtcaccccccagggctcccagaaaacaagttgtaccctccttaccagtagatggcactgctgcccctgggaattcctggaggagctgaactatggagctggcaaaccagcagtgtgtagcctctagtcagaagattttgaaaggctatgtcagccctcaaacgaaatctcaaagaaaatagttctgaaagccataactgtttacataaggtaggaataacgtgtgtcatggggattgaggaatggctgtgattacattgactgtacatgtgcgtttctgaagggagaaggcagagagtaaactgacaagcatcatagcataggctttaaacgcacccggcatatgtattggttaattaaacataataatcatgatttgatccaactttccaacaacttaatcgtttctaattatttgcatgtgaagctagtctacacacatggatgggactatggaaatatacatgtgacttttaaacctgaacagtagctggtaagtacatgctctgaagacagcagtgagagtattagtaaaaataatgctgataaagtagtcactatatttcagggctgtccacagaagataggtcaaaacaattcttaattcgtttcttctaaaacttgaaaattcctaatgtgtttttagatcttcttagttaatgtggacctttcaatattatattagcagccccaaacttgtgctttggttttaatgatgttattagtcagggttaattcatccatccacctattttgaaataactattctttgttctctagctgttatttactgttctttgagatgggaaggttatagtgtataatgagggccccggctttgactctgcctgaggtataggatgctacctctaggtgcaattaccccagtcacctgctgctttgtgtagttcccatcctatggcttaggttatttgaggtttctttctgtctctcaagtgaactgatgagcttgtctttactaccaatgctaaatactaaaatcctgcttgtgctaggtagtggtaggccaacagtccattaatgccatcttattatgtgactaaaaataaatctattcacctttctgaaccttacttttatcacctgagattgatgagatggtggatgtctcttaaaatctcttccaagtctaaagttatatggttaggtgattctcataagttatttctgaagactaaaaattatttataaaatattttcatactgtgagcttagggcaaaaagaagtcttgctaatgtttcctcccagaaaagtggttgtgcattaccttaggatcctaacagttcagagtaggaagaaactcttgaagatgatttaacttaaccttctcaatttatagacagctcagttcagagttgagtttcttgaccaaggtaacagagctagttagtggcagagaactagttagaggactaggatgcaagctcaggactcaatatagttttcccttctccaatgctgctttatttcatctgccatcaggccacagaatatgctgtgtctacagggctggggccaagaaaattttctgagtaattccttaatgtagggctttaaagcaacagcatgaatagctttgagttttggcagaagttcaaggtcaggcttctctttgcagctcattcttttcttcactgattgattgtgagcaggatttttcactgcgcatctttaggctttaaaaacttttctgcatatgctgtttcctgtaagaaaaaactttcatcatcctagaagaatcattcctcaatcagatgttcttaagttgggtccatggactccccaacatctctctggataggagaatctttcatataattcacttcatttgtaatcttatgtatttgatcttatacatttcacacataattctgagaaggaggtccttaggcttcaagagactacaaaagaggtctgtggcacacacacacaaaatagggtaagaattctgagttcttgtctgaggagctaaaagacattagggtggaagagtgttaggggtaagatatggggtaaacttattgaagtttgtaggaacatttttaccttttaaaaaattgctcactaaatgatgctaatagcattttacccatcttaaattaataatgtatatgcgagtattgatttccatttatcattccttcctcaataagtactctttcctaattttaccaaaacactttcaaattcatgttgctttattggcgatgacatgcatactaagaggctcccttctcccccaatctgacttgatttccagatgttcagttcccttctaattcatgacttggagtttttgacttctgaggtagtacacctcatgttcaactctaggctcctaggactcaccatgatcccagagaggcaaaataatttacatgctaggaattaaaaaaaaatccttaggttcctttatttgtacccagggtttaccacagaaattgctgctcctccttggctaattattttccttttctatttgtaatcccaaattctcacttttcctaattgtttccaaataagagtgactgggagtttgtatgtattggaaataaaaatccttgtttaaaacatgcaaaatttttgaattttgaagaacatttgcttgaaaatctcttgctttgtgtcctgtgacaccttgcctacttttggtgccatggtgacccatgttggtgaattcacctgctggcatctttttggctatgtatctttttggccaaagtaatatttattattgctttagtagaagaatagaaattaccttttcttctttagaaggttatatttgggtttatgtaataacctaattatgttatgtaatgtcaattttctgcattctaatctcagtatattgctgagttattttgagattttgggggcatgattgatttctctgagcttgtttccttgtttggaaaataaggggagagagtaggagagtcgtgactactttgtttcctgttccaaaatcctgtgactctaagaaattgtacctggtacccagactaaacatatcctaaaaaatgctgcctaattgggaatttatttataatcaattagtgccaggataataattctttatatctgcaaatcattttatggttttcaaaaatgttctctaatcctgtatctattttctactcaaaatgccaaaggacaacagcatcagtattatgtgggagctggttagaaatgcagaatctctggcttcacccatgacctaacaaacccgaacctgcatttttatcaagatgccttgaggatgcacatgcaccttaaagtccaagaagttggtggctcgtgcctttgagaagaagctggtgctttgagaggctgaggcaggagaattgcttgaggccaggagtctgagaccaccctggataacatagtgagactccatcactatatacatttaagaaaaaattagctgggcctggtggcacatttctgtagccctaactacccaggaggctgaggtgcgaggatcacttgagctgaggagttttaggctgcagtgagctgtgatcacacagtacatagtgagaccctgtctcttaaaaaaattctgaagtgctgctttttttttttttcttttttttttgagacggagtctcattctgttgcccaggctggagtgcagtggcgtgatctcagctcactgcaagctccgccttctgggttcacgccattctcctgcctcagcctcccgagtagctgggactacaggcacccgccaccatgcccggctaattttttgtattttttaatagagacggggtttcaccatgttagccaggctggtcttgatcgcctgatcttgtgatccgcccacctcaacctcccaaagtgctgggattacaggcgtgagccaccgcacctggtccttttgagtcttacattggccctatgagagaggaacagtattttacagttgaggaaactgagactcagagtagttaagtaactaagtcaaggttactgtgctagtgtctcactcagaaccctctactctaaacttaatgctgtctttcttcatgattgggctgaagtcacttttgtacaatggagtctggtcactgccctgcagcccataaggttaagtgtgactgtgtaattgagttttagccaaccaacagaatgtgatggaagtggaaaagtattgtgatccacttctaggaaaaaaagcacagagaatgctcatgcaagcttcttcatactgttttccattcttagctgactggaatggagaggacccatagggcaaccttggaaattatgttttaaacatggcaggacttttgtcagcgtgggtacctggatcactgcattaggtccaccccacctacatattcacctgtccagtatgcatacatgaatcagaaataaatttttattgaacttgagctattatacatgtttgggtaagcacttagtctactctcatattcacttcagcagtgacttgggacttgaagttcctttggcctaatgcattttttcattttcatctttgccagttggtgatagattggtggtcatccaacatgcagaaatgaatgagcagtgaaaagcagcagagccgatgggtcatgaggatgtaagtgcgtttgaaggcttccacaccctctactccagggtaaggcaaaggcattctctgccattgtttttcttgcttttccaattcatagaggctattgtctcacctgtctcttggagtcagtgcaatatgatgccctgtctgtgaaaggctcctaaaagcctttattgattcaactcatagataccatgcaaatcagcagttatgaagagaaaaccatgaccgaggtgatgggatggaatctatgcatggaaatatttcaaaacaggagtttttagtgagttcgtttagggtgtgatttatatgggaggggctgttgagccctcttgaggtgcactgtaaagatgggaacagggcctgattatcatttccttatagccatgtcatatgttagctctggtagctcctgtttccctcacctaccaccttctttcttctttgattactctgcttaacttttgcttcattaatcacttttttagtgaaggaaataacttctcaaagtgttgaaaattccagatttggtgtataatagcactagcaaagtacatggttttgcctgttccattttattttatccagcatcactggaagtcacatgcccattcatgcctcatctatttgcagcccctagtacaatgcatgtgggcactggcaatgttataaccaaaactggttttgaattttcacttgtgctgcagatttttgagaccagaaggagaaattaactgtttggtgtggaaaggacatcacatcctttctgagctctccaatttctagagcttaaactaaaaccagcctccttgaagggaaaattatgattcatataaatataagaaaagctgaggatggttaagaatgagggataggaggttaaagaaacatacttaactgaagggttgttttaagcagcttggctcaatactgctgaacctttgctagataatgtcccattatccaggctcagacagagggcacccagaaaaggctggtatctttcggggcctcatgtggctcagtaatgagtacaatttactgaacaaaatagacaattagaggatggagatctctggagattccaataaatgtacatcattattgctctaaagtgatgcacatgcttggagataaagcaaagaaagggcagctgcaaagtacgtcagcagaagagtccaggtgagcagcccgatgcagactatagctcagcacctggaggtagctaagaaaaggagctggtcttttctagattttctcattaaaagaaaggagctggtctttgctaactttgctcaatttcctctatatcctgtatatcctgtattttaaaagtatatcctgtatatcctctattttaaaagtaactaaaaagtatagcatgtcagaaatagcacttggctggtatgttgctgtgtaaatactatacaaggactacattgtggagggagccattctttaattattgatttggggtcaaataaagtaatgctagagatgccagtggaccagagttagtttctcaaccttacactatttattgacactttgagccaggcaattcttgtgtggagtgtcctgtgcattgtaggatgttcagcagtgtctttgacctccacccacgaaatgccagtatctccctccctgtttgtgacaatcagaaatgtctccagacattgccaaatgtcccctggagagcagaattgcccctggttgagaaacactgctgaagggatatagtgattcaatcttgctctgaatttctctggtatcgtattttaatcatttaacttcattttgtttcactttccctatctgtaaaatatacacacataaatagctaaatagtctaatgaagtaatgtacatagtactgtgtgactccttgggggctctgtcatttctaagaagcgatattcgtcttcccaaatttctaggacccaagggtaattcttaattcttgtgatggcactaactgaggaacagtggagtttgaagaagggcgaaggtctgtggtatgggaaataatgaagaatgctggactcttgagtttattcaagggcttcatgttctggttcattgtgataatatattctggatgaaaactttcctttgcaaagttaaaaaaaagggaagagtggatgaggcagaaagaaggctgttcaaaagagcagtcaaggaaattgcatttgacaaggtgatctgctaatgttaaagtgactcatgtataattagaccaaaggacataaagaaatagcctccaaaggaaaactatcgtcccaaatgactgctagtccagatcagtttttgcagacaatacagtaaagaccagagaatgtttggagatcagtgtttattctagaaacttttacatttctatttcttctcttctttaggaatatggaaagggattatctttaatatatgccctttgaattataaatgtaaatgttttaatatgacatgttcttttgacagttttctagtactatgtgttggaatggtcaaagaggccataactctgacctagacctgaagtgtaacctgcattattttaattaaaaggctcagtttaactctaaaacaaggccagtgcagggattagatgtaaactgtcctggcaggtttgcattcccccttgctgtgtttctggtccctgtgattattagacttgcttacaaagtttccaacaaatgcactgtattttggatctactatgtagagaagccatcatgtatagccttgtttatttgcattcttcatacatttttagccctaggtgttaagcaaaacttataagaatgtttaagaaggattccatgtaccttgaagaaagaggcactttggtgtggaagagaggtgaaaagtgaaagaagctccactttgttaggagtaggctggtgtttgaatgttgaagtttttgttctagtactactcaaagtgtggcctctgaaccagcagcatgagaatcatttatacttgttagaaatgtacaaacctattaaatcaaaatttctgggagtgggcgtaataatctgtgttttaacaagactcccagtgatcctgatggatgctaaaatttgagaagcattgctttgttagtggtttctgacgtagttacttcttacaaatgatgtctgtgtgtgtttatgatggggagggcgcagataaagtatttttccaggtggtcagaacatatataagcttttcttgtgataacctcttggataattttctcaaatgatgccttaagccttttcctgcattgtctaatacagtagccactagccacatgtggctttttcttatttaaattaattaaaattaaattgaaattcagttcttcattgcactagccacatttcaagtgctctgtacccacttgtggttagtggctaccatattggacattgcagatagggagtatgtccatcatcagagaaatctgttagacagcactgttttagcctgtgaagacccctgtttgtcagaaacttacatttagaatgatagtatgctcttgttataacaagacctcaactcatttaaaacagaattgagttttgggcttctccatcctggggaaacttttcagtctgtgactctatcttgctgaactttttaccttgctctggtatctgtctgctacagaaagtgccatgggtacatctctgacataatcaaatccgcagcctctgaaacatttgccctttaatccaaggctgctgagctgtctttttccatttggtctctctatgccctgacccttcgtggtgaggcttgtttgtgcaaggtgtctcttttgatactgcctagagctttacaaagagtctggaagaggtggcaagaaaattttcacctcccctacttccaatttccagcttggctcaaaaaaagtgtttcataagagggtattaatactcagacttcaccgctgaggaattatcccctgaagaattagtctctaaagcaagttttccaacagacatattacagcacagatttagtaattaagccctttggcaacatggaagaattttcagttgatattatgtattaatattaccaatattagttgctcagaaattataattagaacaaatgaaaagatgtggaaatatagacacacaatttttcaaagatataaagtttcctgagcccaagattcttgtgcataggagagggaataggaataaggagtttgtggcaattagtagtattgctggagttgaggggaaggaggtggatagaacctggacttgatccctgaatagtcttaaccctgctgtttttcttttgatggatgcattgcttgttctcttcctgcctttctttctttctctctttaaaaatagtttattcactcatttgtttatttgaacagttttaagttcaagcaaaattgagaggaagatacagatttcccatatacctcctactcctcctactccctatacatgcatggcctcccccaatgtcagcatcacccaccagaatggcacatttgttagaactgatgaacctacattgacacatcataatcacccaaagtttatagttcacattagggtatattcttggtgttgtacattctttggttttagaccaatgtataatcacatgtatccatcattatagtctataggtattttcactgccctaaaaatccttcatgctctgccttttcatatctcccacccctttgcccttcactaaaccccagaaaccactgatttttttttttttactatctccatagttttgccttctctagaatatcatgtaatatgtagccttttcagattggcttattttactcaataatcaacatgtaagtttcctctatgtctttcatggtttgatagctcatttccttttagcactgaataatattccattatctgggtataccacagtttgtccattcacctactgaaggacatcttggttgcttccatgttttggcaatcatgaataaagctgatataaaaatctgtgtgcgagttttttttttttttgtggacataaatttttaactcctttgggaacattccaaggaccatgattgctgcctcatatggtgagagtatgttttatttagtaagaaactgccaaactgtctttcaaaatgactaacattttgcattctcaccagcaatgaatgagagttcttgttgcaccacatccttgcaagcatttggtattgtcagcgtttcagattttggccattctaataaatgtgtaatgatagctcagtgttgtgttgttttaatttgcatttccctgataacaaatgatgtagaacatcttttgatatgcatacttgccatctgtatgtcttctttgatgagatatctgttaaggtctttggactattttttactcaggttgttttcttactgtcgacttttaagttttttatagattttggataatggtcctttgtcaaatatgtcttttgaaaatattttttcccaatctgtggattgtcttcttattctcttgacctgatgtttcagagaacagacattttgaattataaagaagcccagcttataagttctttctttcatggatcatgccttttgtgttgtatctaaaaagtcattgccatacccaagatcatttaggttttttcctgtgttatcttctatgagttttatagttttgtcctttacatttaggcctgtgatccattttgagttaatttttgtaaagagtgtaaggtctgtgtctagattaatatattttgcattggatgtccaattttaccagcatcatttgttgctttgttgtactgcctttactcctttggcaaagatcagctgactatctggatgtaggtatatttctaggctctctattctgttctattggtctataggtctgttattttatcaataccatactgtcttgattatggcactttatagtaggtcttgaggtcaggtagtgtcagtctttcaactcagttctgctttaatattgtgttggctattctgcgtgttttgcctctccatatacacattagaaccaatttgttggtagccacaaaataacttgctgggattttgattgggattttgttgattctacagatcgaattgagaagaactgatatcttgacaatattgagtctataatgatcatggaatatctatttagtctttctttgagttctttcaccagagttttgtagttttcctcatatagatcttgtacacattttgttagatttatacctaagtatttcatttttggagatactaatataaatggtattgtgttttttatttcaaatttcatttgtttattgctgatatgtaggaaaacagttgacctttgtatattattctagtatcctgcaaccttgttataattgctttactagttccagaggttttttgttgattccttcagattttctacccaggtgatcatattatatcatctgaacaaagatacttttatttcttccttcccaatctgtattccttttattttaatttaatttaattttattttattgttctattgcattacccaggacttctagtacaatgtttgaaaaaaaaaaaaaaaagtagtgacagtgcacttccctgctttgttcctgatctcaataggaaaacttctagtttctagtttctcaccatttaatatgatgttagctatagatttttaaaatgttcttttccttttggtttgcctttcttacccatttttttctgccctaaatgttggagggggctcagttttctcaaggggggtgctattagcattttgatggaatgaatcattgttatgtagaattttcctgtctgttataggatgtttgggctctctggtcacaaaatgcccatattattctaaccaagtcattgtgtcaatcaagatgtccccctacatttccaaataccctctgattgagaatcactgactgctagaaagagatgagtttgatgggttttctgtttgtttcttttttgatggggagagggaggagtaattagagtcagggaagatgcaggtgctctgagtgtctggttcattaatttctaatatcacctaatctttccccggtgctggcagtgctgttggtagccaatattattctattgggatcaggagaatcagggtctcctactgcaagacttgctttcagaggcttgataccaacccagaaaccacagggggttgtctgtgccacagagagtagaggaactactgaggctcccacaagatgctgcatttttattttgattcactgcagctaaatctcctacatctacttgaaagtagactcttgtctacatgacagtgatctactgagggaaaaatcaataagagaaatttacagacaatccaagggagaaaggctttgccagccatttactttttttctctgtgattgcacatattggcaaagtagcccctaaatttgtgaggttatgtgtagactattgagaggtctgagaattgttctacaattagcaaagaaaaggagaacacttttagacatcttgccaaggggcctacatagcctattttgattacaagagtggaaactcaagttactttaaaaaatggaaggcttaactaaagatgcacgagaaaataaggaaaacagaatttcagtcatgtggcaagtctgcaaagaatctcaggggtttttaggatgagagaatagtctggctggacctcatggagtcaggacttaggagcaggaagattgttctgatcttttgtaactccagggtgtgtctgcactaacagtgttggtcagtccatattctacttttagatcattaatgtggttcagcatttccattttagattctctcttgttcctcatgttcttgcttccatttatcgttcccacaacctaaccaatgatctgtgtatagaccaaactccaaaagaagaaaaggagtatgataggttttgtagtaactatcatcctgatggttaaactttataccatgcaattttagagctgctgatgctctctcctggtccaaacagctgtgatttaagggtatttgctttagtaagggctatgggcctggcaatttctctagaagaaggtaatggtggggtaggctgagaccccactggggtagagcagtgctggggtagaacatgagacctcagtctagtttaattaccctgaattcttaactcttggaatcaatataaatagtatttgtgggttatatagacaacaaagaactggaagattattcagaaaggatacatgtttagtagcaattgtgaaaaagcatgaatctgtttttttgagaagtctgattctatcccagtgctgagtggtagggaaattgctgggctggatgattgggaaatggggaattgtatttcccatacagatatcttattttttatatctgtcaaatttgattcttatggccacctgtgtgttgcacaggaataatggctaggtgactttctaaatgttgaaagacattttgacatcttcgacaagtgttgttcaacagctgggtttgtaagactccagttgtgataaaggaaaataacttggcttattactgtaaaaataagttccatacaaatgttgacatttggtggattactacctcacatagtgtgttttgttcactttctccctgaacttggagcattagtttcatttgagccagtgattgagtgtgactttataagggaatgcattctaatactgcagaaggctctgtctttatttatgactctgtgtcagggtaagaatgatggtcctggctctatttggacctgcacagctgtgagtggagtgacccatggcagcacaaacagcccgtcatttcaatgaattatttaaggctcttacacttcccttcaagtagctggatcatggtggcaccacatacagagaacaagttagtgtttccttagagaaatgcagcttttgttgaaagagagtctgaagagaagagattcagcagggcttcttcaactgctggttgaggaaagaatgtagtttgttactgaagggtgatggagattgggatcaactttctcaacccagctgctgactgctgaggtgaaaacagcagagataaaacatttgctccagtttctcttcagactctgtgaagatccccatcccctgtattgaatttttaaaaataaaaagcaaaaaatatagaattgtatctaattggtcttaacatatatccatgtttcttctgaacaggaagatttgtatgtagataaccacacgttgccagaagattaaaatcttcaattttaactttaaagaagcattaatcttacagtataagtgaaagattaactcaaatttgtgcatatataatttttctacaaaaacaaaacaaaattatgtttgttctcatagaatcaggaattaatttgaagcccttgttgaagattctttagcaacaataaagacatctgctctctccagggtatagagagattctgaaagatggccaagagccagggatcctgaatcctttattcccatcctgccataggctactccccatgaggttcctgcaggataaatgtgcacggggggtggtggaggcaggactttggatgcagatccctgagggcctaggactgaaacccccagccctgaactgccctattcttcctatgaaccacagaaagaggcagctcctctcagcctttttctttccatgcccactgttgaatctttgccttcacttttcaaacaagcaaagctgtggctgatgccatgtcctcaaacatgacccattcctatcagcacacccctttagagggcccatcacagacaaggaagaaggcagacagggaggaatatgcttccctgactatcaaaagctgtttcttttccactggaaagaacttactggatcacttctgaaattaattattgtcattagaacagtatttaccaggcattaaatgttagacattatttagagactctcaacttagaaaatcatatttttactttgagagagcaaaatcccatattaatacagtcctggattttaacttttggtttcctctggtgtttctccacatacccctccattttttccttccattaaccctgttaccttaagttctttagtctctttgcctcaattcttatatctttattttatttccagagttctatggttcccacctggctgcaggacaaggtgctttataagttggcataaagacacaggctgattccaacttctctttctgaatttctttctactctttctatgcgcaaacatcttttacccaaactggtccttggtcccgttctctcctccctgtgtacagtgctcctgtttcttttcagtgaccgcttggtagcattgatagactttgagtcctgtggccagatagatctgcatttctatcctgtccctatcattttttagaaatgtgactttgggcagaatatttcatttcagcctcaatgtttttatttttagaatgggaatcataactaccttatgggatgcttatgggcatggtacttagggaactgtcctgcccaggttctattttctgccttttcatcccaacagtatgcatacgtgcttgctgatgaagttattgaacatcagaattccagagctggtctacatcacagttcgtggttagccattctctacctgccactttcacaccttccctaaccacatcttcctttgataggacctaatcctatcagtgagcatctaaagatacattttcctccttctacctatgatcgtgaaaactatgttcatggacattcagaatgtcctggtatatctgcccatatcagaaattgacagcaatttcatggccactgtctgcaaccttgagcactaattcattttctcagcatttgtttcctttcatgtaaagtgagatttatcgtgaacgtcgaatgctctgattgcaaagaatacctctttaaaacgaagttttccaacagctttttattctgagtatcatttaataaagtgcaacatgacattaacaaggttgcttagacaagccctcggagtttatttaagtagactctgccccatattgattcccaattataacatgtttagcatgaattaaacctgccagtgttctcagacaatgtgatgctctccctgcaattctgccctcgtctgtcagctacaagagtgtcagtgtttccttgttcattctatttaaaacgtaattctcaacctcttgctcaaatgatttaagccatatgtgaagtctataaattttgttttctcagacgaccaccttctttcccttcttactatttcttactcccttttctctattttccttattgtctcatgtactaaaataagactttaaattttttttctactcaaagtaagaataacaatgcttatatttttctagtttgatctactttttagtaataaatatgggctattagttgtgtgtgtgtgtgtatatatatatatatatatatatatatatatatatatatatatatatatatgtgggttttcatggaattaactttgtctctttttgcccatgagtttattggtgagaagacacaagtataactgttggggttcttctgcattctttggttattcatgatattgctaactgaacctttactggttgtttaaattttgtggtcatgtgtgtttttaccataggctcttgagggaaatatataaaaggccatgggaaaattggtggtatgaaaaaaatctatcagtatattcttctcagatacccttttcgagaaaaattaagatactttgaaaaagattcataatcagaaatattatctagtttaacttttttgaatggagagattttataggctggcaacgggagcttctgacttttcttctgcatgagcactgatgatggagggagtgactgtgtttgagtgaattttaggtagaagaaagggagcctggtaacaacaaactgtgagactggttgtattacgttacttgttaatccttctgaaggagagataccagggcctctgccctgcatccttccatgctagaaatattcatagttggaggaagcaagaaatgcagcccttgagcacgttggatttttttttaactattgattttgaaaaaaaaattgtttttgtaattatgagtaccaggaaaaaaaagtaaatgagaagagagatgtatagcagattaaatatgtggctgcctttttgacttgtgtaacatcagatatcccactccaccttcatttttaaataaacctctctgtttcttgccctttcagctaatcagaacttttctcctgctctcccctgttgtctcaggatttaggaagagagctgatgggattgggctgggcctaggaaggattgacagcacctctaagggtttgctcctgaggagagaataacttgcctcttgctcctcttcaagcctcagacgggagctcacccccagcctagcagttaacattgctgctgcagtcaggtgtgctttctctgtccaccttttctgtctagggttcccttcctgtcttttgtttggctgtgagacgtggttaagccctttggctactcccgtgcctacaggccctattgccctggttggaagggatggggtgggaacgcacttgaggggtgagaggcccccagagaggagaccaagaggtgccaagggcaaagccctgtttcacaattctgttccaggcctccatgtttacctggctttgcttcttaggctgggggactttgttacttattagaatttttttttcctcaattacatattttgtttccccaattagataaggaggcctctacaggcatggatcctgccatgtgcttctcttgtattctttgtgttgcctgcactgtgagaggcacatagcaggagctgagatatgggggtttcattgcattaataatgtctctttgtagttgtgttagggctcttacaacaaagactgggtggcttataaacaacagaaatttatttctcaccgttctggagactggaagtctgagatcagggtgccagcatggttaggttctggtgaggactcccttccgggttgcagactgccagcttctcattgtgtcctcctcacatagtgaaaagacagcggactggctttctggctttggattacaagggcgttaatcccatgtgtgagggctctaccctcatgactgaatcgcctctcaaagacgctacctcctaaatgcttcacaatgggggttaggttttcaacatatgaattttgggggaacacaaacattcagtctgttgcagtaatttgtcttattcattccctttaccttcacttacttaccattcttatatatttttttaaacatatatttagtaactacttgcctggttcttgctggagtgacttttttttggaagggtccagattctgcatacctccaaagcagtctgcctaagattgatttgtccatttctgcctttatttgttgagttgaatcttaaactttctctttcttataactctgtgaagaacctgcaatctcaggaaacatgagctccactttcgaatgaaagggctttactactaggaaatgagagaggcctaggttttcttctttcagacctcgcataaattggctgtgcggctgcggaagagttaggtcgcctctctgtatagtgtattctcagataatgtgagttaggctcataattgggaagtttagtgtaactcctgtaactcagattattctctctgttacttaggttctccattacatacaaaaatcattgtttttgttaaagttgttctgttcctttgttctagttgtttaatgcatttttcccctggccagatcattttttttgaggagcaaggacaagagctaattctcacatatccttggctaccctttttctccctgtagaccaagcatgagagtccattcaaagtaggtgatccataaatgttttaacctaattagacacaagcatttttagaattcaagaggaagaaattccctaaatacgttagcatttaagcacatcgtagaggtcatctggtttaccacctcattttttgatcatcagtttatttgttctattattctctccttcctttcttcatcccttttgtgccaggcactgtgtgaggagcaggggatatgaggtgaggatagacatagaacttccatcaggtggagaggatagacattaagcaagtatttaaaagtctgaggagagctttaagtaccaaaagctacaaaagcccatgttggggagctgccttgtggtctgagaaggctgttatgaggacgtaatgtttaagctaaggattatcaacccagagaagggaagtagcttgcccaaggtcagtcagtagctcacacgtagtagagcatggcctgtagcacagatttctcccctgccctgggcttatccctatgagttttgtgggggtgctgagaaaacttcattgttcaagtactttgattttgcatttcactggggcatatggcttagctattctatgaatagcttacagtttgataattttatggactgtttgtataccccccaaattcatgttttaatctaatctccaatgtgatagtatttccaggtggagtttttgagagctaattaggtcatgaggatgaaaataccttctagaatttgtccaccaattcaacttctagtatttgtccaacttctagtatttgtctatgctgttatctttctggaaggcagtttggcaagatacataaaagtgtaaaatgtgtgtacaccttgacccagcaattcagcttctagtatttgtctaactgcatagccatgaaacgatacatgcacagagatacccactacatatttgtgtttgtacgaaaaaaaactagaaataacctaaatacctattagtgggagacttgttaactaatttattattaggaaactaaatacttatacaggtcaactgtggaataccatatgatttttttaaatgatgtagtagttctttatttgtttttaatggaaggatatccctgacatgttatttaaaacaattctgatcacagacaacataaataatatgagcctatttacataaaattgtttgtaaatgtatggatgtatatgaacatgcaaggcctgttcaataaaatcttagcagtgttttttccaagtgatttttagttttgtttcggcattttgctgtgtcatttgaatgtttgtacaatgggcatgtctcctttttttttttttttttgagacagagtctcactctgtcgcccaggctggagtgcagtggcacgatctctgctcactgcaagctccgcatcccgggttcacgccattctccacctcagcctcccaagcagctgggactacaggcgcccgccaccacacccagctaaattttttttgtatttttagtagagatggggtttcaccgtgttagccaagatggtctccatctcctgacctcgtgatcctcccgcctcggcctcccaaagtgctgggattacaggcatgagccatcgtgcccagccgggcatgtctcattcttaaaagtcacaacaatatttaaaacatgcattgccctactgaccaagtgcttgcagcatcgtctaattaagtcagagtattaaatgggtacagaggattggacattgctttcatagagcatttattaactgtatatgccctataaaactaggggatatgaatacagagaggtgtccttgttccctaggaatttaaagtttagaataatttcaaggctatatgttactaagtaggcatactgcactggtgtgtggaatatgtaagtacccaccaaggagaaattttataatggcatgtggattcagatttatcactttaccttgaggatttacccaaatatgaaaggaatattagtgattgctttgcgttcaagggaaggggtttgggcataatgtgtagacctccagtaccatttaactgagtgttgctaccagttggggcatgtatttttcaaaaggaactagtaatttccttcattggcaattaattaggtatcctaaaaacgtgcaatttaaatctgatagcatggatggtgagtcttctggatggcagtgttggagagaaagtccaagaatgcattttctaggagaaaaggtcactaattagctttgcaagtaaaatcaatgcttagtcattccttcatccagtttttcttttctgatgttcctttagcagcatcatattagtttttgacattggaaaatcataacctgttaacccaatggataaacaatagctaggaaagctttttagagtttttgataattttattaattttctattaacgtctcatctttattgtaattttctttaggctcagagaataaaaacatctgtctctagctaatggaccagtagaacagtctttggagccagtaggatatgagcctgtggtctgaagaatcaggatagatttaaaggaatttggttagtgaccttgaatctttaatgttctctgccacacattctcctcttttatagtcttaccataagaatttgtgctaagaggaatctctggaaacattctaacccaggacacaaactgcctttgaaatctgaagtaaatctcatataaaatgtatttacacataattaaatttgttttagtctaaaatctggtgatgttacttaatgtcagttcatttccacaaagatttatcaagcttctgtggattcaagtgagaatggaaggagaaggtttggagacaacacttctgaggacttttgccaatcacctaagcaatgtgaggttccatattgtggctttcgagtgagatcattcaaaggtgttatgtgtttttctccctctgggccttcatgtgtatgagtggagtgttgaagtgaacgaggccatgtttttgccgagtgagcaggtccacactagagtggggatagagttcagcatgtatggaagggagtggttatgacaattgactgtggaatttaaattggctaaggaggtgaatttggacatgaggagggtgagggacagtgaaaagctgtagtatccaatgggttggaggtctccctggggtcagagacttgctgaagttgtggtatcagagatgggaaactgacaggagatgttggtggtgggagagcaacatggaggaatttcagctaagaagtggtgtgtgaccttggagttagggcagagaacagggactgaaaagccagggtattggaatgatcatctctgtggctactgaattcacttagagtcatggccacaggagtgatgaagagtgacagggaaccaggaacccagatcttcccagaatgagggagagtgggcaatatagtctgattttgtgtgaatcaaaggtcaggattttacagaagaaaggagggacagtggtatagatgtgataaagataacccactctacctctaagccttgaagttcagggaatgtggggagaaaatagtcaccacataggggggctagaggtggagtgagcagtgggatcttgctaatgactataagttccagacagcacagggaaagggtttcaagcattgggaatggtgggtgatagggtcaggaagaggaatggaaagagccatatggtggtaaaagtgtaaggttgagaaatgacttgtgagtccttgagggcttctccttgtattcttaacagggataaaagatatgattaagttagtcctgatattcccaaggctattgatttatagactggaatgggagaaaggacagcacccagggttttgggtctcccgctggactcctgcttgagggggtggtcttatacagagcacatagggcccccatttaaccccagccagaggaggggctgccttgagaccaagcattcattacccctgtccagggaagtataatgaacagtagaggtcatggaacattctcatgttttattcaactttgtggatcacttcacgtatttcaccacatagacagcattcccttgtgccatatttctgattactttgtgcccagtgaggatccttcattcatttattgcttctttccttcccagttacttgtgtttcttttgtctggacagaagaaagcggtaatgtctgccagtctgaggacagagcgtgtgtgatggtgccctgtaagactctattgaattgagatactgtctgcaggaaggccatttagtctaaaaccagttatcacttctcctgagctaaaaagcattcagttctatcttctggtcactccagaagagattccatagtacaagccaaaagaaattaaatacatgaagtgacctttaatctatattagggaaattaatatacgtttaactctttggaagcactagatttgaaattcaaaatgaactccttaataaatccttactgtctccttgtggacagatgcgtgggtctttaatatctttattctttatgtcacagtctgttgagccctaaacatatttgtataaataaagagattcaggaaagatttgccaaaaggacttaattttatttctaattcccctttctggaatcctgcttcctttacaaggatattgtacagaaatgtgattttatgaaatacttgaattgttttaatacttcacttttaaagttccactttgtatgtaagaggacttctcagatttgagtcacaattttcaaaacatagtgaaggaccaaatgggaatataaaggttggttagagaaataaaccttttttttttttttaatggacagttaagcacgtgatagaggttccaaaggtagattgaagtaggggaagataatgctgatgaaataatggtttcactggtgtcccttcattctttacaaataaatctatcctagagatcacttatgcagtatgtaaataataaacacagccaaagttggtttactggtcttttttccaaccagaactttacactgatacttcctctcctctgtgatagagtcatgatcatcagtcctttggaagatctggaaagtcctgagatagcagggtgaaatcagaccccttccagcctgtaaacttttacaaggcacaaccaggccttttatgtcttacatggtgaagttggggaaactatctcaccatttgggaaggcatagatgctaaagtcacaatgatgtgatcctcgaacatagagctattcaatgtgtatttgttggatggattaaattgtcactgcattttttttagcactatgtattcttttttaattctgtggactccaaaagtgtggttgtgtgtaaggatatgtacaaataaacacttacataggtagccacacacacacacacacacgcacatgcacacacacatgcacagagatgttcgcatatgcagagagacacctgactgttggttcacacagttttccattacagaagaatgcctttcccagctatggtaaataagtgcggttagtctgatctctccacctctgacctagttttgatattttgtagctctagttagtataaaagaaacccaatttttttttcatgttccagaaacaggttctttcttcctaaaaataaatgaaaggaccttgacataaggtgcatattttctaattaagaacatctatgctgcatttaattaatagcttctcaaccttatttccaacaagttgttttattcataactgggccaattcttattaaatttaaaaaaaatttatgtccatatggcattctagtggtatgcgcatttgtacatagcattctaggaatgaaaatatcattttaaaatggaaattacaataccagtatgtgcctatttctacatagttcagccattttcaaggcttaaaatgggtgggaccgcacatctgaatttttcagtataatcgttgggttattaatgcatggcaattttagttccgtgaacaaggaaatacactgtgctggagtttcttctttgatgggtaaatatactctctaagttaagtgtaaggattcagagcaaccacaatagctacataaggctactctcttttgcttcattagtgtggttttttgaggattttattgtcataattcttcacatgtacttatattccaattactttactatatttggtggcccaaacgtgacattccttattagattcccattggtctaagtaattcccattacttagactcgtcttttctctatagtaaagactttcttggagcttggaatttaattggtgttatgctgggataactaccaagttcattcccattgccatctggtatgagcctctttagtgttgtgtgtgcctggttgcacagtgatctcttcagtctgttttgtattactatattgttatttataatgtacatctcatttattttataccttgttctagaaaggatttaggatggtttacaaagattcataaaaaataataacttaaaatttaagagtgtaagcaatagaagaaataagaaaaaaaagcaagataataagaatagaacttgaaaaggtctgagaaaattgctggcttttagggccgatattcatgcttttgcatggacacatatatgaagcgttgggcatcctagaaaccatttaaaaaggacctctattccattacgtgatatccttagtataggagcaaaccatttaccttccttcttctatagtttactcagtgtttgttaatctttaaaaagttaatttattatacatagaagagcagttataatgtatatattatttatgaagaataaagtgcataccctctgcctagcttaaaaataaaacataaccactgcctttgaagcccccaatgtgctctttaccaattgcattccctccctctctcccctactagaggtaattagtacactaaaatttgcagttattctttacttttgttatattttaacatctctttacaaatgagtgaaaatgaaacaataatgtgcatgtttttttctgtgatctttgcttcttgtgctcagcactgagattcacccatgttgaaatttgtacctatagttcattcattttcacttgggtaaacatgtactacttatccatttccttatgaacaacaaacaatgctatcaatattcttatttgtgtctcctggtatgactcccttttgtatgtcttacataggcatatatgtgtgagactttctctaggttttagaattaccaatttgttgtgtcatggggataatcagctgtgcatattaagctttactagataatgtcaaattattttccaaagagatttctgctcccactagtgtaagaggagctcgtgtgcttcacagccttatgatacttggcattgtgtggctttttgatatttgcccatctggtaggtatttgatgcattctttataaaggtattgctaggccagaagcctggcaccagagatgagttatatatatcctgctcatcttactcaccagaccttccttcacaacttctctcttgtccctgaagttttccttcatagcatccatctaaagcttgactacatctcacctgctttagctctctgaattatgaatgttcatctgctactacttgcttacattaaaaatttagaacacatttcaagtgtcttcagtcgtggttctctattaattagctcaacacataagttgaataattcattgacactggacctggtatatgttaaggtaagtactttgctctcagagacttttgtctagctaaggtggtgagggccaataggactgtaaacaagtatgtgataagttaaaatgctatgaagggaacatcaggtgctgagatgaataacatggaaatgaactttagctggtgtctcagttttgtgctgctgtaacaaagtaagctgggtaatttataaggaacagaagtttacttgtctcacagttctaaaaactagaaggttaatttgtacagcagcatagaaaaaaaaaagaaactggaaagtccaagagcatggttccagcatctggtgtgggtcatcccaccgtggaaggcagaaatgagcacataagacagaggggaaatcaggctaaactcatccttttatcaggagctcattttcatggtaactaaccaatccctgagatgtaacattaatatattaatgttatataatatattaatgttatataatatattaatatgttaatgttatctcttaaaggtcccacctcccaacactgttgcattggggattaagtttcccacatgaacttaggagaacatactcaaatcatagcagatggtgtggccaaggaaggcctctcaggcaggtgaacttagctgagacatgaccaatgggaaaaggttagccaggtgttgtgactactatgtgtggggcaggttggagggagagaaggaaacagaggcagcacttcgggccaagaggttaaagtgtgaggaacttgaggcaggataaaactggcatgtttaatagttgtaagagggcaggtatggctggaaggcagatgcttgtttggaggactgtggcaagaaattaagaaagagagaaatcttataccacctcctagtcagggtaaggagtatagatttatacttaagggcaagagaaagctgatgaagggttcaaaatgtggataggaaagggagaatgatatgatctagttgaagttttaagataacttttgctgatatgtgaagattggattgaggatcatgatcgagtgatttttttgtgtgttcaaaacaatcacaaaatttcaaacatttgcagcacctgttacctgtgaggatataaagtggggtccttgtcctctagaagttgttcataatcatttggggtggtgaagcacataagaaaaccgttagtactaaatgccaagtgagctgtacaaagaagacttgttacaggattagaaaaggaagaaataactgttgccagaagccatcaggaaaggcttcctggggcagctgtgaggctcaatatagacagggaaggatgagtaaaagttaaatagtagggaatagagaaggcattccaagcaggacaaaacagtgtacatccatgtttggatagaacaaaggaaggctgggaaatgaatttagagagacagagaaagctgttgccaggttgtgagagcccttgaatgacctcttttccctaaagatggcaccaccagtagaatagtgaactaacacacttcacattttcatgaggatggagccgatggctctggtttagaagactttacttaagaatgcaatttctttacaaacaataccattgcatttatgattacagacttattttattggtcctagattaatatcttacaggtctttgctgggtcacatggttgattttggtttggcattgggtctttacataagagaaccagttcttttttaaaataaactaagaagtaattagacaaatgcatgtctagctaataaaataagggcacttactttactccctcaggactccttcgtttcagtggtagtgcaaagaaatggtggaggcagcatgcatctgggggacttattcaaattaactagtataaagtcatatcttttaaggtcttacaggaacttaaggtccagttcagtacaagtccttttatttaaaacccaagctgttctcctctatatttgatcctttatttaatacccaaactcctcccttagcctgcccttaaggtagaattagtggcatcatgtgatactccattctggcttctggcttccagcttccttcatttcttaagactttatatttacccatcatcctgtagccaggattggtgcatgatctgtccaggctttgtctgtctgtttggtcaaagtcccgctgtataattgactcacctcactcttacgcttccaggaatgtgtacattgttcagtctccttgtctgcttttccacagtattttgtatatttacatattctttgaatgtgttcatttaatatatcctatttttattcactatttttactcactaaatgtctttctaaatttctcatcttcctatcagagcccactgctgcatttttgcccagtcttctctcatggctcagtaccatacatcatacctcattcaatggtgaggaaatgtccatgaagaccctaaacagtacagagcacttgtttcttttcctgcttcctctggaagcactgagtgacatcaccagtataataacaatcctgggtcattgccagccttaccacacctttttttcagataattcaaacattttgatagcctgccacagtcacagagttagagagaccctcagagtgtcaagtatgagatattgtgcctgtcttctggaaaggttctggtcttgggagaggagggcttacacaagtgaggacaagagaggagtacaaaatggctttaccaagttatctctgacataaggcagttcaactttggcacttgcagggctgtggtgtacctgctgctgctgcctttctctccccttaacttgtgggcagtgagctaaacaaactgaggaaatttaaaggtggattctccattggaaaaggcttagaaccctagtgcaacctataagcaagtgctgcaactacagatataaaggaaacacataataatccctgaagagtgtattaagaagagagcatgatttaaatctcattgcaacatttcatttcataccaaggactcattctttgtaacaaagcaatgtccctgtcctggtaggcgacccacagaaaaaccattttgtttctctgagtacagtaaactctttgcagtgaatgctttctctgatgtatgtgtgtgtgtgtgtgtgtgtgtgtgtatctgtgtgtgtttgtgtgagtgtgtttaacagtctcttgtcgttaaaaaagaatcgcattctgagctgaagatgggtatgagggtgctagggtactgcagctgctctgaatgttatgttgcctttaaaaaaaattcaacatttgctgtcttcagggaactcccattgaagagatggggacaccagacagcttactaatgcagctctgatctcatttaaggtaggagctcaggaatttttgtttgtcccctctctgttaccagcatattgtacaatgcctggtgtgcaaaatgtgttcagtaggaattcacttttttgtttggaaataatttcaggattttaaataagttgcaacataggctatagagtatacccatatactctttactcactgttttagtttgctagggctgccatagcagtgtatcacagagtgggtggcttcaacaataaaaatggattttgttatgattctaaaggccagaagtccaagatcagggtgtcagcagggttggtttcttctgagccctctctcctcatcttgtagatggctgttttctccatgtgtcttcacatggatttccctgtatatatgtctgtgtcaaaatttcttcctcttatgagaacaccagtcatattggtttagagcccactctaatgaaatcattttaacttaattatctctttaaagaccctatcttcaaatataatcacattctgaggttaggactacaacatgtaaattggggcaggaggatcatagtttagcccataacacccagattcatttaatatttttcctcacttgcatgatgatttgtgtgttaaacatctgttcatattcttgttagccatttgtgtattatctatggaaataatacacaaaatcctttgcccatttttaaaaaattgtgttgactttttttgttgagttgtgggagttctttctgtgttctggatattacccctttatcagacatataattttcaaatattttatctcattctataggttattttttcactctactgatattgttgtttgatgtacaaaggttttaacatttgatgtagtcccatttgtctacttttgcttttgttgccagtgcttctgatatcatatccaagaaatcaccaagtcaaattccaatgttacattttcttctgggatagttttagatctgacatttaggtctttaatccattttgagttgatttctggtatatgatgtaagacaagcgtccaacttcattcttttgcatgtggatgtccagttttcttagtaccatttattgaaaacacagtcctttggtgttggtacccttgttgagaatcatttgaccatgcacaaggagtttatttctgggctctctattccatttctaagcttaccagatcattaggagaatcctgatgacatttgggaaagagatccctgcaaatggcatctaaagatattcacacaacagtgaggtcaatgaggtaaaaataatgattaaggacagattttagaattaagaagtacttattataatgaatatgacactgctaaaacctgtcaagtaaaatatgtaataaagcctcaggataatcagagaatgggttattctctgtttacctcaggatttagccaaaagtgctttagttttaaaccttcattaatataaaattattaaggataatataatataaattattaagtatttcacaagatcatgggatcataactcttatgtcagttaccacatttaatgtagaaaaaggggaacacagaatacacgtggccaaagaataccccacggaagttatttgcttttgctctttaccgcataccttatggtactttttaaagcaggccttctttttaaaataacagctttattgagttataatttacgtattataaaatgcaccttttaaaaaatgtacaattcagtgatttttagtatatgtagaatgttgtgcaactatcaccactatatttcagaacatttttgtcaccccaaaagaaacctcatacccattagcagtcatgccctaccccgtttcccctaagtccctgacaggcagtaatctactttgtatctctggatttgcttattctggacaattcctataaatggactcattctatacgcagccttttgtgtctggcttcttttacttagcaaatgtttccaaggttcattcatgttgtagcatgtcttggtacttcattcctatttatttgtttaaattgacagatggaaattgtatatattattttataaaatatgttttgaaatatgtatacattgtggaatggctaaattaagctaattaaaatatgaattatctcacatatttatttgtggtaagaacacttaaaatctactctcatcaattttgaagtatacagtacattgttgttgactataatcacgttgttgtataataggtcttttggatttattagtcctgtctcattgaaattttgtatcctttgaccaacatcttcccagttccccgttttcccaagtccctagtgtccactgttttactctctgcttctataagttctcctcttttattatagattccacaggtaagtgcgattatgtggtatttgtctttccgtgcctggcttatttcacttaacatagtgtcttgtccatgttgttgcaaatgacaggattctctttttttttttttaaggctgaatagtattctattctctctctctctctctctctctctctatatatatatatatatatatatatcacattttctttatccatttatctgttgatggtcacttaagttgatctcatatcttggctattgtgaataatggtgcaatgagtatgggagtgcagatatctcttctacataccgatttcatttcctttggatatatacccagtagtaggattgtaggatcatatggtagttctattttaattttttgaggaacttccatactgttttccatagtcactgtattaatttacattcccaccaacagtgtacaagagttccttttttccacatccttaccaacacttatcttttatctttttgataatattcattctagcagtgtaagatgatatctcattgtggttttgatctgtatttccttgatgattagtaatgtagaatattttttcatatttgaaaaatatggtcatttgtatgtcttcttttgggaaatagctcttcaggtcctttgccccccattttttaatcaggtcattcattgagattcatagagattagtcaacttttcccaagtaatataattaaaaagtagtagagttggagtttcaagttacttgtacctgtctccaaagttgaggcaggttttttgttttattttgtttaaaatcacaggcacagagagttgagtgaatcctatttcttggtacatggaaccaagaaatagcattttattagactccctcttgattatttacttaaatatttatttccttttatcttcatatttcatttgattcccccccaacaagcaatcattttaatttgttttcatgtacagatgcttttcaacttatggtggtgtgacatcctgataaacacaatgtaagttaaaaatgttgataatgtatttaatatacctaatttactgaacgtcatagcttagcctaccttaaatgtgttcagaacacttacagtagcctacggttgggaaaaatcatctaacacaaagcctatttttttgtttgttttttgagacgaagtcttgctctgttgcccaggctggagtgcagtggtgtgatctcagctcactgcaacctcctcctcccaggttcaagcgattctcctgcctcagcctcctgagtagctgggattacagcatgtgctaccacacccagctaatttttgtatttttagtagagatggggttttgccatgttggccaggctagtctcgaactcctgacctcaggtgatccacctgccttggcctcccaaagtgctgggattacaggcgtgagccactgcacctggccacaaagcctattttataataaagtttttataaataattttgaatcaaaatccaaaattcagagtagattttctactgaatgtgtattacttttgtgccattgtaaaggcaaaaaataataagtagatccatcataagccagggaccatccatacatctttttgagtatattataaaatatgtattgtgttgtattcatgtgttataacaaatcttatctctcttttttcccactaagccttgcaattttaggctctatccatgttgctatgggtacatcaaacctgctgcgtctctttgctgtgcttctccacagagcatccaccacatttttatccatctgttcggccagggatgctcactcgattccctcaagctccccttccccacaaacaatactgctgtcagcagctgcttttgattgcacatcaacattcctctgggatatatacaagggagtcaaattgctgggtcatacttaatttaactaagtagtattggattgctctccaggatagctctaccagacttcgctctactagcagttcttgggggttactgtttccccaacactccaccaatgcttggcattatccagcttcctaatttttgctaggcaaataagcacaaaatgaagtcttgggggattttttggccatttctttgatcaccagtgatttaacatttcttactattttgctgtgatttctagcaagtgaaaacaaccctactgaatagtaatcctaaccctcaagaagtccagaccatcactagttttctgttgttgtccttcatcactcctcctccttagcacatccccgtggcttttccttctctgctgtaatccctcctcccttgcacctatcctttttatctttttgataatatccattctaacaggtgtgaggtgatatcttattgtggttttgatctgcctttcctgggaaaatatcagaaaagatccctggggaaagatcagaagctatttcgcccatcctgtgttttgttgctgtgggaaacaaggagattctcctgctttgtgccagcagtgaatcaaataagaagtagtagataatttgaagggtgaggacaaagacaggaggccacaagcaagtgatgttcctttaaaacacagcattcaaggagaagcaagtgagtgaggctgaaagagtgaggaaagattgctaggtaaggggtcaggtggtatctggagaccaccaaggtccaaaagaaggaggagatgatccacaaaggaatgtggtgctgagtaatgtggggaccctcgagatttgggtaaggaggaaggcaggaggaggatttaagggtctagatttttaaatacatgtacttttaataagtccaaactcatcaacatatatacattaaatgtgggcaaatttttttatcagttatgctttgataaaactaaaaaataaggaacttttccataaaagtaggtcgtgaccctaataatagtaataataaccccttctgtgtgtctgtttcacagtttaacattctgcttgcacttcgaggagtcaaggatgccactgcctcattatgcatgtaaagagaccgtgatatagatgggaaaaaagacttcctcgaggtcttttggaagttgagattggaacttgggtctcaaagcccaagtcgcttactgcttatttctgtaacatgatgttggagattgggcaggactgcttgggagaagcaattgactataacagaagggcagaaaggagataaaaggaagagaaaaattgcagatgcagtatgtgtaataaaaagtaagctactctgcccttaaagtttatgtcctataatcttccactttaaattattctctcagatttttctagtgtaaataggttgagaatattagaactgattaccttttcagttctattgcccagccatcctcatttggccaaaggccaacagacagttttctgggttgagatgtaggaaggctttggcaatgggcagcagtctttcttagcccgtctttgccatggggctcagtctctttgggttgcgccacctttacaggttagctggagtcaagcttaggtcacatacggggatccagatctgtggataagccaacgaaaggaagagaaatcaagtgcaaggccaagaaatcagaattcagttaccacatcaaagccagaatgacagcactctgagctgggagggctggggcactgcctcagttcctcacatgagatagtcatgctagagcccaagaagcagatagatccaaggcaaagagacaaggacttgggagggcaaggctccagttgtttctcattctttgtctggctgagccagtcaaagactcagacaaagggcaagagaagtaagcaagtgggtacctggccgtttggggctgtgctggcggtgagcagaggaggcagccgatgttttataaattgttgcaaacaatactcctaaagtcttgggctttatttttgcagagaggaaaaagggcccatttaattgtgctttgttattctcctactcatatttttttctcttttattgtagtgatggcagtggtgttcagccaggagcaagttatatgaggtagggttctgcccaggggaggtgccaggggcaggcggtgagatagggcgtccaggctacctgggtgtctgcagagcaccctggaacacccatttcagtgagttgtctgacccaggaaggtcagcactctgctctccccactttgttcttggggtgaaggatggatcttgtgaaatcctgagcaagaacaaaggctgactttatccctaggagggatatttgggtcacttttcctctctgaagactacttccacagttctcaaagtgagaaggcagaaatgaaagcactttcccttttctgtttgtgcccctaaattcccctgcaccttcagtcttcctttggccaggtaacttccttttgagttggctagcttcctctgcctgctgcttagggatacaggagagatggtccattcgagaaaggactctaatctttgtcttttgtgtatagagtaaataggtacttggccaggattccctgagctcttgctcccaggctgactcgtttgcctgtgttctgaggaaacaggcagagtgtgtcttcccaggacagcccgggggcattcagagtgatcaccccagatgctgccaggtttttgtgtgtcttccaaactaagacttttatacaaactaaaattagcctttgaggatagagaactccctaaatggaaacatgtagcaaagtggatggagggatggcaaaatggggcaaggctgtctcacctgcatgttttggcgaaaaatggtggagtttatggagctcagtgtgtgtgtgtgtgtgtgcacgcgcgcgcgcgcacacgtgtgtgtgtatatctcagatctttgtttttagtgactcacatatgtgctcctgagttgctttttgtggacgacagggcatatacctccctattcttctcagtcctttcggacatgcactcattttatatcacctcagggatggctccagccttcctacccaattcttaagtattagaagacaggttactcccaaacaactaggcggtgtctgatacccttgtggcaatcaagtgatgctctacaaagctgctttgtagagctgacctgagtggctagggtctttgtagagatgagctgagtggctagggttagattaaggcttggaggggtccaagaaaaatgaacaagttacaaggctgtaaccctctgaaaggccacagaattattagtgatattttgagttttaattattgatagcaactcagtaatttaagtagttaatcaactcaagaataaatacaacttagcaggaagtaattaaaaaattgagatgtttaactggaggagttttaagctttgaagttatctattcagtcagaatagttgcacaaaataccaaattattcatttactaaatatgaaatgtttttttctttctctttccctctctgatgcacacacacatatattttatcatagttggatcttgtaggaaaaagactttgaagggactgatcattttcaaatcatttatccagcgaatagatattgacatattattttgcatgttattctctgctcaaaactgtaagggtgttaagatgcttaaaacatgattgctgcctttcagaaactttcagccattaaattgagaagagaagacaaacttgcaaaatataataatagttatataaatattgaattcagcgagaagtgccggtggtatataattaggttctagaagaatggatcagatagctgtgacttacgaaggggaagacataattgctgactgcattttactaaaccatttatttcctcctggatttgttccctgtgtgtaaagaggggccttcaaccctggtcaggtgagatggaatatgcaatgcatatacatttatctggaactttgtccagagaatgggtctttcaaaaaacagagttacataaatcctctcagtgattctttggggattgttgagatgttcgtcattatctttattttgcaggtgccttagtccgtttgggttgctataccagaataatatagactaggtggcttgtaaacaacagaaatggatttcttacagttgtgtaggctggaagtccaagatcaaggtggcaagctgattcaatatctgatgagggtccgcttctggtttacaggtagccatctactttctttgtcctcacgtggcagaaaggagcaaaggtcctctctggagtccctcttacaagggcactcatcccattcttgagagttcatgatctaatcatgtctgaaaggccctatgtccaggtaccatcacattaggattaggttcagcatgtgaattttgggaggacacaaacattctgtttatggcagcaggtaaggaactgcaggtcagaagggccccagcaaagtatcattctgaaatgaatgacagatgggacaggcacgaagcttgaaagcgaggaataagggtgtgtcttgcttgactgtgaccgtcttgcttacctgctgaggcagaggtgctaggtatgccttctcttcaaggcagggcctcatcatgtaaaggagcttctgggtggaggctgagtgctttctctatatagccagaggcctcactccaatgcttggggtgtgagatctaagttttgcacagatgtcttcttgctacaggccaaggccacaattagggggaatggactctttccacatacttacttgtcatctcgtccaaggtagatgcttgataaaatagtgctgtatgctaaagtgagctgcctaagcttccctacacatgaaaaagaagcctagaggagagcacagatgggggaccgttcaactgcattcccaagagcattatccctaacagggataatggcaggatgtccactgtctgcggccccttcttttgccattcttttacattcattgctgtagagggtataaataggaataaggaactgatggctatgtgaaggtgaatttcaaactctttgagttgtgattaacttccagaggcctcaaaataactgatttacataaagtatgatgcagaaactaagccactcatttacatcttcaccatattttttgcatgtaaggacatatgttggttacctttggtcttgacaataacttcaaggaaggaatgctttgtctaatccttgttccttcttcaaggcccaactcaaacactttctcccctggaatccttcccagagctctttagtcagaattaatgatcctatatacctttccatagctctttgttcatatctcttcacatatttggttattcacatgtgtgttcatttccttcattcaactcatatattgtttttttttacactcagaagctgaaattagtagacacttagtgctacatgctgattgtaaagtgtatatctagaggaaagccagtacagttcaatgtacccagtgtgaagtactttcatcctagtacttaatatttggatattttctccattttttttaaatactaggacttgcgtgaatgaaagcttagtctctagatagacacaagtagggtctcttcacatgaaaaaggaactcatcctcttcccctttagctccttaaagcttctcctctgggtggcagagtcgtttgatgaaaggaacatgaactttaagctgaccagatgggtgatcttgggtaagttattcttatctttccacataacaacttctcggatataaaatgtggataattacagtttccttgaacagttccatagcacagtgtcgtcacttctcatgccttcatccataccttcatcatttctcatctggacgtttcactggaagatgactgtcctagctcaggctgccatcacaaaataccatagactgggcggtttgacaagagaaatttgttttctcacagttctgaatgcgggaaatttgagatcagggtaccagtatggtcagaatatggtgagggttttcttcccagtttgcagatggccacctccttgacgtgttctcacacggcagaaagggaaagaataagcactctggtatctcttcttataaaggcactaatctcatcataggggcctcaccctcatgacctcatctaaatctaattacctcccaaagactccatctacaaatactatcacattagggcttcaacatatgaatttggggggaacgcaattcagttcacagcaatgattgtgccattccttcaatccattcttgctatatggaatatagatctgtcacatttccctgcaggccagaataaaattcacatttctttgcataacacttgtaactctgactcttatttaatgcttcagcattgtatctctctgccttcatgttggttggttcttccaggaagcagacaccaacatgggattagaaatgcaaaagatctattggggaaagataatagggaaagggaaaaagagtaggtagggaaactttagactgcaataccaagtgagacacatgaaaaagaaaggaatcaagtacaatcagataggaagagcattgtactgcaatgtaactctgagcaacaaggaacttttgtgcaaagatcatctatagaggagtccccattggttgggagtggcaagccttgcttggttattggctggagctaccttagtagagcatgacctcagcttcaaagccgtggcagatcctaaagacacccacagctaggagctgtcagctaactctactccttgtggcagattttgtcttgaaaataaatctgagcagcatactttatgacctctgcagtctgctttgtgctctctcctttgccatgccaagttacttcaacagccattctacagatatttgagtgcctgctttgtgcccataaccaagcttgctgagcaaaaccaggcttctctggagtttacagtctactgggggaaataaatgctaatcagatattcacaatgatggtgcataactgccagcggcactgaatgctctgcaggaaaggaagtccatcttacaggagtgggtggcaaaggaacctgaattccttgaactcaccccagtttcttgactctctgtcgttgtatgcgttgttacttctgccataacgtcctttccctgcttctttgcttagccaacatcattcaataataacaaccatgagcacatattgagggtagccaaatgtcctgatttgacttggacgcttctggttgactccttttgtcatagtgtattaattagtattgccctctttcctgttaaaaatatcccagtttagacagtatattatatggtcacttgtttgccaagcgctattttaacctttttatttattattattattgttgttttgagacagggtctcaccctgtctgccaggctggagtacagtggtgtaatcatagctcactgcagcctcaacctcctggacttaagggatcctttggcctcagcttcccaagtagctaggactacaggcaggcaccactgtgcttggctaatttttaaaattgttttatagaaacaaggtctccctctatcgtccaggctggtcttgaactcctgggttcaagcaatcctcttacctcggcctccaaaagtgctgggattacaggcgtgagccaccatacttggcctgtaaactttttgtacaaaatactcatttaatgcccactatacgtctaaaacagtaactttttcaaaaagttgcaattttacagtacaagaagttaaacaacccactaaaagtcactgagccagtggtgctgggatttgagcccagcaagtctgttcctgagcctgtgctttcaactaccaagctgtttcgcctctcaagagacattacttggaaagcccccccccaccccccgccgccccactcctcagcctggcttgactgtttcccatgtgatccatctgtatcctgtacatgcctctgttacagcacattgtgatggcactggaaactgtccctcactcctcatccccctcccagcacctcacacatactgagtgctcagtcaatctgttgaataaatggattgagacagatgagagagttgcccatacatggcacatggactgttaagctggaacaggacgttgggtaagttgttttctcctttttagatgtttttgcccttgtccaaccttcagaagtttacttcctctctggtttaatactgttcttagacatactgaattataaggactgtggactgaaaaggggcagctttgaaagaagtgtatctcatatagttctttgttgtgtctaattcattttgtggtgtcacattcattgggcaatttatatttcttttcatgtccctgaagtaatgttttatttttagatagttctaaccctgaggacattccaaagacaatggtatttctgtttttttaaaataaaggaatacataattttttaaaagcacattttgctaagggactttcaaagggacaggacagtcatgtaattggggggtgaaggtgattctgttcacttttattctattgttttcccctttctcctccataggggctagtcctgagataaagtaaaaaaaaaaggcatatggtaatccattctgaatatgtcatattcccttagtgttcatagctgagaccttccataaactatttcttaagacactgaagatgaatctcttgacacggttatagggagcagagataaggcatccaaggggttgcttttcagctaggaagtttttggtcatctgtacaatgcataccccagtatcataaatgataagattttattttcaaccattctttttcttgaattaaaaaaaaaaacagtgattaggaaattttcaactagaggaaaccaaagaacagcatcataaaccatgtgtattcagcttcaacatttacccacattcttttaatcctactaccagacttgcctatctgaatcatgaatgttaggccctctggtcaactagattttcttcaatgcttgatttttcccttcaaacagacttctgttactgtcactagaacaatcagtattagacttattccagccactcttcccttctctctcccactctagagaagaaatggcctcaaatttagtttggagtagggtgctgtgcacatatctcattaggaaatggtgtagatattcaggttctatctaaagatagttcataggagaaaaggggaggcaaagagaggtgattcatgtgctggaatgatgaaggtaccagcgctgctccttgaaggattattagcttttggatgggtgatggaattaaaaattattaattgtaatggcaacaatagctaatatttgacgtgtttactatggtccaggcactgttccaagcacttcacatatattacgtcattactatatgcaaaggtgaggaacaagaactattaacatcccatttgcaaatgagatggaacctgaggtacaaggaagttaattccttcaagggcacacagcacagggagatagaagttcaaatattcgtgagatcatagagtgggagtgaatgtcatcaagaccagctcttttattaaggaaaccatagtgcaaagggggaaggggtttctccaggacacgcagtgagtgggtggtgggtttgagactcttttccaggaacctagatttgagtgtggtgtgtttcagttataccagacagtcgtcttcactaacagaagcacctcgcgaggcctcatgatgtcagttccctacctttcagcttttgttaggattgactcttcttttactatttctttcttcgaggaatagttcttgctttttatatttttaaatctcatctctgcaaattattgaacttagctaacatttagagaatacagcctgttcaaagcatagtccaaagacaatgtaaagttaggggaagagtctcttgcctctttatctgaaattccaaatataaaatgaatgttttcatttttttaccccatttcctctgccttatagtctcaaaaaactgatggatgtctgaaggataatttctttctctgccaccaaaggccttgcccactatggtgcttattcactttattttacttttataatggaaaaagtttatatacaaagcaaaaattgagcactgaaacagatcactgattctcaatcagaggctacagcaagagatgggaaataattgtgtataaggatttcccctttcacttttaattttttaatgcacgttactgtgtactcaggggttttcatctattcagtatgttacaatcaattatagtcattattatttggaccaaatttggccaccagaagcctcttcagtctgattcctttgtccttttggcataaacccattaatctttgaatcctttcttgtattcagtgataataagatgtcccattaaggtgtcatgttgtactttcttgctagacttcttcttttttgtaataattacttttatttttttttctttcatagaagaatggtggtttagattgtatggattttagaaactcttgaaaaaaattgaaagccattagtaagatcaatgtaccatttgagatttttaaaaaagtatttcagccttcaagagcaatatttttagagtgagacttattttggaaatggaatctataaggtttctaaatcaggggtttctatttttcactaatttcatcttttctcttgttcaactcttctaatttctgtctttgactgctgagccacattaaaaaaagaaagcaccattattgcttactaaggagatatcatatggaaagaattctcagatcctgaccttgtccaaggagtggtgaaagggatggcatcccaaatgttagctgtcctttgtggccttttctgcttctggagtccagaggttctccctctgtaccttgtgacctatccatcattgaaatcagcttattcgtttcagtgccagatgtgtctggagtccaccttagttcccttcttacttaatctctcgagcatttgagcttttttttttcttttgccatctgtaaagtgaagcaaaacttgtaagtttgaggtaagcattaaatgaacaatgtttacactataaataagggacttgaggcatagtgagggttttgtacctgttgaattccttcttccttgtgttatatttacttacacatgcaggatatgtgtctgcttcatttctataaatatttttattgttaagtataagacaaatacaaaaacctcctaaaataattgtacagtttaatgaactattacgagatgagcattttttaaaacgttatccatgtgaaacaggccctctctttattagatgaggtacactctgtggtgaacaagatagggtcctgctttcacagagctgatgattctgtagcatctggtactgccagagatcatacataggaatgagagaagacatttaatttggctaaattaacattggctcaaatccagcaaaagaccttgttagcagaaggtagagctctttgtccactatggtgtagtttgggcattacatggatgtgtgcggttggccatacaaccatgagataacatgagattccatgtctcacttccatggttacagaaggatcagcatgctttatagttttacatcacaaaatgattcagaaaaatgcagatgtttacaaatcctatacttgtcccagaaaccttaaactcccacttgaaaaggaaattcaaaatgtcaggaatccctggggaggaacattcaactttaggatcttggctctgcttgactctcactcaggggtagccaccagcagttgggtgcagccctgatagagattaatgtaactcagcctagacttcttcctctctgggctcctcccttgtcatgtcctccgactttgactctgctgtgtgtgtccttgacctgcttcccactctctgggtctctggacttgatagaaagccttggtgagttctaactgctacctctgggagttcctctgaaccttaccatcccatgcacctctcttgttctgtcctatttagatgtgataacgctgcaggataaatcttctggaactatctcccaggcttcatgccttataaccataggcaatgctaacttgctttgttgtatagccccagtctgggagatcagacagtggtttccactggcttggggttaaccacagagatgtctttttgttctctctgattttgtttccttgcttgttctttatgctgatccttaaaaaatgtcatgaaactgtggcattgtgacaattagcccttggcattgctgtttgggaacagataagggaagtttctgacattaagattggttatgccaggaccatactacctgtctcaggtatccttcttgggctccctggcgttgttggttagcttgctctggaccttgtctgcctaacagggcttcgggtatcttgagaacaaggactgtggccatctttcttccctggaacctgagcactgagtgttgtcacctttccactgtgtgtggcagcagcaaccagagaagagctgtgggtttgcctgttttgttgcctacccatcatccaggagggcagcctctgtcgtgtcattagagtcgaggcccaactacgtggtgcctttgagagagcccactctcataaagtaactttacagagagatgcagatgaatactataatctgggtattgcactctttttggcaaagagaaaaaaagaagattgttactgtgtctagagtgttgaaattgactttagcgtgttctttatcagtgggggccgaaacattttagcctgttataggcctttggagaagtaaaaagaaagatgtctgtggtccttgttgtcatggtatctgtggtgttgttaaagggacaaggcctaaaacagctatccagcagtggtagggagcctgagaagtgcatgctgggacaggcattgtgggctacagattgacaggagggcaggaaaggcccacagaggtggcagaacatgaaggtgttgagttggaccttcacgaatgggaggagtcacaggggagagaagagggctttggaggagaccatggcctgagcaaagctaatacacagggtgtgtttgagaaaactgagtgaaagtgatataacattagccttgaaagagcatgtggggtggtaggaatagagcaatgctgagaagaaagtaattgagagggaagattgctactggggctggctttttgagtagcaaagcttaggtccttgtattctgctcctaaactaattctgattcatttttatagatctgtgctagtagttcatccacaaagaaggatttggtgctaagcagtatattcacactgtatttgaatacttgacttggaataaatattggcattaataacagtttttaaggatgtttctgattgataatagacatttgaatcgctgcttgctagattgactccaagagctgtggcattatgacagccttggcattgttgtttgggacctctgtcattaagattgactgtgtcacagccacaaatgctgtgagcaattgtctgatccatggagacctggtgtgttagtccattcttgcattgctatcagaaaatacacaatgctgggtaatttataaagaagagatttaattggctcacagttctgcaggctgtaccagaaacatagcagcttctgcttctggggaggcctcaggaagcttccaatcatggcagaaagcaaagggggagtgagctgtctcacatggccagagcagaagtaagtgggggcggtgttatacacttttaaacaaccagatctcacaaaaactcatcatcacgaacagcaccaaggggatagtgctaaactaattatgagaaactgctcctgtaatccaatcacctcccaccaggcccctcctctaacattggggattacaatttgacatgagatttgggcagggacacagatccaaaccatatcaccttgtcagtgcacagggaggcatgggaaggtcaccactgaaatgatgtcagttctctggtcaaattaccagtttatgttcggtgccttttctataattttaatatattagcatattgagttttttattaaaaataaattttactctcatgtcctttgaaagaaaatgcatatgaatcttatttttggctgtagttaattcatttttgatagttgttttttggtccactttactctgaatgtgcctcatggactcatgtggtgctctatgggcaggtgagtctagtgacaccaattataggttgtcacttcatataaatagtaactgaagaaacagtgaacttgacaaggacagagaggagaaaagatgtttgggagcaggaaaaaggttggcttaatgattgtctaccttctataatcccagattaataccaggctgcatggttcagaggtgcaagctatctcttgttttctgattcttaggaaaaaatgctaatggtctggttgaaaacctagttcattcataaactgacctgctgaaggcaggtctgactatcttgaatagacagcaaatagatttgtttgctggctgtatatcagcatttgtaagagtttcaagttcaattaaatgtcaatttagcatgtgtttaatatgtagaatttattcctgaatcaaactatgcaaaaatgaagggctcagctactggaatttaaaggcaagttcttactctgtcagccctgtgggttgaacataggttgtagattaaaatgagaccagcaagcatgaagaacaccttaacaatggaaggtggtggccagtgggttttagaggcatgttactgaaaccctggaaactttgtggccagtgcctaagtacaaaatgaatcattacctgagagagagatcattgttttaaaaacatgtagattgtcactgtaggatctgtagtctttcccattaaaacgaaacaaaaaacttccctgaaatctttcatacaaaacacctggaaccaagcaaaaggtcatcagggagcatttcttgaactctctggcatttcaaggcagtgatgtcattcttattgcttgataaacataacaattcttcaggagtctttttcctcccatttaatttaaaagggaactattacatagctgctgtattgttgggattaagtaataggggcgtgaggcccttgtatctttaggattctttcccatctcagctgtaggcagacacttttgggacaaagccatcagtaagcatcagtaagtcatttcgcattactataaagaaataatatattcatatattgccaagtaaagcttgagaagtcaatgcactaccattctcttaagaattatcgtaagaaatttcaaaggcgcatttttaagagtggggcaatctcccatgcagtcagcatccacagaaactcattggttagcagtttggagtttttccttccggtataatttacatgcatatagggatatatttttattttataaaattaagatcatactgaatttaaggacatatatcttacattttcacacatcttataatttactatgtcactaaatattcttagagaacttgaaagtattctattatatggagctcccagaatttattaacatactgcttttgttaaatgatagttatctgctgttttttacttttataaaagtgatgatcatccttgcacattagattaatatttgtgaatttttagggtaaatcactgtaagtaaaactattgggttaaatatatacatttttaataaacattgccagaatacttccaaaaagctgattccaatttgtaattcctgtagaagtacatgagagtatctatttcaatgtagtctactgacactgttactgttaaaaatatttcctagattcttagataaaacatggtatcttattttaatttgtatatctttgattacctgagaaattgaacttttccatatatttgttacttgtatttattattgtcctggctttttctgtactctagatcctctttacagggatcttctgttcaggtaggcttccccagtgagtgtgaattatggggcaataatagattgtaactaaccacaaaccaggccaagggacagctattcttatggacttgttgactagatcagtggcttttatgtctacttaatgcacatctgtcataactttctgtttcttatttattcttcccctgacatttattgattatgatgcataatatggtttagtaagctgctaaggaaaccatgtgatgggtgggataatttttcttatcaggaatttacaaattaattagtatcatacttgaaaactttgcatttgtcattaaagaagttaaataccactctacttattcaccagctacttattcaaatactttggcctagggaagactgtgagaggttatcaagttcatttttctgccattaggcaaaacctaatcaaacgaggctagaagaggcagtagagaaatgtaaagtattgcctctcccagcctcatttgattaggctttgactaaaggcagaaaatgaactgatgaagaaatatttctctgatttgagagacttcttataaaaaaaaaacaaaacccaaaccatcatggtagcataagagcatgaatgtatcatgattgttttgagcctctcagagaaaacgcattatttggtatctactcttgctaatcatcaactagtttgtccctgtctaataagatgctgagtctataaagtatgatgacttcagtagtacttggagcttccaaattgcaaggcatgtcttgggaggaagacgacagcttttcctcttctgctaaactgaggcactcttctctgatacctattgaaatggtagagatggtagtcaagaggaaacaacccatcatttgagccttgattttataaacagtttagtaatacatagaagtcaacttcattccagatacagcctgacaaggaaccagctatgtaaaagatagcagatgtctagaactttcttctacattgattagttggtatacccagagtgatgtgaaacatctccagtgtttcccaaactccagggtctaatattttctcctaacctcttttacccaagtcatatttaaaagttttctttctgtcaaattttaaatttataattttttagttggacagttttaagcatgttaaaatattataataactcacttttagacttttagaattttttttattccttgtaactttacagctgacacaatggccattattattactttgatttttaaccctgtttttagaagacatggtttttacgtagtgtgatcgtaggttgtactctgtattgtaactcagatttttttcacttaagattaaatcctaaaatattttcctaattcatggtatagtcttgataatgttaatagcagcaaaatcattttccattaagtgaacataactccttaaccattgcctattgtgggacatgtccatagcttctaattcattgtattcagtgttccttgaagctatatttatattataatacattcattcatagaggcatcaagtatttaaaagtgaagagccgatttaagtagaaggaaacagaacaaagctgtgtaatcatctaaaatagttcacttagtcatagctgaaaaagttcctctgccatgtctgtggcttgagaggaaaacacaaatcccatattttatatatgtaggtaaagtttttttttttttttttgagatggagtcttactctgtcacccaggcttgagtgcagtggtgcgatcttggctcactgcaacctctgcctcctgggttcaagtgattctcctgtttcagcctcttgagtagctagggctacaggagtgtgccaccacatctggctaattttttgtatttttagtagagacgaggtttcaccatgttggccaggctggtctcgaactcctgacctcaagcaatccacctgccttggcctcccaaagtgctgggattacaggcgtgagccaccgcgcccggtcataggtaaggatttgaaaagttagaactgaagtcccacttgggtggggagctggaactgatgctgtttgcagttagaactcttgggacaccacactcttggtaagggcagtaggagcttcctcccacctggcttgttcctcaggcctgaggtgtgcaaacagaaagtccagaggaagatttgcttctaggactggttctccatctttgttatgtatatggtcttggccaagtcactgtatttctctgggctagttccatcttccataaaaatagaagcattacatcagatctaaaatgcttggcaatattctcacttctgtgacttgtagacagtctatcagctcaaaactgctctgagtggtctggaattatggggaattaatatgacttactgggtggaagaaacttaattctgatggggacggagatggacagaaggctccaacatttaatgttgctttaaaacatttttatgcctttcttgatatttcatttttactgttaggtcagtatatctttctgaattagaaatctagctataagtagagatggttttcattcattgaaagcacaaatgatgtctttgtggatggctgcaacttttctgcttattcaacccccggccacctaggaacctgccacttgcatttataacatcagtcatgacagttaggtgtgttgacatgtgaagcagacacctgggtagattaacaaggcctgaggaacttgagttgttacagttaataggtcagctgttgtatagatagtaatattatagccaaagtttccggtttagtccttgtttccaaaggaaattcctctcatggtgtgaagatatgcaggtctgtttcttaaccctctcagtacctgtgtcccttctgatgaacctcaatgtgagtcattctttctttctccccttcccacctcccaccccaccccccaccccccccacacacacgagatgctgctgaccaggttgataacccttgatacaaatggaaggaatactagattcattcatttcagggctactcaactgtagtttcagatcaaccccttaccagccccgtggccttggataagttagcaaatccctctgttttctcttctaaaaaatgaggacttaggtcacagaatcttcaagaatcacaaaattatactttcagaagagtaagacctgacgcataaataaatacatgcctggccccaggcataccgataaaacaagacatgctgtttgtttgtggaactttcttgtctcttgtccctttctgcacacctcatcatttgttctcgctccctccatatcgccagcatatggcacccagtagacttcttctgctgccactgctggcctggccccttgcagggatagttagcagtttctcagccaccttttccacttgtcttgtttgtattctagccatccttcaacacgcaggttaaatggcttctccattaagccacatagatcccctcatctagccttaatctcttccacctactaacttccataacactttatcttgtttttttttaattcagggtatttattacttcctcttttgtggatacaaatatttcctctactggattgtagttcctctgagggtttaatttgtatcccaatgcctggtatatttgttgaatgagtgaacaaatgaatgagtggggagttagtaagtgactaagtgaattaattaattgtattcccactcagtactatgccattcactagtagaccctcaaagttctgtttttcttatcattcccttaggccctctttagataactagcttcttaatttctggttaattaatgaagagattgttaatggctgatatactgatacgttgctgcttaaaaatttgtgtcttaatagcagatccaaagagatgactctttagttcacataatggagtataagaggattatgagatgtgtggatgtagtcagggatggggaggttccatctaccaaaggtgatggtctcagcctgtgtagaaagcttgtccaagttacatgtattaacttttaatttataatgcaaaacaaaaattctccatagtacagcaagccccagcctttttggcaccaggaactggtttcatggaagacagcttttccatggacttgaggggtggatggtttcacgatgattcaagcacattacatgtattgtgtactttatttctattattgttacattgtaatatataatgaaatattatagttatataactcaccatcatgtagacttggtgggagccctgagcttgtttttctgcaactagatggtctcatctggggttgatgggagacagtgacagatcatcaggcattagattctcataaggaggatgcaacctagatcccttgcatgcacaattcacaatagggtttgtgcttctatgagaatctaatgttgccactgatccgacaggcggtggagctcaggtgataatgagagtgatggggagcagctgtaagtacagatgaagttttgcttgttcgctcacccgatgctcacctcctactgtgtggcccagttcctggctgtccacagaccagtatcagtccatggcctaggggtttgggacccctgccatagaacacttaataattgtggcaaagttgacagctgccatctctttgttgcctcgcaaatattctttccattcaacagcagcgttttaatttttgctgtgtggaccatcaatctgtaagctgcactcaaggaaaaagactgaggctctcctaaaaaatgataattgggtcatcttgatgtcttagacagaatattcgtatagcacaggtgggcagtgttcaaaggctcacctgtattcactcctgaggatgcagtggtggtttttgtttggtttttacagacagggtctcactctgtcactcaggctggagtgcagtggcacaatcatggctcactgcagccttgaattcctgggtgcaaatgatcctcccacttcagcctcccaagtagctaggactacaggcatgcacgaccacatgcagctaatttttaaaaaatttttgtagagatggggtcttgccatgttgcccaggctggtctcaaactcctcacctcaagcaatcctgccttggcctcccaaggtgctgggattacaactgtgagccattgtgctcagtagttgtggtattttaaagtgagacatggagatgagagagactcataggatgtctctactaattgatcagcacaggctttcttgtctcttcagattatatgctgaatggcctcacctcatccaaacacacaatgctgacgcctctgcctcccctaccaccatgcactgtgcctttcctataatatgtattaaaatagatgacagatggtaaagagcaaagccgattctgtaagccttgttttgtgggtgcttgatcttttatttcagtcactgtgcagttttctgtggattatgtttctcatattctagaagaccaagtatatctaaataatttggtataatacgcaacagaagactgtgggtgaactgacactgaataaatgatttactttgagagaatggagttttacaaatatgacagccaaggaaccagggcaacagttaacttgagcagttggccccaagaggaaatgtcttggtgtcctggcagaagagagccagttgtctgtgttagtaccacaactatctcctacttcttttctcttctgtccgcacccttgcatgtcacgggaaggactaaaacatggttagattggccattccaaataatgttgttaagttctgtagaggccatgacctgggtcattgtagaaacagcagtctttaatctgtttccagaatgcagtgtgcttagataagcagtctactcaaggttaatatctctgcatctgtggtgtttggtatttaaagaatcaatttaaacaccttttattcaaagaaaaatcttaatgttctttggaggttaatgaatttcaagtatacttgggatttaaggagtagacaaaaagaagtagatttttcatggcttagatgtctggtgatgaaaacataactgctttctaatgttttaatgttcttcctgtggtaattccagaatgcattcattgtggttctgtgtcattaagtactggcacaaaggagttgttgataataacccaacctgggcacgtttcccagcctataagttgatttacagttacagattctctgcatgttcatcactccctaaccccacagactatcatttttgaaggaactagaaaaataacattaatggcatttgaaaggataacattagaaaattatctgttattatagtaatatctgttatattgactactacctattttattgttctactgtctgaatgttagactttcatgtagaattcatttgtagtttggcttggtttaatttttatccagagagacatagaaatgtggtttactgttacttttgaggatgaggtctattagtaaagaactatgtggcccattataacccattactgtctatgtggatcctgcaatacactcctccatcactttacatgaagaactaacagtagaatgcaaaatgtaggaaaatttgctttaggttttacacctcagccttctaagtttcagtttggttcagtctgagaaaggcctagtaaatcaaggaaagagaagggctgccttgtgaggcggtattacaaaaatgagaattgctcagcctggatggatactcaccaataggatacattacctaaatccaaaagaggacaggtgtagcagcttgtattagttctttttcacactgctgataaaggcatacccaaaactgggaacaaaaagaggtttaaatggacttacagtttcacatggctggggaggcctcagaaacatggtgggaggcaaaaggcacttcttacatggcagcggcaagagaaaaatgaggaagaagcaaaagtggaaaccccagataaaccaatcagatcttgtgagacttattcactgtcatgagaataattcaagaaagtccggcccccttgactcaattacctcacccggggtccctcccacaacacatgggaattctgggagacaaaattcaagttcagatgtgggtggggacacagtcaaaccatatcattttgcccttggcccctctaaatctcatggcctcacatttcaaaaccaattatgccttccgaacagtcccccaaagtcttaactcatttcagcattaacccaaaagtccacagtccaaagtctcatctgagacaaggcaagtcccttctacctatgagcctgtaaaatcaaaagcaggctagttacttcctagatacaatgggggtacaggtattgggtaaatatagccattccaaatgggagaaattggccaaaacaaaggggttacagggtccatgcaagtctgaaatccagtggggcagtcaaattttaaagctccaaaacgatctcctttgactccaggtctcgctgatgcaaaaggtgggttcccatggtcttgggcagctctgcttctgtggctttgcagggtacagcctgcctcctggatgctttcacgggctggcgttgagtgcggcttttccaggcacacagtgcaagctgtcagtggatctaccattctggggtctggaggatggtggccctcttctcacagctccactaggtcactgcctacagtagggactctgtgtgggggctgtgaccccacatttcccttcagcactgccgtagcaaaggttctccatgagggccccacccctgcagcaaacttttgcctgagcatttaggcgtttccattcatcttctgaaatctaggcagaggttcccaaaccttaattcttgacttcagtgcacctgcaggctcaacaccacatggaagctgccaaggcttagggaatccaccctctgaagccacagcctgagttctgcgttggctcctttcagccatggctggagcagctgagacacaggtcaccaagttcctaggctgcacgcagcatggggaccctgggcctgacccacaaaaccactttttcctcctgggcttccaggcctgtgatgggaggggctgccgtgaaggtctctgacatggtctggagacattttccccgtggtcttggggattaacattaggctccttgctacttatgcaaattctggcagccagcttgaatttcttctcaaaaaaatgggtttttcttttctactgcatcatcaggctgtaaattttctgaacttttatgctccgtttcccttttaaaacagaatgctcttaatagcacccaagtcaccttttgagtgctttgctgcttagaagtttcttcccccagataccctaaatcatctctctcaagttcaaagttccacaaatctctagggcaggggaagtatgccaccagtctctttgctaaaacataataagagtcacctttgctccagttcccaacaagttccttgtcctcatctgagaccacctcagcctggaccttattgttcatatcactatcagcatttttgtcaaagccattcaacaagtctctaggaggctccaaactttctcacatttttctgtcttcttctgagccctccaaagtgttccagcctctgcctgttacccagttccaaagtcgcttccacatttttgggtatcttttcagcaacacctactcctggtactaatttatggtattagttcattttaacgctgctgataaagacatacccaaaactgggaacaaagagacgtttaattggatttacagtttcacatggctgagaaggcctcagaatcatggcgggaggtgaaaggcacttctcacatggcagcggcgagagaaaaatgaggaagcaaaaggggaaacctctgataaacccatcagatcttgtgagacttattcactatcatgagaatagcaggggaaagattggcccccatgattcatgggttccacccacaacacatgggaattctggagatacaactatagttgagatttgggtggggacacagtcaaaccatatcacgggtcatgcctataatcccagcattttgggaggctgaggtgggcagattgcttgagcccatgaatttgagaccagctctggcaatatggtgaaacgctgtctctacaaaaaatatttctaaaaattagctgggcatagcagtgcactcctgtagttaacagctacttgggaggctgaggtgggagtatcacttgagcccagaaggttgagactgaagtgagccatcatcatgccactgaacaccagcctgggtgacagagcaagaccctgtctcataaataaaataaagattcaaaagatggtgaagagttaaggatttgttcaatacctccaaaagagtattctttacaacttgaaataagcatgaggactttgattccaccatccatccattccatgaagtctgaaacctggaagcaattttttttgtaaaaatcttttctgattatagaagtaatgttaattgtagaaaatattgttaagcacagtaaagaaaataacctgtaaccctacattgtagagataatttttacaataatcataactgtaatcattgtgaatcaagctttattttgtgtatgtatctagatatttatttctagttgtgtgtataataactgatttttagaattgaaattgtatttttatacctacattaagaacatttcctcattgtcacatacacatgtgaaatatccatcatttagatgaaccataattttctgtgtcctatttttgattatttaaggttatctcctagtttttgcttctgtacataatggagcaatgaaaagagccttgtatgtaaaaatgtatgtgaaaatttctagttattttattatggacagtgcctaaaactggatttttttgggtgaaagctcctgatagttttaaggatttttgaaacatatttcattgtcttaccagcttgcccagtgctgtgtgtatcaggcgttttactctacaaatgatgttcccttcatcacccctgccttggttaaagccttaacatttcttcactggtttacatcaacagcctctagccttgactctctccaagcactttccatatttccaacgtgatccttcttacataggaattcatcacatcagtggctcctctgtagcctttacatcaaaccacatatcctagcatgtatgtagaacttttggggatttgagcagtcctgacctccccaaccttcatctggaaataattgcctgcctacagtctgggcttcattcctgttaaaatatagtagaagccgtctaatctgaggcatgatttttaaatttaaaaatattggctaaaataatgagagattagtatcttaaaatgtttattttacatacatctcttaaaatgtttattttaacttaaaacatatagttggacattgttcaccaatcctttgatgtaggaacaagacctttcctttgaatgtggttccaccattgaaatctactcattggaatcccatgtcatttttcttgtgtaaccacacccataatatgtcacttacaagttccagtttgggattcttttaaacagagtgaatacaagggcagaattcttccaggttgttatgatttattttccagtcttgtatggctgcctcactcctaatttgacagtaattttttgggacctagtatttttgaggctattctatctagctttatagaagtactaagtcttttgattcatattcatattccattggtttctataatatgattaagttacgtgattgtaatgccaagcacaactcgcacaaacatattgagaaccagtataaataacctttggcacacatgcccctcaactgggaaagcataaatcctcccagcatactgtagagatgccttcaggctgagagcacttgacttggtatgggtactggtgagcgcatctttcagaaggagtggagaatatttgttaatttaggagctggttcagtggaggccagtgaaagaagtttctgttgtgtttacagtaccctaaatatgtcgtggtctctcccttctttatcttcagcctgctgcttactctgagatccttgcaaactggactgcagcatcctaagttactgcaggaagttttctctttcatagcccctccccttccagctagctgctgctcctgtgtgctcatgtaccgccacatgcttttctctgtgtaagtgcctattgtaatttatttgcttaaagtctccctagaatagactgtgagtccagtgagacgaggggccttgtcctttacctctgactccctagcttctgacacagtcttggctcttggaaaatattggataaatgaaaatgaatttctttagcaagtggtataagctgaaaatatacgtatcacatatcctcattctaagacacattcagtgtccctgaaattagaataggacttacaataagtgtgttcactttctcaatagctgttattcaattgatggtaggccttaaaagtcaaagaaatgagagggcatgtgaaaaaaagctcaacatcactgatcattagaaaacttccattcaaacccccaatgagataccatctcataccagtcagaatggctattattaaaaagtcaaaaaataacagatgctggcaaggttgtggagaaaaaggaacacttaaacactgttggtgagtgtaaattagttcagcgattgtggaagacagtgtggcaattcctcatacctaaagacagaaatactgttcgactcagcaattccattattaggtatatacccaaaggaatataaattattctcttataaagacgcatgcacacctatgttcattgaagcactattcacaatagcaaacacatggaatcagctgaaatgcccatcagtggcggactggataaagaaattgtgtacatatacaccatggaatactatgcagccataaaaaagaatgagaccatgtcttttgcagggacatggaatgagctggatgccattatccttagcaaactaatgcaagaacagaaaaccaaataccgcatgttctcacttacaagtgagagctaaatgaggagaacacatggacacatagagggaaacagcacacactgggacctttcagagggtggagggtgggaggagggagaggatcaggaaagtaactaatgagtactaggcttaatacctgggtgaggaaataatctgtacaacaaccccccatgatacaagtttacctatataacctgcacttgtacccctttagttaaaatagaagttaaaaaaaaatgttagatcacctcagggacaactatagtgagcatagttgttggtgtggcagtgttcttccataaacacccctccatgtttctgtcagaatccgctttctgggccttcagtaaccagtgcaacattccttgatttctaattcctaagggtggctcagagtagggaggttgtgtagccccatggttatgagcatgaagactggaggtcagatgtaggccatgcctcttaggcaagtcaggtcctcacttttctcatctataaaatggagaaagtcatgactttgggatgatgcatgaaaccacttagaactgcttggcatgcagtatgccttcagtatattctagcagttgctgttgctattgtgaaaccaaagagttcataaaagtgatcctataaataatataatcaaagaagtattcataagatgcttctataaataatatcatttctgtcacacactccttgcaaagaattcaaggagaaagtactactgggtagatgtttgattctggaatctaccatttaacaactgtaacatgtctgggatattttcttaacttctcttagccttgatttctctacctataaaatgggatgataataataatgcaaaacttagggggttattaagcatagcaaattataggatacatgtaaaatacagctcctggcagataataactgctcaataaatgttagctatctctggcagttataattcacagtcacagacttggatatgcaaaatagagctttatttgtctgtagctgaatgtttctcacctcttgaatttccatttccactgatggcagaaatcataaatcttgccaatttatgataaattcagtgactttcaggctttttttcttaatctctagtttgagtaaattctcagttgattttggattctttccttttgctttctcccaaagggtgaggtcctggggagcaggtgtttttctgatatccatatgcttctgttcagatgtagggctcctattggtctttggccctgctgtgtgcacagctggaagttttcatttctcttctgcctcctgggatccatcagggtcctacagatccctttggttccctgaagcctggttcacctgcctaatcactgacattttggggaaaactctcagtgttctctagcacctcacaggagagccaagaacctgtaagacggcctccattcatttccttgcccacactgtgcagccatagctcctccatccctcaggcccctgctgggtgctgagcttttctcagagctgctactttcctggatttcccaggcacaggcatctgcctgaacttacctggtgtttgttacctaaggattcatcccctatccacctgggcttgacttagtgtggattgggaaagaagagtactgcttccttcttagaagcccacaagaggcatctgttagtctttgtgttagttttctattgcttccataacaaattaccacacattttgcagcacaaaatactacaagtttattatctcacagttctctaggtcagaagtccagcttgactctgctgacatctctgtgtcaggtggcatagggtcaaaaccaaggcccacttccgagctcaccaggtggttggcagtttcttgccattgtgggactgagatctgttagctggctgtcagcggcaggtcattctcagcttctagaggctgtccatgttccttggtccatggctctcttcctccatctgcaaagctagcaatggtgggttgagtccttctcatggtttgaatctctctaaccttcccttctgcctcgtcttttttgccttcctcttccaatgcatctctctcagtaactcttctggccttcctcttctgcttttaaggactcgggtgattacattaggcctaccctcataatttccctgtcttaaagtcagctcattagtaatcttaattctttctgcaaagttccttcactgcagtacctgggttagcagttgattgaataaccaagcaacaggaaaccttgggggtatgtgtgtgcgtgcacatgtgtgtgtttctttagaattctgcctgacacactcttacccccaaacttccacgactttctctcgtccacaagtagagggataaactggcttggcatatattccttgaaaactattgcttctgctagaacttcagtttttgaacctgagtacttttaaaagtgtcaaactattttctctacagcaagcctgaagatgctttggatatctagaaataaaaccaatatttttctctgttatagcctgtgtaccccatgggcagtgggtacaaagaggtctcccggtctcttagggtggtggctaaagggtaaaggtccttctaaaggcacgacagttcagttaatcaaatgtttattgattattctgttgacagtgctgtgggagatcctgccctcacggaatttataacctaataggggtgaatgtcatttaaatacatacttataataagtgcagaatatgggaagactgtggggaatatgcagtgttgtcagagcctataagaggaggctgggacttccaattgagaggttaaaggttttttttttttttttttttttttggcttaaagagtgggtgggttttgagaaataatgttacgtatttgtagtctacaatgtactttctatactggatttcacttagtactcacagttcctttttgtggcagggattatactgtttgtgttacagatgtgggagctaagcctgagagacttggctcaaaatcagattccaatcattgactgactgagattgaacccagcttcaccaactctaaatcaaaaccatgcagagagaactgcatgagtgaagacagtgaggtgggctagtgtatcatgtagagctagcctccagggtggccaaccatgatccccagctactggtactcacacttttgtgtagtttcctcccaaactgaatgggaatggcctgcataaccaataagatgtagaaataatgatgtgtgggttatgtctgaggctaggttataacagatattgcagcttgcagcttgctttattggatctgtcattccaagggaaaatagccaccatgttgtgaggacatttaagcatcttcttggagaggtccatgtggcaggactatgcaagatccatcatgaaagcagatattccagtctcagtcaagtcttcaaatgattacagtccgaggcaacaacatgactataccttcatgggagcctctgagcgagaaccaccccagttaagctgcactcagaatcctaacctgcagaaactatgtgaaataatagacgtttattgttgttttgagccattgtgttctgggctaatttgtttcacagtaatagatagctaatacagcatggggtttaaaagagtaattttatttaaataacgttgaacagattgtaaaaaacttgcctgccagactgaaaaccatattttttattctgatggcatgagggagccactgaagggttttgaacagtagaatatttggaaaaataggctattggagagtctcttgcatatagagtatttacaaattaactgaattctatgtcatttgggcctggagaggagtcactaagaaattaaataccccccaaatacttcctgcttcatcttttttgttctgaaaatcttaaaatatgtatctgccttcttttgcaatcctaggaattgtgtttcatttttaatctttttctaattagtggagatttttctacttctagcattcatagaagattagagcccatgaaagataaaacagcttattccaagagtatgccgaggcaaatctgtgggttaccaccaggatgaagtgtatgtggtgtgtgtgtgtgtgtgtgtgtgtgtgtgtgtgtgtgtgtgtataaaatgattacatttcagccaaacacagacatagcagggaaaagtgtgtagtggaaaaattctgatcttgagcctctgttctctagccttctagtggagtcagattacaaaggggatttaattgccagcaagatcttgatgttaattcagctgccaaaaaagggattgctcatgattcaccaggttacccaggagaaattgggtgacacatcctgagtctctgagaactttaggtcttgggaggcctttacctgatcctggtcactgaaccgctatagcctctaagccacaacctttttggaagactgatctgggtgtaatgaatactttccttttaagtagatttcctaaatccaagttttgaggaggtagtctaaagtggctccacatctttggattttgcttaaaccttgtaaggactgacagatctcctataaaaatgttgtttatagctgggcacggtggctcacgcctgtaatcccagcactttgggaggccaagatgggtggatcacttgaggtcaggagttcaagatcagcctggccaacatggtgaaacccatctctactaaaaatacaaaagttagccaggcatgatggtgcgtgcctgtaatcccagctactcaggaggctgaggcaggagaatcacttgaactcgggaggcggaggttgcaataagccaagatcacaccgctgtactccagcctgagcgacagagtgacacttcatcttaaaaaaaaaagttgttcgttcctatttctccacatcctctccagcacctgttttttcctgactttttaatgatcgccattctaactggtgtgagatggtatctcattgtggttttgatttgcatttctctgatggccagtgatgatgagcattttttcatgtgttttttggctgcataaatgtcttcttttgagaagtgtctgttcatatcatttgcccactttttgatggggtcgtttgtttttttcttgtaaatttgtttgagttcactgtagattctggatattagccctttgtcagatgagtaggttgtgaaaattttctcccattttgtaggttgcctgttcactctgatggtagtttcttttgctgtgcagaagctctttagtttaattagatcccatttatcaattttggcttttgtttccattgcttttggtgttcatgtcctttgtagggacatggatgaaactggaaaccatcattctcagcaaactatcgcaaggacgaaaaaccaaacaccgcatgttctcactcataggtgggaattgaacaatgagaacacatggacacaggaaggggaacatcacactccggggactgttgtggggtgagggtggggggagggatagcattaggagatatacctaatgctaaatgacgagttaatgggtgcagcacaccaacatggcacatgtatacatatgtaacaaacctgcacattgtgcacatgtaccctacaacttaaaatataataataataataaaaaagttgttcgtgaagatgacctttctatatcgtgggtacacttggccttgcaggtgacctcagagactgtcatgcctgttttgctttgcttggagttcattggtagaatgatacggtggaaagaatagtaggttggagagtccagaggtgaaagtgctggttctcactgtgctcctaactagctgtgttattttgggcaagtcactgaattcccctgggtcacacagctttcttgcccataaaatgaggaagggttgcaatagatactttcgaaggttcattctaattacaatactctataacttgtgattccttttatgaactatcttcatcaaatttgaggtactgccaggcatagtggctcacgcctgtaatcccagcactcagggagacagaagtgggaggatagcttgagctcaggagtttgagaccagcttggtcaacatagtgagaccccgttctccacaaaaagaaaaaaaaaattgaggtactgtgtatctctggggagagttcagagtgataagctaactctgtttctaaagagaatagggcaaacgttacaaccagagatattccttggaaactttatgcactgttattagacacaaatacccattcattagttttccaaggtttttgtgtaagatgagtgttcctttgtaactgtaagaaatatttaatttctaagactcataaaggtatggaaaacatgagaaaggctgtcattgcatgcgttgacagtgagtaagtaagcaaatctgtgccatattgttcagtgtgttttatattgtttaatagctgcagttttagtcaattatgatttgtagcatattcttaacgttatgcagggggtgcagcctcctgcctaataatcagtgtgaccttagttttggtgcaacattagtatataatacggtacttaggaattgtgatttgtagctatgacagattttctttttaggattggtaagtacagacagggcccccttctggaacccttacaggataactgaaatccaccagttaatcagaaatcctctattttagcttccactgtaattgcatctcttcttcaccaagcctgttttgcctgtttttttctcttccctcagaggatcagtgaaaatgcaatcagatgaacaagcagacaagtaaaaaggaggaaaatcaaggagcctatatgttctctgagagagctacataaacttaaactctgttgcttctggagttgatttgagtgtgggggagggggaggaagagaaggtcaccaggtacagcagcttgtcttgtttgagcattcagccacagcttccaacactgaacagacagaaataaaaagttggtgctggctatgtgcgtcaggtagctctacatcagtcctgccactgtggaccatgtttacaccagtaggttattttctacactcctttcattctaagaggattacatcctccattgctttctgtccaggaatccttcaattccatctgaaaggcatgttcgtgacatttctagttggatcaggaattgactttgacctgtagtggtctgaggaagtgtcgagttgctgggtgacctgcatcttgttgtcacatagccagagagtattgtgaatccattgctgatctgtgttatatcacagggccagagggatactgagatttcttgaactaaatcagacattttctaaactctgatttgaaacagatacaaactcctgaacccactgaagcgagactgtctcctaaggctgtggttctcaaaattatgtgagcatcagaatctcctataggctttgttaaagtccatttgttgtgtcctcactcccagaatttctgattcagtaagtgtgcagtaggggcaaatattttgcatttctaccaagttcccaggtgatgctaatgctgctggtccagggaccacttttgacagccattgtcctaaggggcttctcaacatggaaagatttgaagtcaggccatagtccttttgaggtttctcaatcctttcactctgttgacccagcttgtctctgacctactgccccttgggtatgggggccatagatgtgtgctcatatcctgtctttcagttccatagtgcccagacaaccaagattgtgtctgaactatggtagccatctagtctgaatttttgaatgtagtgtaaaagccagagatttagggcagaatttatgtctcctattgccttaggaacattaatcttgaaaaaacagtcttaggtggggaggattctcatttttatctatgaggaattgaaactcagagtttaaattatttgcccaggaagtaaatggcagagttgatatttgaacccaggactctggcttcagtgatgattttccttcacctaagcttctctttctcttgggttccttttgaactgaagattttcttcaccctttcttctcatcatgagtctctttaattagagtgtgaattttgactttaatatagatatatgtgtgtatatatatatctgtatggaggcccattttccaacagttttatcaagtcagtgaagtcctcagatgtgtgtgtattcatatatattaatatatatgcacaatacattgcttcatttttaatattttgcgtgcattttatcatactatataatatgcatctttgtaagctgccctgaagcagttagaaacagggcaaagaatacatgtagacccccaactgtagtcaacacatacacaaacacattatttatccacccacaaggtggcttgttcttcataccttacagtctaagaaaatgtctctttggtagctaaagacttgtactaggttccagctatgcccttgactgtcatcagtaaatggagttgaaagtggctttgcttaccctgcttccacccagtaactttctataaaggagatcagggcatcacttagttctgtggggagagaggtggcaggtctgtattgacactttcatctgttggaaaacaagaacaaaccctgagggcttttaaagtgtgttctgcagtgagagtttatatgctttatccacattaagagcaagacagtttttttttctttcctaaagaaaacagttctttttccattgcgggggaaacaaaaaagaaagaaattctggcatctcttgctgaaggctgtaatgaggcaaggagctggattgcaggagaatggtaataagaagttaaaaatgatggtcatggatacccctccaggaacaaaatgactctgggaagatataaaattgcctgtttttgtttttaaattatcaaataatatggcaaaatgtatcagtgacccttactccattcccctatcttcttcctagttagatggcttttttacttttcccttcactcatgttttgtgagtacaatttttactgtcagcaaaacataatgaagatatttgttaaaaacctgtgacaacggttagcttccaagggggtctcagttatgccaacttctattattataaagaaactttctgatgtttaataacatgtataaagaatactaaaagaaattctgtgtcgtctagaactgagaataaggatcatcacatgaatcaagcattcttttatcttccctcaaccctattcacacatggtgattggtcagacaatattaatgtacttaggggcctataaaaattagagttatccagcacctagatattccaatgggaagcagaatgggttctataattaagcagtcaaatgtgtttatcaattgagagtaagttaatttggctagtgctgctttaagggagaaatcagagaattgaagttgcagaaagatatagtcagttctgctataaagtgacgtaagtgttctgagaatcaccatgctatgcaaaattgtgcaacaaaacccacaggatttatggttaaaatgggcttagtggcacacatttaaaaactttgtcaataaacattaaaacaaaaagaaacctaataaaaatggtaacactgttaatatggttaaatggttaaagaacacgtaagaaagacttcaagaagtatgtcatttttccttgaaaaaagaaccactaagtttgcttgtggaagtagacattggaaaggttgctgcttgtgagttattatgaagtggtggaaggagggttttcctgaaattggaaggaaggttgtagacagcaatgtgaatggatgggtggctcataacactcagtgacttaggtatccgataggtgttagaggcatgtgcacctgctttggttcagctgggtgtggttttctgcagtcacctagtatttctcatggatgaaataatgcataaacccaacatttgcattatactttaagtgttccctaatatatcagttgtgttgaaacaaattcatgttttcaaaataagcattatagaagaattgacaagtcaatcctcagaggataagtggaacccttcacccaccttctcattttttaaatactgatggtcatctatgagcgatgagccatatgagaatgactcttttatgcatgtttatatcatatgtcttataaaatgttaaataatattaagaaacataaacatgtaaagtcctccttccagccccacaagacaagtaataattttaggccaaatcaaaaatatcccatgtatcaaaatggccttgtcaagatgacatgtcctcacctcaacccacccctacccttgagttgagccaaatagaggctgagtcaccgatgactggatgttattcgttttctcactgatgattttccttgactgaggtggcaactgttgaactggctctgtattgtttgacgaagtatatatatataatcattggttctgggtcccaaggcagttcccagggtcttgtttgttgattttcaggatgtggctgcatgtactggacatttctcagcagatcctgcatacagaatgattgattctggggctttctggatgttctactctttttaggtccactttgggaaaaaaagggaagctactactttcacatgaagtgaaagtagcctgcatttgcagggaagccatgtctagaaaaagcataatcaaaatgatgtccttggaggaagcacctggctgtttacaacaagtgaaatccttgtcttccaattagaggggcagctggagtctcatgtgtgcattcaggttgcaaagagatgagccactattagatgagccaccactaacagaactgctgggatgatgtaaagtaataaattacaccactcatgtaagtatgatagcatcaatgtaagcatgtaggaaattttgttttaattctagatttaggtatcaactataaaaccctagaatctatggcaagtaggaaatgaggagagtatattttatcccacatctcatcttacaatgaggtgaggcctgcagaagcaacagtgactagccaggagatgctggcgagtcataatgtaactaaacaataacataaacgctagaattcccaactgttcttttagtaccatagtattgatttttgtaattcggtgagttttgaccacttacttaagattccaggcagccctcctgttgttgttgctgctctcctttatgccagcatttgtcacacttgcttgatttgattccctgcctcctgcctttattttattttattttttaaagctgaaaaaaatgagggttgcttgtattcaggccacggttaccaccagttggctttatttctttggtcaatatcctctcttccatggatagaaatatgaataagaataatccttgtacaaagaaaacaaaagtgctagcctactttgtatggaggcccattttccaacagttttgttttatctagtcagtgaattcctcagatgtattactcgagatgcaaggaatacattgggaaaaacaccccagaaaagtagtagcttccctttttttcccaaagtggacctaaaaagagtagaacatccagaaagccccagaatcaatcattctgtatgctggatctgctgagaaatgtccagtacatgcagccacatcctgaaatcaacaaacaagaccctgagaactgccttgggacccagaacaaatgatagtcttgataattaaaatcttgaatatttatctttcaagatttttcttaagccaaattgggaaaaaatggattatgaaaagtgcttagaattaaatccaatatttaagatatattaagtgttcatatgctgttgtataatctttaacttttcaaaatgaattctaaaaaccacacaactggaggacattcatgaaagactgtttacagtgtcatttagcacaattcccacacaccaaggataagctgactaataataatattaatagcagcagctaaaactcactgagcacttactagatgcctggcatcattcttcatggattacgtggaactatttaatccttaaccccaagaggaaaatgccatcattatttaccccatttgaggggaggaaactgaggttcaaagaggtgactcctttcataaagccagtcagctaacaagttgagaagctggaatgcaaaaccaggttatctacttccaagcttacactgctaatagaaataaagggaggaaccagtagcacttgagttagccatgcctctctcactgatcaggcaagaaaggccatgcctctaggcagttttgttatgcattaaagagaaataaaaataatacatgttttttctttcttacagatttgttgtgataatcttagaagatagggggaggaagtggtgtttaatgaatatctgctatatgcaggcactatatcaggtatttcacataacatcattagctgttgctgtccctgttattgcacaggtctcaaattcacttttgactgtagagtcactgccattttcaaaggatagaatcattgccatctgttctcatgtgtgagtttttcttgttgcctgtcttattcaactgatttcagtgggggtggggagttatttttaaagcaatacatgttattagtagaaaacttgagcaaaggatttgaacaggcagtttacatagcaggaaacttcacaggccatcaagtattggaaaagatactccaagtctttagtaatgagagaaatgtaaatggatggtctgcctctatgggcttcatcttcaacatcatctcatctcttcttaaaatgagttatccatttgtaaattgctcatttctctggggcattgtcttcgtaaacattttgtgatgcatcagtaatttcagcattcttccacccaagaatcacagtaaatttgatgtttgcccttcaattttagcagaattcttgttgcttggataggggcactttgcaaactgatgtcttatacttcttagtgccttaaactagatcctgtttagatatgttataacaacttagtatgagtttattttggtgcaaaaaaaatttgaaatccatgtatagttttttcttaatattcatttttcatgaactttttgaagacttcttgtattttatttacataaataaatgaataaaatgggggaggcatattacatatgctttttttgtaccctggctatgaagatggactaagttatctctaagatgccttccaactcgaagacactctcccctcaaggcaaatatcagatcatcaaatccagtcaagttataaattgacttgggttcagcataatccaaaacttattttgccaagcgctcttgttgtcaactgtatgagataccagtgtaccagtgcattcaaaggaaaatatatctgtattttgatttatctgcatttatttatttattttttgagacagagtctagctcttgtcacccaggctggagcgcaatggcgtgatctctgctcactgcaacctcctgggttcaagcgattctcctgccccagcctcctgagtagctgagactacgggcgtgcactaccacacctggctaatttttgtatttttagtagagatggggtttcaccatgttggccaggctagtctccaactcccaacctcaggtgatccacccacctcggccttccaaagtgctgggattacaggtatgagctgccgcacccggcctgatttacctgcatttaattcaaacagtacacattttgacttggtatgctgaaatcgttttagtgtattcagaccatttcataggctgatagtttactctaaaaatagaatatacagcatcaaacaaatattagtcctcaatggaacaagtgaggttgaaacttgatctaatgtaccaggaaaccatcccatctgagtgatctagtggcttttcataggctagagctgaacagtttctgatgactgctcaaaagcaagtcaatcagcgagtaatagagttcagaatctttattctctgttttgtatctggactgtgaacaacccttaataaagagtacattcctttctgccagaactgcccaatggaagacaacaagtctatctaggcttcttataaaagccaacagaaacctcccaagggagactcaaacctcagatcattgcattaggagctgaaaattagagtgccattgactgttgttgccatggtaatcactgctgacctggcaggttcttcctcatgatagccttctcaacaggttcacttctgctaaggtgtgaggtgtgtgtctctgtttgtttgcttgtggcaaagttgtcatgttttactctaaatacaaagtaagaagacaggagccaccaatgtcttgcacacaataaatgttaaatgaagatttttggggtttgattgggtgcaccgggtttggaaaaaaaatcagaggtgtcagtcactatgctcaaaatgtctgtgaagcccccattgctggctgctgtttctcttgaacagttcccgttgctttttggagtaatcagcacctgggtaagatttgcaactctccaatccacaaaattctgtaggtgtccagagaggcgggaagctgttttaaaactgtccttctttagaatctattatgaggcctttttgggggaggaatagcatggcttctgagtactcattctattaggttgtctggttttggggagttggtagagtactaactctaggttctctgatttctaggagttggtagagtactacctctaggttctctgatttctaggagttggtaaagtacttacgctaggttctctgacttctggggactggcagagtacttactgtaggttgtctggtttctggggccctcctttgggatttttatgcccatccaggtgtggaaactactcaatggtaatagtcttaaaatcatcttaagattttccagtcctgagatttccccaaacctaaactgatattaatagtcttatcagatttttgccatgtgttcattgaaaaaataatctccttcatgttaatgcaatatttatggaattattctttccaagaagaagggaaagataacatccaaagttttggaggtagtttaagcatttgtcttaagttttgtgtttgcaaaatactcttcagttgcctctcatttatccttacaagcctagccacacctgcccccagtgaacatctcatatttactgagaaataaaaatttagtacaggtgatttgccttgggtattgttaccagattgtgtttttgcccagtggagaagcagatgcatttaaaactgcacttgacacctgaaaaatcactgtcccagaagctactaagtcctttgtgaaattacaatgaggcggcgggctgaaccactggtggttctcctacccagggctcggcttcccacagacataagtgaatcagatgccagggtgtttcagtttaccgtagggggtgtgtaaaaagacgtaagattatttacttaggcagtgtagtgtggggacatcaccacagaccaatagtaagaaggttggccctgatgctgggctttttctaatagcatagacttgatcacatcattaacctctcttacctgtaaaatgaagacacctgcctttcctatgccacaggtggttgtatcaaatgaggtaatgtttgttaacattttttttgcagcctccgaagtactttggaaacgtactagcaccattctccgaggcccgatgatcgtacagtggctggaaacggcattttcgcatgtgcttttcctgagtctaggttgtcaggtggatccttcttaggctcctcagtttgaacaagctgtcagagtgtatcaaagaataccagataggaggagaagaaaaagtaacagctgaaaaaaaaaaagagggaaaaaagagtaggcactcccctccacccactctccggttccattcagcacactgacttcattcagcagtttttttcctgctttgtatgcaaagacagagcctctcatgagaacttggatggtggagtataaacactcatttaaaaataaatccagatgtagttggctgcagtcatctgacagaaccctgattctctcttcaataatgacgttcatttgtacctcattaattgagagtttttaataatttctccagggtaagtctgaagtttactttgttttatctatgaagaaaggacccacagagcaaatgaatagtgtaaataagtttgctaggaaacatttagcctgcttgagaggaagggccattttcaaatgccttacttgcatctatttgcatcctaactatctactgattatgagtgattctagtcattaaagtagtcctaggaggatttcttcttggcgatgttttattagcatttaatttgaactctaataaaactccatttttaaaaacttgcccataattcaatattgtcacacatcttccttccatcagtataaatttgttgtaaggcattattgtaattaattacgtgcccccaaatctcttgcatatcatctggtacaattacatccttttgaaaaagattttctattttcctttagtttcttaagattgaagtgtcctgacataaatagcatcactaaggcttggacttagagaagacctgcctgtaagaaaccaactagggaggaatgtaattagttatttccactatgactagattccagcccaagatagagaccaacttcttcttctaaaaactttagatttctgtaattgcataaactagactttattcataaaacaacttctgtaccatgcttgagatacagtgaatactaagtatttaatgaattaaggcatgagtgcacatcttttgggttttcgtttgtcttttgtgtagacaccttttaatatcaagcagtctgtattataataggaactctgcaagaagattgtattgaaagcagtgtgttcaacccatctattcactcatttttcaaatattttgagggacaactactatggatcagccagacctagaggtcagaggaagtgtgtgtgcctctgtacatttcacatttagcgttcaagccccttaacctttaaaagtgagattgatacactctacagtctttgcctcttactgtactttgagttgctgtgtgcctggttcaaatcctttcccagccatcctcctatggttattgctttatgcctaactagaccactattacaacaaagcagatgctctgggcatagctcatctctctttatgtttgtgtctaatttttcactttgttatacttctgtcacattttgaatatctgcggtactatggatctacacttctaagtaaataaagtacctttgtaccaaaggtaacagctaatatttttgttatttatctatgctaggcactcttagaagagctaacatatgctcttagaagagtgcctagcatagatagcacagatagagcaaatgataaaaagcatggatgcatgcatctaagagcatctgtgaaatgagtgtttttattattcccattttacaggtaagaaaactgagtcacacaaggatatatttgtgtaacacaatttcaaaaaggcaaactcttgctcttgttaacggtaaggcctttttggcatcccatatttgtgaactgtatcgatatgttatctcatttgatctgatacatcccttcccatttgctcacatagaagaagtgaaacagatgaaggtgagtctctgctttcagcagctctgcaggttaaggactgtacagcacttgaacccaggacttctgaatcctgatcttggactcttccctcagaaacaagctgcctttcttttgctggtctggccagtagatctgtactaaagatgggggcctctcaatctgaatgggagatttggaatcatggggacctgaagcagttaatggaggagtgttataatagaacatgtttcatagccagtccatttagtctaggatctagagtattccaaataaacaccaactcctaatttgttttttgctcctgtgttgaatcaatatctagaatatgctcttgacagctctggagcaaaaagccaagtctctgacaaaagaatcagtactaattgggaaataaatcagagtttgctatagctaaaagggaaaaactcccacacatttatctgtcattttgattcgttctttcatcctatgtagtacattttcagggtctcaaagaagctcatctgtctatgaaggtgctcatggaagcatcttgttttacatatgatgaaaatggagagagcacttcttttgacaggaaacttcacttcttgttactgaaaaccgtcacaacagtcattatgtctggctttcagagatttcctggagttaggagaacaatagacagttaaaatggcaatgtcaagagcattctggggttttataatgagtaccaagggaaattttttctctcgagtttgtaagaaaaaagtaggaggactatttgggaagctggggatatgtggaaatgaaaggcaatgctctatttttttaacggagtgttccttctaacctttgtaagctgaaaaaaatattataccatggtttccatgttcttgttattgagttgccagtgaagaagagaagtttctcttcagttgtccctctctgtaggttaaatcagcccctgaaaagacacatttgcagctttctgtatttttctttgattaaacatcagttagaattcttggatccagttttttaattcttgttgtatatgtacggtgcttctggggcttatgatttctaatttagcagcaggagttacttctcttttccctctacctccaaaaaaaaaagatgactcaagcattaggaatatgtttttgggcttattgtataattcaatgtgtatttggatttgcacaatttttaatcttgatttatgtagccctaatgtgatttctaatttttaataaagtttttgaggtactaatgtctaacacatttaaagtataaacttcataaacaatttatgtgacctgctgttttcatttctgtagtttcttgcttgctgctagagctgtggatggttttaaagacccctgtgttagttacgcagggatacctgaatggtaaaaataacctgctatctttatatttttttgaaaatctaacaatacaaaggcaattatgaattattaacatgtttttaaaatatgagtagaatattccttgttttaaaaattggtcaacattggccaggcacggtggctcacgcctgtaatcccagcactttgggaggctgaggtggacggatcgaggtcaggagatcaagaccgtcctggctaacacagtgaaaccccgtctctactaaaaatacaaaaaattagctcggtgtggttgcaggtgcctgtagtcccagctactcgggaggctgaggcaggagaatggcctgaacctgggaggcagagcttgcggtgagctgagatcacgccactgtactccagcctgggcaacagagcgagactccatctcaaaaaaaaaaaaaaaaaaattggtcaacattttaagatgctataaggtggaaataaaagttttccttcctattgtctcaatcctaaatatcattccttaaaggtaaccactgttaagtctctgcaaattctaccagaaatgacctaatgttctatttgtatacaagcacacatacacgtatacataaatacctatatacatgtaacacacatctatgcttacatgtgtatgtacggatacatatatggattccattgtggatatgttagcatataccttagacatctgttcacatcagtatgtataaatccatttcatttttaatggctatattgtattccattgcattggtttgccataatttagcttaccttctgtttatcaacatttacgtttttccagttttatcttgttgcaaacaatactgcaataaatatttttgtatatatctttttgcatttttgtaagtatatttgtaggatacattcaaggcaagggaattactggtaaaagagggtgtccgtttttagcatcactaaatattggcaaattgtcctccaaaatggctgccctaatttatacttccatcaacagtgtagaagaatgtcgtgtttctccacacccttgtcaacactaaatatgacaaaaatttcagtttgtaaatacaataagtgaaaatagtatcttattttgacattctgttgctgctgtatttgaggttcatttaagcaaatgcttactgagcactcactgtgtgtcatcactgaaataggaaatggcaataaaaaaatgtccttgttcttgaggagccatggaagtgaataagaagcctctttttagaagaaattcaaaggttgcaaaactagaaaagtgggtcttttgcaccctaccagcaggaaatgttgtctataaaagatagtgtccacccatgtcaactttcagttctgttgtcggcctaaattggcaactctctgcttctgcaatagtggccttgctttcattttggaagaaagttggctgcaggtaggagtagaaatgcctatctagtagctttggtttttctccaggacctgacttgattatctcactggttgcttttaggagaaagcacccactgttggcttctgttctgaaagggcaccaggcaagcatggaatcctatcagcagagcaagccaagagctcaataaactgtttattcattgttcaagcttctccacctatatggattattagaagaagtatttcatcttagggtacccagattagattatagatacttcaagtattctttagaattcactgaggggaaaaaaatatggaaagcagcatcagtcatttgggaccgtgttgtttcctgataccaaaataaccgaaatgaagaaactacaatctgtaagttaaaacagctggtttccagcctgttaaataaaaaccaaaaggtgtgacgtacatggcaaaatgggataaacctggttttctgagtggaggcagctattgataattttacttttcttatagctgaagatgaaggagatttgaggttctctgagaattaaaattcggctggagttagcctagggtgagaccctcagagctgtctgttcatgccattgcctcaagcctgtggacgttttttcaccctggggcaagaagaggctccagtttgcccaactgctgtgtgtgttccaggccagtgtccagtgaggctgacttggcagctgccctttccacagccagccagccagcccctgagtgtgttttaaaagataagcgacaaaaagccaaccccttttagaggggctggaacaggctagtagttgctaggcaagttaaagtaattcagcgtccttgccaaacgtctgccaggcaaatagggaactttcagagaaggggagtgagatggtggtgtgtgttggttgccataggaatgtttccctgattggaacaagaccacagagtggggagagcaagacggcagcatctacggttctttctgctcaggaatgggaacccagagtgggcagtagagcggaggcaagccatgcagaggcaggagcagatgagaccctagatgccacgagaagctaaacatgtggggaaaataaagagcagattaactcaggaaaattatatggggagctcttatgctactctgaagatctgagactcgttggagaatttacaatcccaaattaactcagggagaattccaactagactctgaaatgaattagatggagatttaaaatagggcaatttagtgggaagagatacttaatttgaaggtaggtattttgtatttatgtaaatattatgtcagattatgtctttattttagctcttaaggtagtaattaaatatctgttcatgaattatagtttttatcgagttctgatttatagggggaaaaggcacagttgaccaaattgtatgaaaccttggaccttgaagagaccctctgatgtgggctttactgccgcattaacaagcaccctgtgcatctggtggcagcttccagaatgacagctgagggtctgagtggaaataagtggcttttagcaaatgttgaacctcgaatgtgctatttaacctccctgattaattgattatccagctccgaaaataagaggtgatatagctatccccttatctcagcatggatgctgttctcatttgaatacaatttggggggtaggtgggggtagtatcagatcctagggtacatgctatgataatgacaggcttaattatcagtcagtcaatattgtttagaacaaatgttttcttttagatcacaatcttaaggaaacctttctttaacggataaagttttacttgtgcatatgaagtgtatatataaatttatcatttgccatatatttgattcatgttcagagggtatttaaaatagtatcttcttcagaatgtatatgttgggattatatattgctgtttccttcttatgtggtttctttttgtggtcatgtaaaagaagactaaagggatgtgatatttagtctcaaatatttgaattatagtcactgttttatttcagggctgtttccttctatcagttcctttgatctggaacaccaatgtcatttttactttacagttgaccgtatgctggctgactgacatcaattaactaatctgaggcaaatttgtaagccaaatgccaaattgtaatttactgggagagtataatctaataagaaagactatccttgggcttttcacatggtgaaccctagtgtgattttgacaaagaagcccaagtatatactactataatcttttttttaaaaaagtgatgttctgaccaggtgcggtggctcacgcctgtaatcccagcactttgggaggctaaagtgggtggaccatgaggtcaggagttcgagaccagcctgaccaatatggttaaaccccatctctactaaaaaaatacaaaaattagccaggcatggtggcgagcacctgtagtaccagctactcgggaggctgaggcaggagaatcatttgaacttgggaggcagaggttgcagtaagccgagatagcgccactgcactccagcctgggcaacagagtgagactttgtccccgccccccccagaaaaaaaaaaaaagaaagtggtggtcttatctagaccctccagagtctagactagcattgtccaataaaaatgtaatataaacctcaagtatgagctttatatataattttaaattttctagtggccacattaaaaaataaaaggaaacatgaaattaattttaacagtatattttatgttgcttaatatattcaagatattatttcaacatgtacagttgtcccttggtatccatggaggattggttccaggactccccacagataccaaaatctgtggatgcccaagtcccttatataaaatgaagtatttgtatataacctgtacacatcctcccatatattttaaatcatctttagattacttaaaatacctaatacaatgtaaatgctatgtaaataattgttgtgttgtattatctgtattattttttgttgtatttatttaaaaatatttttactgggcagttgcatatgtagaacccatggatatggagggctgactgtaattaatataactattaatgagatattttgcatttttaaaatacgaagtcttgaaagtcctattgagatgtgctgtaagcatatttttacacttacagcacatctcaattgggacactgaagtttcatggacaatacttgatctgtacttagattaaaacttacagtagaaaaagtagattcacatatccaagtcattccaaacatgcatatcagttgtccagtaactgaatcagtgtccatttctaaatttaaatttaactttaataaaattaaataaaatttaaaataaaatttggtttcttattcacattagccacgttttaagcactcagtaaccccctgtggagtggctgccatgttggacagcacagaaaggactgctttctctagccttttccttcacttccacatgtctcagattggaagacctgtgtgagaactcggatgggaagagaatctcatttcgtaagtgtggaaccacagacaaagagttgatgttcttaaaaggaagtttccattcaggctatattagaacctgcctggcaaggagttatctgtctggtaaaccacactatctccacccttgttcctagatacacccctcattgtctccccaatagataaaatcatgccaaccttgacagtctgcctccctcaggctcctcttgtcttccactccaggctggctcatttccattatgtcagtgtatttcctggttataggccccctttatctttctcattgtttcaatttccacatttggccttaatttctatgataccttagtgtagcattcaaatgtttaaattccagtttagttcttaattaagatcatgtatatcaaggtcaatgttgttgatttatgttaatttgaataagaaacatttcctttgccccttgctccagatttctagagtggctgggccgagaaactttacttcctgttcacctaggtaggtatcttgctttgggcaaatcaggattcttgaatataatcactctgtggtgaatcagacctgtgaaacttaaagaacttatctgttccctaaagaggaagaattaagaaatatcaggtggatggataaagacttagccttgccagaagttttgccccacaccttgcttgggtctgaaacttggttggtacatagtataacagtaactctatcactcataggttaaagagcacagaagtctgtcattttctcttgggtacctggcacttgcaagggacatcactgataaaattcatccactctgttttgaatatatcaagtgaaaagcacttacattgctttttcaggtctggagaatgatgaccttagaatgggcccttgttcaagacaattccaagtcctcccttagcaagaaagttagcttggaaattaggaaataaatatttgacctgtcgaatcattttaaattaacctgaatagaaatgcatattgtgttccttcctcattaccatcagaatcaaatcattttagagacagctaaggcttcgtggaaagaggatctttattgcctgtaaaataaagaggatctttattgcctttattgggactggatgccagtcccaagtctcttggctgcaaggactgtgacatcaagaaagccattgaattgttcttggcctcacttctcacctgtcaagtgagaacattagactagatgatcttaaggccttttggtcatcacatagtttgatcatctactctaatcccatggtttcttgggtgaagaaacaaaggcctgcaaagttacttcctaagatcccacagcaagtgtgaggctggtctctggttctccgtcatgctctgtctacttcaggaaacttcattgttcacttagaggttaagcttgaaccaagtaaaaatacccagatggatagctgattgtctgttcttcccataatgtcattttgtctgctcatatattgaggttgttggccaaacacctaaaatccataggttacctgttaattttttgcctccttaatatagccggccagtaattcaggtcagatacctctctggcataaagtccccaatgacctcctatttaaaacaaaacaggctgggcacagtggctcacgcctgtaattccagcactttgggaggctgagatgggtgggtcacttgaggccaggagttcaagaacagcctggccaacatggtgaaaccctgtctaccaaaaatacaaaaattaattgggtgtgctgttgtgcacctgtaatcccggctattcaggaggctgaggcacaagaatcgcttcaatctgggagacaggggctgcagtgagcatcgagatcgtaccactgcactccagcctgggtgacacagcaagactccgcacccacacccccccccccaaaaaaaaataaacgaaacactaaattagttctttgctggtgaaaatgcatggtaacaaaagaaaaagcagtagctgggatgcagagttaaatttgctcaaatattttccattaaaacaataactaccataaacccagagtagctgctctggttggaggccaactttcaagtgttggagcatcactcacggacaggaagcagagcctgactttcctgggaaggcttcttttagctggggcaaacctagggactttcattctcctttagcctttcattcaatgaaaaaggccaagaatgccaaggaaaggaaacttgttgattgtctattatataccaggcatgctaagtattttatatatagtggctcatttaattctgtaaccaccctgtgaatagataggtattatttccatattacagatcaataaaagttgtgtagcttgtctagggctacacaataagtgatcagggattttacttagctctaaaatctgattactttctaaatgtattatttgcaaaaaaagtcctttaatatttttgcttttagtcttcaaaagatcgctgatgcaggttaacagcctctgcttgttaacctgcatcagcgatcttttgaagactaaaagcaaaaatattaaaggacttttttgcaaataatacatttacatacatatccactaatcggcattgttggtgagtggcaaaaggtgtgtgaatcttaagtcaaatttaactttcagaagtggtgcttgcactttttgggtaaaatacagtgctatcattttggtttttaagaaatcctgttgtttgggcttgtggttctgtcttttatcctttgggtagatgaagggatgacatttgcattcagtgtccctcctgttccagttaattggtgctgcataacaaaccactccaaaacttaatgtcagcaacaaccatgtgtatttgactcatgaatctgcaatctggccagggctcagcagggacaactcatctctgctcgcctcagcatcagctgggttggcctagaggctgtgggttagaatcatctgaagctagcccacttacatgtctggagcctagctgggaagacagacagctgggctcctcaggcatctctgtttgtggtctctccagcatgatagcttcagggtagacagacttctgtaccagttcactgctcagcacatgacccaagagaaaaaaaagcaggaacctttcatgatctaccttaggaaatcagacagcatcactccactatgttctattaaactgaagcagttacaaaggccacttaggttccatgggagtagaaatagattccatctcttgatagggaagtgaaaagtttctcacaatcttgcagtggccactattggaagatatagactgctacacagataaacgagattgcaggtaatgtgctggtgcccaaaccagatgcatctctgggcctttctcttcagaccaagggagcatattggcattaaaatggaatataatctatccattataatttaactgacataacttatacttttcaagaaaattatctgaaaatttatgacactctatctactgttaaaaagaaattacttatgaaataccaatggattaggctaatgtggtagatggttgagtctttccctaaatttttcatcatttttgagctggtgtctgtttagtgttcctgaattgtcatcaggtttctgcttttctaccttgtgtgcagaggtaaacagctgaatatttatgtaaacagctttgtatagaaacttttccgtttaaaactaaaaagggaaggcaattgcacttaagattgaatgtttcctgaaggggttgtttcagcattttacagcagctgctgcctcctcttttggagatgaaattattattcaagacacatttctcaacgtttacaaacttagtacacgcacaccttattttattatgcttcactttattgtgttttgcaatttttataaattgaaggtttatggcaaccctgcattgggcgagtctatcaacacctatttccaacagcatgtgtttaattcatgtctctgtgtcacattttggtaatacaatatttcaaacttttaaattttattatatctcgtatggtgatcagtgatctttgatgttactactataattgttttagggcactgtgaaccatgcccatataagacagcaaattgataaatgttatgtgtgttctgactatgccaccaaccaacggttctacttctgtccctctcattgggcctccctattccctgagacacaacaatattaaattcgaccaattaataaccctaaaatggcctctaagtgtaggaagccttgttgaaagcctaaaggccaaaacaaaagctaggcctcttgcatcagcgagacaagttaggaatgcaaagcaaaagttcttgaaggaaattaaaagtcctactccagttaacacacaaatgataagaaagcaaaacagccttactgctgatagggagaaagttttagtgattcagatatatatagagagagtgagaatatatagaagatagatagatagataatatatagagagaagattaaatcagtcacaacattcccttaagccaaagcctaatccagagtaaggtactaactcttttcaactctctgaaggctgagagaggtgaagaagctgcagaagaaaaatggaaagctagcagaggttggttcattaggtaagaggaaagaagccatctccataacagaaaagtaccaagtgacgcagcaagtgctcatggagaagctgcagcaagttatctagaagatctagctaagatcattaaacactaaacaacaaattttcaatgtagatgaaacaggcttctgttggaagaagatgacatctaggactttcatagctagagaatagaagtcaatgcttggcttcagtgcttcagagggcagggtgactctcttgttaggggctaatgcagctgatgactttaagttgaagccaatactcatgtaccattctaaaagttctaaggtccttaagaatgatgctaaactattattgcctgtgctttataaacggaacaacatagcctggatgacaacacatctgtttatagcatggtttactgaacgacttaaccccactgtggacactcactgctcagaaaaagaagattcctttcaaaatattattgctcattgacaatacacatggtcacccaaaagctctgagggggatgtacaaggagattcttgttttcatgtctgctaatgcaacattcattctgcagctcttgggtcaaggaataatttcaactttcaagtcttattatttaagaaattcatttcataaggctataattgccatagatagtgattcttctgatggatctgagcaaagtaaattgaaatccttctggaaaggattcagcattctagatgccattaagaacattcgtgatttatgggaagaggtcaaaatatcaacattaacaggagattgtaagaagtggattccaatcctcatggatgacttggaagagtttaagacttcagtggaggaagtcactgcggatgtagtggaaatagcaggaaaactggaattaaaagtagaggctgaacatatgactgaatttctgcaatctcatgataaaacttgaagggatgaagagttgctgcttatggatgagcaaagaaagtggtttcttgagatggagtccaccctggtgaaggtgctgtgaacattattgaaatgacaacaaaggatttaaaatattacataaacttagttgatgcagcagcagcagcagggtttgagagtattgactccaattttgaaagaagttctgtgggtaaaatgtggcaaactttattgtttaagaaattgccacagccaccccaaacttcagccaccaccctgatcagtcagcagtcatcaacattgaggatcctctaccagcaaaaagattacaactcactgaaggctcagatgatcattagcatttttagcaataaattatttttaattaaggtatgtactttttttagacatgttattgcacacttaatagactacagtaatgtgaacataacttttataggtactggggaaacagaaaatctgtgtgactcactttattgtgatattcactttattatggtagtctgaaactggacctgcaacatccctgtggtatgcctgtaaggaagatcatatgccatttgtctttctgtgcctggcctattcacttaacataatgccctccatgttcatgttcatccatgttgtcacaagtggcagagttttctttttttttcctttttttttctttcttttttttttttttagacggagtctcgctgtatcacccaggatggagtgcagtggtgcaatcttggctcactgcaaactctgcctcccaggttcacgccattctatcgcccaggatggagtgcagtggcgcgatctcggctcactgcaaactctgcctcccaggttcacgccattctcctgcctcagcctcccgagtagctgggactatagtcacctgccactgcccctggctaattttttgtatttttagtagagacggggtttcaccttgttagccaggtggtctcgatctcctgacctcgtgatccacccacctcagcctcccaaagtgctgggattacaggcatgagccaccgctccctgcctcagagttttcttttttaaagctgaatactattctatatatatatacagtatagattatatatatatgtataaaatctcacatttgtgcattctagttatcttttaaaaatatatttctaatattgcattgtaagggaatgttggtatatcagtcctttgcaatttattgaggttttctttatagcttagtcagttttcagagttaatatttcactaattattgtattcaatattctatatatgttctatacatctaaaagttaattatgctatttaaatctttttactgacctttttttatctgctgaagttatcaattactaggagagttgtactgcagtttctccctctggtgatggatttgtctatttctcttaattgccatgtgtgatataataagaaatatatatttggtcactgccctcagtttctgacacagagctcctaaaatgcttgtaatttcctgagtaataggggtgcttattaacgctatttctttccccctctcttcttgctgtctcttgtttttttttaaattattattatttttatgataaaagattgttttgtttcaacagctttaggagtacaagtggtatttttggctacatggatgagctgtagagtggtgaagtcagtctggatttagtgtaactgtcacctgaatagtgtgcattgtactcagcaggtattttttcatccctcacccccatcccaacctccccgcttctgagtctgtagtatccattatactactctgtctgccttcgcatacccatcttgctgtcttttgaattgataagtctttcttcctcactccaagtcccccctacctgtttagaggttgtttgctctatgtctgtctgcttccttagtagctgctcctgctattttaacaggcatcctttaaaaaaaaaatctctatttgaatatgctccaaaattcaaagacatatctctctggcttttctatttttcctccacaaattacacatttttcttatagttttaaacaatgtttttcttttcccatctgtttatcaatatcttctctcattgttactttcttccatttcgaggttttcatctgctatcgtttttttttttttctttctttctgcagtacgtactttagaatttcctttagcgggtctttctctcttctaatagcaaactccgtaatagacatcagtgataacagagataaataaggctcactcccatacaatatgtaattgcaatgtaaactaagtacaaaattagaggttaggacaaagtgttgagagcacagagaggggagactaactctagagagtgaggagagcgtctcaggaacaataagtgtacattaaattatggaaggctatgagtatattcatggaacattcatcagctcagtgggctggagcttaggcgcgggttggtgccagatggagctagagaggtgaattagctagatggtgggctgtgacgagccttaaatgccaaattgaatgcaacagggaattgggggaggttttaggccggggactggcatgattagatgcattatttagaggtaaactgtgtgactgcatggagagccatgagctgcaatagtcacctgagaggaagctgagtaactaaagcaaggcaaagcaaggataatgaagagaagaaaagaaattttaaaagacattcgtgcggtaaaatcttaacagattcaaagtgtagagcactggaggatgtactccagggactctaatttggaggaccagcaagcttgaaagcacaggaaggagtgctcttgtttgggagtggagggagggtggcattagagatgatgagtttaatgtgtagcataaaacgttttatgtgcttcaggacaaatggtgcgttggttttagaagaattaatatttgagatgttaggggggatatctatgtgctgagaactctgcgacattttctgattatatttggctgttgtggtcattactatttttcttttactttctgaattggaatacagatctgggtttcaggatgcaaagtctattttctgcaataaagtgtaattaaataatagttggggtgcagttacattttaagtcagaaacttgaaatgtagtcctgccttcactgtgttttgcaaaattattgcttctgagcactgattgctcttgactggtaggacctcttgttttgtgtctgtttttatcttagcactgttttcaggctgacaaatgtaacccagattgtctaagagcatctgtcaagacaggagagaaggaagacagggcaagagaagaggggagggaaaaacatacttcatttaattagaaaagtatttgcagggcttatgcttcctacctgctctttttagctagcaagatcagattctcccctggagattgcttcctggcctgtaagcccagactagggctttctttttgatgtgtgagtcatcacagtatttctgtgacttattatttactcacatgtaataattgcagtgggcactactgagaattgagaggagcttcttcccaccagggtgtgaagtagttttgacagcaggtgtggtgtgtcagcctgaaacctgaacagggcatcaccttttacctggtgccatcacagagtgctccagatttgggtaggaagaggatcccgtcacatccaggcatctcttggcagaggaaagggagctggtcagggagttttgaaaacaaaaattgtactataaaatgttttatttggggagctgtgctctggcagcatcctgatctgaaataattcctagccttttgtgtggttggtggtggctgatccatggaatcctgctgtgtcgctcagctgctgttaaaatattggatcaaagaaatgactcaggaggaaaagtgtcaagtaaaagttaatcatttcatccttgctgaaagatagaatttgagttgttaaattgcagaattagtcctggagtttttgtagttgttgttgttgttagaaattagttatgataagaagttgtattcctacatctgcatagagacggtgtttatcactagcacctgtctctggttggcatcagtaaggcagaaagtgagaagtggtgacatatgtgaacgcatgaacaatgctaggcattgtacctaaattatctcatttaatctattgtgcaataaaggaaactcagagatgctcagagactaaagacgccatccgaagtcactgagcaggcacatggcaactaccgttcaaacccagtgtaattgttggcaaaatctataccacgctgccgtcagtcatctttcagtatgtttttctaatttgaaagagcagatgaggtttccatgatgaattagtttcacccaggtgttatcccttgatcgaaacaccatcctgtcacgcctgccccagattcccagccttctatccccagatgctgtcttcaagtaacaaaggaaggaaaacatctgaaggggctcactccacggtgcagcagccagccctacttcattctttgctttgaactgtttcttgactgcctgttagaccatttgtcagatatgtttttaaactattacagtttctggctatccttgtcacaaggatagattacacaaggttctcagcagcaaagatgtcagctgtacaaatacaaggatttggtccttgtttttcctagtggtttaaaattgactaaaggctacggatgggccaaatgggacagccaaggatgggacagcttgagctgtcaggaaaggaacatataaaggttgtcttgggagcaggtctccttggtgcccatccaaagtggcttcctgcattctacaaagcttaggggaaaacagcatttaatttacatggagtgttctgtcgtctccaagagaacttaaaatcacttgcttgaacaagcagaatttacaataagagggcttgagaacatgaatggatagccttttgttatggaaacaagttgtgttatacagattaaaatgttaatagttttggatggcaattggaactggagcttatatctattcatggttgttttccctgggacttgtagatacccagccaaaagagtagagtatttttagccaggttgtcacccacaaagaaaataaaatgaagatctagaactaggaatccggagttgagaaaaagaggaacagaaagtgggaggattggttacaagcaatgaccatttacagaacaggtgtgactcattctccaaggtagagtttatcaccttaccccacaaggaatgactttctggagaacccatattagtctcttcctttataagacttcacaggagaaaaaggagtgaaaaggaagagagactatcaaacttatccaacccagggcctgtgggctgcatgcggcggcccaggacagctttgaatgtggcccaacacaaatccataaactttcttaaaacattatgagatttttttgtgtgtgattttttttttctaagctcatcagctattgttagtgtattttatgtgtggcccaagataatttgtcttcttcgagtgtggcccagggaagtcaaaagattggacatccctgccaaaggttgaggaagttcatgtataaccgtgtattcagataagttctaacttacctgaccaatttttgtttgttaattttatgccacctttttgcagttaagtggattttggcatagttgcaggggccatttgtactaacctctgttgatttttttttttaatactttaagttctggggtacatgtgtagaatgtgcaggtttgttacataggtatacacatgccatggtggtttgtggcacccatcaacccgtgttcatctacattagatatttgtcctaatgctctccctcccctagctccccaccccccaacaggcccctgtgtgtgatgttcccctccctgtgtccaaatgttctcattgttcaactcctacttatgagtgagaacatgcagtgtttggttttctgttcctgtgttagtttgctgagaatgatggtttccagcttcatgtccctgcaaaggacatgaactcatcctttttaatggctgcatagtattccatggtgtatatgtgccacattttctttatccagtctatcattgatggacatttgggttggtctcaagtctttgctgttgtgaatagtgctgcaataaacatacatgtgcatgtgtctttatagtagaatgatttataatcctttggatatatacccagtaatgggattgctgggtcaatctatctatctgacaaagggataatatccagaatctacaaagaacttaaacaaatttgcaagaaaaaaacaacctctgttgattttctactaactttttagaaactcttgttcttaaagtgttcagaggccttgtgtttctcatctgtgtaataaaggaagtgatatagatgacccatagtgtatgatttgtaactccagaaaatagttataagtgaattcagttatcatttgatgtactagacacccaatgactaggggaaaatcagcaaaggataggtagttctctagagccctgtctggtctttcctgtgtacgcacagctttaagcatttgcccagccttgtatacctttagagataaggggatctttaaaaggctgtctttagttctttccttccctggattttcttattaaatttctggctgctctgccattttgtgtttgctcgttccaaccagtatcaaaacctaggctagccttgatgttaggctgtcctgattgcttgccactgtgacatctcttatttctgatagtaccctgggcactgttttccatgccctgttccaaatatagtcagccccctccagcagggcagtgagctgccagcccacatagtcttcctcatctgctgaggctggggtaggactttcaggtaatggagcctaaggtgtgagggggaagaggataggagcagtctctggggaagatgtcacagattccactgttgttactaagattcagtaggtgttctttataaatccttttcaatttgttatatgccattgatcagtttttagaatcttaatttggttgtttttgacaactgtgcccacttttatcattgccctttggggaaaagatttgccgagctcctcattaagccattccagaaatcccacctctttttcatataatttataagttttctttaaaacttattttacaattctgacttcagattagtgcatagacattatagttgtaaacatcttgagtctcttctattatctcctacgagccctgcaggtgcaatttaccatgacttggccctaaaccatattgatttaatgaacacagtcagctatgtatattccttgatgatctgttggtaatttgaaagatcatatcaacagacattatcctgaatggtagagttgtgaagaattgtgtcctgtgaattttgcaattcagaggacagattgattagaaagaagatattctgctggataatattttacttcaataaatctggcaaatttataagatctttttttgagaaaaagtctaggcaggatacagttgtggtaaagagtcttttaaaaccatcctcacaaaacagaaattaagtaccaaattggttgccgtgatctcaaagtagtcatttattcccttctattttctgtactccataagaagtcttaagccttaatcacatttgagtgatagaaacatatcacagtaccagaagacagaaaattaaaatgaagtctggctctaagaatgggatagaaactagtcataattctaatcaaaagttattttattttctaatttttaataattatatattgtgatttaaaaaattttaaaatatgtgcacatgcccctctccttcaaattttatgtgtgccaagcatgggctccattttggcagtgaaatggctgtgcatgccacagtagactaggggagaggtactgactatagaggttcactccaaaaggatccggcctaccaaatcatagtaatgttgctcatatcttttgtgaatctaaattattaaaataaaggttaaaatcataccatttaaggggtaaagttaatactcaggagatcttgaggccaaatagtctcatttcttttgggcacagatctctctaatggttaggttgtttccagagctatggtgccagcagggccattgtggttgaagcaggcccacagctgatgccttggatactgagagcaaggttcatttccaggtcagtgaagcttgctgagagccagagataaaggatgaggacctgaactatagggctgtactagaactcatttaggaacatagacataaacctcattcacagggatggggcaagtgtggcaggactggcaaaagaaaactgcaaggagataagcaggtggtatgcaggagtccacttcagtcaccttagatatacctgggcaagagcagaaaaagtaacctcagacgctacctgtccatgggatgggctgtattaatattcagataagtaaggtgggatgagcctgctggtaaaaggctttcagagcatgtaactggatgaagtgtaagccagggactgacctgtgtggtctaccctttgccaaggagatgtcattgtctctattcataatgacaattgaacagtccctgctgctggcacaaataccacaaggcccaaacaatataaaacaaaatatatccacttttatcttcatggttatcattattgctattaataaaaagaaaggaccttgggttagtggacatgaccctggaatggaagttgaaacttagtgcttggcccattaagacattacagaaaaaaatcatgtaattggaatgaatctcattttcccactgtccttggtattattggacaggatttctcaaccctaatacaatgaacattttggaccagacaattctttgttatggggagaagaggggcaggctgtcttgtgtgttgagtatttaggaaggtctctagtctcaacccaccagatctcagtagcactccccttccccatcatgacaaccaaaaatgtctccagacattgtcatatatattctggggggcaaaattgtccccagttaagaacggctgctgaaaagatacaaaataagcttgtgtaagatatgactttgtccttaaggaattcacaaacctgttaggtgaacacacctaatataatataatccatgtacatggataatgtggtaaaagttaaatttggaacagtgaatttctcaacttacacataaaaagagttaaaagcagaatatgagactagctacggacaggaagggtgctgaggagccagggatagaaacagcatttgaggatggacagcattcagcatatttaggggagatgaggagagcagctcagctggaggaacaagagcaagtatgtttgtcaaggtccgtgagaacattacctgctcagggtggatgtgtgtgctgggaagtagaggcaggaggctgcaccaggctgctgctatcctggagcacggtttcacactccacactccacatgtccctgctccctaaaacatcacatcccaggcataaagttcgttctagaaatcaggccttacaagtattagtgattctacttttctcctctccccatgtgattaagtgtgataataaaacacctgctaatactttaactcacaatctgtgccccctcattagggattctacttgataaggctgttagtgtagtataattataactaacacttattaagttctcactatgttccaaacagtgttctaaatgctttacatgtctcaattattttcccaacagccctagttgtagtatgttgtcattttctcagttttcagaatgaggaaactgaggtgtgaagaggttatatcttgaatatgcccaagattatgcacctaataagtggcataaacagcatttgaatccagatggtctggctccagtgtacttttaacccatattataccccttctctatccatgctgataaaattgtgtatgtgacatagatagcaaaaaaactacatagaaaaaagaaacaagtgtatggtgctgaaggaattactggttcatacccagagctctggcctctgaaaaatccaaaactgtccttgaggcatgggcttatctgcagggagtttacattccaggggtgaattgaaaggaagctctgggtttggaattaatatcacataaattacttagatatattcagtattaggaatattggtgtacctaatctgaatcttttaaaatgggaatgcttagatctgacttatttccagatttcatagattaatgtattcaattcatattccccaggatattaaagtacagtgcattcatctggagctgtttaaaaaagaaaaaaaaaaagagtgctttatgtttgtataggtcattttcaattgcatcatttaattttatcataacagctccagaagcaaaactgcttatgaagcataagagtttgcattaatcttttcattcctttgccttttattattgccttgtatggcgaaaagatgtcataattctgttttacagatgaggaaacaggtacagagagatgaagccaattacccaagaaggcagaaacagatttaggtgtgtaattctcctaagccccctgggtagattctaaatctgctgcactgaaatgggctgcaggggaggccagacagccaatatggtttccttcgtacacaaagactccatgctcagccttgaccacgctggtgtctcgccagccccagcacatgcccttctctgccttcactcattctacttccctgacctgcattgcttcctctcttctctgatactctaagttacgaacattctacaagggaaaggaaggctcacttttattttattttattttattttattttattttattttattttattttattttattttattttgctttgctttaaattctggggtacatgtgcagaacgtgcagctttgttacataggtatacacatgccatggtggtttgctgtacccatcaacctgtcatctatattaggtatttctcctaatgctgtctctcccctagccgcccacaccctgacaggccctggtgtgtgatgttcccctccctgtgtccatgtgttctcgctattcaacttccacttatgagtgagaacatgcggtgtttggttttctgttcctgtgttagtttgctgagaatgatggtttctagcttcatccatgtccctgcaaaggacatgaactcatcctttttaatggttgcatagtattccatggtgtatatgtgccacattttctttatccagtctatcattgaggggcatttgggttggttccaagtctttgctattgtgaatagtgctgcaataaacatacgtgtgcatgtgtctttatagtagaatgatttataatcctttgggtatatatccagtaatgggattactgggtcaagtggtatttctagttctagatccttgaggaattgtcatactgtcttccacaatagttgaactaatttacagtcctaccaacagtgtaaaagtgttcctatttctccacatcctctccagcatctgttgtttcctttttaatgatcgccattctaactggtgtaagatggtatctcattgtgcttttgatttgcatttccctaatgaccagtgatgatgagctttttttcatatttgttggctgcataaatgtcttcttttagaagtgtctgttcatgtccttcgcccactttttgatggggttgtttgtttttttcctgtaaatttgtttaagttccttgtagattctgaatattagccctttgtcagatggatagattgcaaaaattttctcccattctgtaggttgcctgttcactctgatagtttcttttgctatgcagaagctctttagtttaattagatcccatttgtcaatgttggcttttgttgccattgcttttggtgttttagtcacaaagtctttgcccatgcctatgtcctgaatggtattgcctaggttttcttatagggtttttatggttttaggtctttcatttaagtctttaatcaatcttgaattaatttttctataagatgtaaagaaggggtccagttttagttttctgcatatgactagccagttttcccaatacctgttattaaataggaaatcctttccccatttcttgtttttgtcaggtttgtcaaagatcagatggttgtagatgtgtggtgttatttctgaggcctctgttttgttccattggtctgtatatctgttttgggccagtaacatgctgttttggttactgtagccttgtagtgtagtttgaagtcaggtagcatgatgcctccagctttattgtttttgcttaggattatcttggctatacaggctcttttttggttccgtatggaatttaaagtagttttttttctaattctgtgaagaaagtcaatggaagcttgatggggatagcattgaatctataaattactttgggcagcgtggccattttcacgatattgattcttcctaaccatgagcatagaatgtttttccatttgtttgtgtctgctcttatttcgttgagcagtggtttgtagttctccttgaagaggtccttcacatcccttgtaagttgtattcctaggtattttattctctttgtagcaattgtgaataagagttcactcatgatttggctctctgtttgtctgttattggtgtataggaatgcttgtgatttttgcacactgattttgtaccttgagactttgctgaagttgcttatcagcttgaggagattttgggctgagacgatggggttttctaaatagacaatcatgtcatctgcaaacagagacagtttgacttcctctcttcctatttgaatacgctttatttctttctcttgcctgattgtcctggccagaacttccaatactatgttgaataggagtggtgagagagggcatccttgtcttgtgccggttttcaaagggaatgcttccaactttggcccattcagtatgatactggctgtgggtttgtcataaatagctcttattgttttgagatacattccatcaatacctagtttattgagagtttttagcatgaagcgatgttgagttttattgaaggcattttctgcatctattgagataatcgtggtttttgtcattggttctgtttatgtgatggattacattgattgatttatgtatgttgaaccagccttgcatccctgggatgaagctgacttgactgtggtggataaactatttgatgtactgctggattagatttgccagtattttattgaggattttcacatcaatgttcatcaggggtattggcctgatgttttctttttttgtagtgtttccgacaggttttggtatcaggatgatgctggactcttaaaatgagttagggaggagtccctctttttctattgtttgaaatagtttcagaaggaacggaagcagctcctctttgtacctctggtagaattcagctgtgaatctgtctggtcatgggctttttttagttggtaggctattaattactgcctcaattttagaacttgttattggtctattcagggattcgacttcttcctggtttagtcttgggatggtgtatgtgtccaggaatttatcaaattcttctagattttctagtttatttgcatagaggtgtttatagtattttctgatggtagtttgtatttctgtgggatcagtgttgatatcccttttatcattttttattgtgtctatttgattcttctctcttctcttctttattaatctggctagtggtctattttattaatcttttgaaaaaaccagctcctggattcattgattttttgaaggctttttcatgtctctctgtccttcagttctgctctgatcttagttatttcttgtcttctgctagcatttgaattcgtttgctcttgcttctctagttcttttaattgtgatattagggtgtcgattgtagatctttcctgctttctcctgtgggcatttagtactatacatttccctctaaacactgctttagctgtgtcccagagattctgttacgttgtgtctttgttctcataggtttcaaagaacttatttatttctgccttaattttgttatttactcagtagtcattcaggagcaggttttcagtttccatgtagttgtgtgggtgtgagtgagtttcttaatcctgagttctaatttgattccactgtggtctgagagactgtttgttatgattttcgttattttgcgtttgcttatgtgttcccttttctttgaaacttctccaacatctgttcttttttgactttttaacaaaagccattctgactggtgtgagatggtatctctttgtggttttgatttgcatttctctaatgattagtaatgttgagcatttgtccatatacttgttggccacatacatgttttcttttgaaaaatgtctgttcatgtcctttgcccactttttaatggggttgtttgttttttgcttgtagtaaaaatattggcaactttcttaaccctcttgagcctcaggtttcccacctgtaaaacgtagtcagtacaacctactacctattgctgagaagatttttttatttaaagaatctcaatgaccacatcagtattttcccctctcagtctggcctaagacatacctgctttgagaaatcttttctttgcttgaaatccttgtctgattaaaaactcctctgaatgctgtgataaatcctatggtgctggattaaagttagaaatatcagtatgaactcctgtttattttaatgcatatttggatagctagctacagaaatacagaaatctttgtctgattaaaaaccctcctctgaatgccgtgataaatcctatggtgctggattaaagttagaaatatcagtatgaactcctgttattttaatgcatatttggatagctagctacagaaaaacagatatctctgtatacctgcattaatatacatacaaatattttccagctgtatccatgaagagcaatgaacattcctagtacccagattttggtttctgaatatcattttctgataaaatagcccagggctccttggagaaatggctgattctaagactgggagaggaaaatacaagaggaactgagagcatcttttggtgccagaaagtaagaaaatgctcaagattttaaaagtacactaaaaggacacagaagccaatctgaaagaacatctaatggccaaagctaggcaaatataatagctacttttcttggggaagttggaaaatgtacaggataactgaggagccagagagtctggttttgttgtggtagtattgcactttcatttctaggagcattaattaataataaaaaaaaatcttccatgaggatatggactgcttacatcatatcattatgctttcatttaggtgatgctaacactggaaaaagtccaagatttcactgaaaagtcttccatgtgttcagaatataaatcctattaacaggacttcatcatgatacttcttaaattacgttcttgatagcagtcattcaagagagtctctcagcttttaaatgtgccagtaaggtttaaaaaaaaaatccaaacattggtcaggtatggtggctcatgtctgtaatcccaacactttgggaggctgaggtgggaggatcacttgagcccaggagtttgtgaccagcctaggcagcatagtgagaccccatctctacaaaaaataaataaaatcagccaggcatggtgatgcatgcctgtggtcccagctactcaggaggctgaggtcaggggatcacttgaccctgggaggctgaggctgcagtgagccaaaattatgccactgcactccagcctgggtgacagagggagaccctgtctcaaacaaaacaaaacaaaaacaacaagaaaacacaaatatttaacctagcttatataataagagaagaaaacacctacatcagtcaagctggacttcactacctgatattgctccataaaagaatgaccaataggagcttaggttttaggccttactcagttgactcagcaccccacaggccctcagatgaaacagttcacctttcctgtctcccccaaccagctttcctgaaaaataattgacaaataaaaaatgtatatatttaaggtatacactgtcacgtttcaaaatgtgaatacattgtgaagtgattaccaaatcaagcaaattaacatccatcacctcatatgctcaccttttctttgatgtatggtgagaacactaaagatctcttagcaaattttaagtatacaatacattataattaactatagttactatgctgtatatttgatcaccagaacccatcttataactgaaagtttgtatcctttgatccaaatccccacatttttcccagccactgacaaccaccactctactctgtttctatgagttcaactgctttagactccacatgtaagtgagatcatacagtatttttctttctgcactggcttatttcacttaacataacatcctctaggttcatctatgtttcagcgaatggcagaattttcttctttttaaaggctgaatagtattccctcaggtatatgtaccagatacacatacataagggaatatatatatgtctcaggtacatatacataagggaatactattttttactcattcatgtatgtgtaccagatacatatacataagggaatatatatatatatgtctggtacatatacataaaggaatgctattttttactcattcatctctcagtggacacttaggttgttttcatatcttggctattatgaatagtgctgcaataaatatgggagtgcacatatctctttgacatactgatttcagttcttttggatatatacccagaagtaggagtgcaggatcatatggcagctctattagttttttgagggaatatccatactgttttccacagtggttataccaatttacaatcccagcaagagtgtacaagggttcccttttctctacaccttcaccatcacttgttatcttttgactttttgataacagcctttctaatagatatgaagtgatatttcattatggttttgatttgcatttctatgatgattagtgatgttgagtaccttttcacatacttttggacatttctttgtcttccttggaaaaatacctcctcaggtcctttgcccatttaaaaaaatcaggttatttggttttttttttttttttgcaattgagttgtttgaatttcttatatatttcggatattagccacctattagatatatgatatcagatataatagcaaatattttctcccattctctaagttgcctttccatttgttgattgtttcccttcctgtgcagaagccttttagtttgatgtagccccacttgatatttttcttttgttgcctgtgcttttgaagtcatagtcataaacttgtagttaaactttttttaacctgtattcatctacttgaatagtaagaataattagagaattagagcgtgtgagcccccagaccaagaacatgatggatagcttagctttaaaaaaagccattctgtggttataaaatatctatagaagtttctaaactgaggtgagatcagagacatgatgagagaagtagtctgatggcgcagtgaacatcgatccaataagtacaagatggcaggaagactaggccacagtcaagaagactcccaccttcctttccaaatacctttaatgcctcccccatacttttaaggaaactcagacaccttcatttggcttatacaacatttcctggtcagtccccagtttacctcctttgagctcattatcccaatgtaagtatatgagtaatgagtttccatttctttctcttgccatgcctttcttttcgtggcctgtgtacctgctaccccctcttccaagaacccttttttattcctttagctctcctgtttcaccaccattttttccaggatatcttttatgaaccctgtctgggtaaggggaccttgctaggtgctcctttagcattgatcctctcctgacattggcacttgacatgctgcattgtatttggctgttaattttctgttgcccccttaggactgtaatcctgagggaagggaacatgtttgttttgttgtatccctagcccctaacccagtttatggcaccaagatgcccaacaaataacttgtcgaatgagtggacaaagtaatgaatgaatgaacaattgagcaatattaaatatgagctagcttactgagaagactttccgaagtccactccagagatctttaatgggaaaaccatcatagaaatcaaatacaagtcacctttgctatgaagcataaattttctttgtagagccattttatctcttacattctgagaagccctctgaacagtaagaagaagactcttcttcttagaagaggaggaactcgaggggaaaatcattgacattaaactaggattttaatgctagaaataaataatagtaacaaagagcctattgtaacaaaccaggcttaatggtttataacctaatttaatgaagtatttcattgacagatcttactttcttttgtgtttatattcaaatagcaatagaaccattatatagagtttctaaatattttaattgtagattgtcattaaatttgtggtatcttgtcactttaaattaagtagaggtttatttgttaaacatttcacagcacctccgtatcctgagtgcctcacacttcagttgtctctttctatggcagaatagaagagagccgagtaagagaatggagagttgaatgtcatggttgatgccaaccagagtagaccatatgctactgtatgcatctacagctgacctgcacaaatcgggtgatgacgtatttatttgtctgagacttccgttgaccaaaacagcatctgactcaactccatgaatgagcttcatcagttgagtgcttccaaaatgccagtagaacattcactttaatcagaatctcaagtcatactttagatacaagggacagaagaaggtatttaactcttcattcacagtgcctttgaagaatggcattggttgctaaggaacagcaatagcatattcttgtgcaaacaattggtctgctgggaattcacgttactgtttcaacaggctctcttagaaggaggcaatatctgtttctttgtttgctagtgtaatggcaacgtatgctgacttcacttcatctattttgttcaagaagtatctcagttgaaccttcataagggcagaagagaagctagatggcacactgctctctgttgtatagtgatttgattttggaaagaaagaataaaaacaggaaatccgtctttatagttgttttagaaattgtcgtcatctatttgggttatgcctttgtcacatgacccctgtatatctcccctgggttaccagggtcatgatttctgtttcacagataaggcaattcaaaggcttactttgaatggaggaatgagaatataactcttagagcctggagaacatgcaaacttgctggaatttccagacccctattacctggaaaaacatgtttaagctgctttctgaaatgcccttatctaagccttttaaaagagaaccaatttaaattttttcactttaaagtgcattggaacacaacaagcatttctgccagctcttaaaattcattcagtgtagcaattaagggcgacttaattaaaaaacaactgacaatatcattaagctggtgagcaaaatagagctaatttcaggctagagtcctacctctaggctgcaaagagctttgattcaatgtttgggcctgtttcattttgtactcaggccaagatttaacagtcatgagggttggttgtgttctctgtgcttaaatagatggattttcagaggaaatgaacactaaccaaagaaaatcaaatttgatttgtgcagaatcaagtagaccattgtgtcaaacaccattctaaataaaacattcctcctatacataaaattacatgaggctaacagtcaggaaactcagatttcatcttgggtccctcataaattgttcgattccagacaaatgccttaaatttctttggagcagatagactccaaagtcccttccagccctaaaatttcattatatgttaatatctgagttcagttggctcaagtggaagcatttggcaaaattcaaatgaaagtaatacctacaacatttagtgagtgcttactatgtattagacattttctgtgttttatgcattctcatttaatccccacaacatccctatgaaataagtactgttattatcccacttttacagtgaggaaagtgagaaattaagtagcatgcccaggtgagttttagtctgtggttagattaagacagatcagacaagctatcaggaaactggtttcaccattatcacttctcctttttattcagactctggtgctaattaagcacttggcttttgatccttccaatcttgccctgtgcaggagcactacattcattccagggttttcagaaaaaatctgcctttggggaaattatggaaatgacttaatgatggaaaaatgacttttagtgaattcacaaagaggaactttcagtgtcaaaacaaaggcaaaccgaagtctgcaaatgggcaatggttgtatatagtaagaatgatgtgttgtctgtagtgtgtgacgtgatttgatgtgatggaaaagggaagcacatatatatatagtcacactttgcaggcactttacacacaccatgtatttacaaatacaaaactttgtatttgtaaatgaaggtggtatatggaggacatctccaaatggagtagtcttaagttctccaaaacaataaattagtagactttttttttcgttttttaaaaaaaaattttcatgtgttttttggctgcataaatgtcttcttttgagaagtgtctgttcatatccatcgcccactttttgatggggttgtttgtttttttcttgtaaatttgtttgagttcattgtagattctgggtattagccctttgtcagatgagtaggttgcaaaaattttctcccattctgtaggttgcctgttcactctgatggtggtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggttttaggtctaacatgtaagtctttaatccatcttgaattaacccaaatgtccaacaacgatagactggattaagaaaatgtggcacatatacaccatggaatactatgcagccataaaaaatgatgagtttatgtcctttgtagggacatggatgaagctggaaaccatcattctcagcaaactatcgcaaggacaaaaaaccaaacaccgcatgttctcactcataggtgggaattgaacaatgagaacacatggacacaggaaggggaacatcacacactggggactgttgtggggtggggggacggggaagggatagtattaggagatatacctaatgctaaatgaagagttaatgggtgtagcacaccaacatggcacatgtatacacatgtaacaaacctgcacgttgtgtacatgtactgtaaaacttaaagtataataataattaaaaaaaattattttaactttcattttaggtttggaggtacatgtgcaggtttgttatataagtaaactcatgactaggaggttcagtatagacactatttcatcacctgggtacttttttcctgaacctctccccacttccactttcctctcaagtagtccccagtgtctgttgttcccctctttgtgtccgtgtgttcttattatttagctcctatttataagtgagaacatgtggtatttggttttctgatcttgcattcgtttggtaaggataatggcctccagttccatctgtgttcctggaaaagaagtgatctcattcttttctatggctgcatagtattccatggtgtgtatatataccacatttcctttatccagcctattgttgttggctatctaggttgattccatgtctttgctattgtgagtagtgctgcaataaacataatgtgtgcatgtgtttttaaggtagaatgatttatattcttctgggtatatacccagtagtgggattgctgggtcgaatggtagttctgtttttagttttttgaggaattaccacatccacagtggctgaactaatttacactcccaccagcagagtacaagtgtttccttttcttggcagcctcaccagcatctgttattgtttgagtttttaataatagccattctgactgatatgagatggtatctcattttgattttgatttgcatttctctaatgatcagtgatattgagcatttcttcatatgctttttggccacatgtatatcttcttttgaaaagggcctgttcatatcctttgcctgcttttcaatgggtttgttttttgcttgtacatttgtttcagtagattctggatattagacctttgtcagatgtatagtttgcagatattttctcccgttctgtgggttgtctgtttattctgttgatggtttcttttgctgtgcaaaagctcttcagtttaattaggtcccatttatcaatttttgctgaaattgcttttggcatttttgttatgaaatttttgccagattctatatccaaaatattatttcctaggtaatcttacagagtttttatagctttaggtttcacatttaggtctttaatccatcttgagtttatttttgtataatacgtaaggtgagggtccagtttcaatcttgtttttattttttcttttatttatttatttatttatttattctttttggtagggataaggttttgctatgttgcccaggcctacacttaatttttctagttaacttctttctcctgagatactcaaagtacaggcttggtgttcagaaaatagtgattctgtaggtgttttacaaatcaactaagacaaccttacaaatatttgccttttatgtctctgcagtagctgagatactgtggcgaatgcaaggaactatgtgacaatatatcttcaggaagcacagaatttagagataccgtacatgtatagtatataggaagagatgagtagcatcagataacatttaatgaatagtacaaataacaagttagaatgtacttcaaactatgagagcaaagatttgtaccacaatagccttttaactggaatattataatatggaattccaaaagctgtttgacttactatttatgtgatttaagcaagtcacttaatctctctgaggcttggctatttttgtttgtaaaatgggatgcagatagaacccaaactacaagggtggagtagaaatcgaatgagataacagatgagaaagaacaatgcaggattcttatataagattgtcatttgtgatgtacaaaaatgtccacctctgtgccttttaagcgtgtggcagaactgtactgccttgcctcctttgcagttaggtatggccatgtgtcttactctggccaatgaaatgtgggcccaagtggatatatgccacttctaggtggaagcttttaagagcctgtgtgtgaatcattgttttcccctttttttctctgccactgggattgtggaagccatgtgaagccttaattcaccgggggtcccttgagtgcctatgatgagcaaagcccccagctacctgatgttaagtataaaacatgaacaagaaattaatttctgtcatttaaagtaatgagatattggggttgttactgcaacataatttcctggaacagtctggctagaatgtttaccaatcattcttaatattacttgagtacctggatatccaggttttagatatgttatacatgtatgtgtctgctgcatgttagatttgttaatatctttgctaccgtttttaacttcagttttccaaaaaagatgttggcctcaacccagtcatgtctttttctcttcttttctgttaagtatttaaggtatctacagaccaggactagaactgggcttttctgtctacttctatttttcaaaagtttaattggagggaaaagttactggtcaagacaaagtttctatgtagatcataacaatatttggaagagtggttgaatataattaaagacaagctacctttatgtgtgtacacatacacacacatatatatttaacaagtctgtagttattaccacaaaattaaacctgagtcttataagtttgggaaaagtaaactcttgctcagattttaagttctcactctccttgacacccttttctcacttagagaaaattggacccattttagaacatgtggccataaactggtgcttgagacccatggaaggaatggtattctgcttaagagtacttttaacaagttaaggatagcaagttctcttggagggtgcctaaaacagagctactttatattaaactcttatctgcattaaagaatatagtaagcattcagtgtaatagtcactctgatgatccaagccatcagttataatgaggatttacgtgtatcctgttgaatatagctctctcagggtgtgtgtaagccaggggaatgagctcccccggttctggataacaattagctgagtgtgactctgttgaaaggctggttagtgctagcactgcagactacaacatggccttttgagtgcttagtctctttagactgaacagattaacccttctttttggagtaaagcctgcattgccatatgccaggtactagacaagtgggttatctcctttaagcctcttaacaatcctgtgagtccttttaactcctttttatataacagattcagacaacaacaaacaaaaaaacagagttgggttctgccctccatatttatctctgtggtgtctcatgtatcttagaaactggttagatgggctaggtgtggtggctcacacctgtaatcccagcactttgggaggccaaggtgggcgggtcacgaggtcaagaaatcgagaccatcccggccaacatggtgaaaccccatctctactaaaaatacaaaaattagctaggcatggtggcatgtgcctgtagttgcagctatttgagaggctgaggcaggagaatcacttaaacccaggaggcggaggtcacagtgagccgagatcgcgccactgcactctagcctggcaacagagtgagactctgtctaaaaaaaaaaaaaaaaaaaaaaaagaaaagaaagaaattgttgtgacgtaggtcgacttaaggaagcaaaccttttacttctttcacatctttgacatttgtttcatagaaaatcaaaaaatgccagagtcaaagagaaactgcccatcattctgccatgcatagtgaagtgtgattgaactttggcatgcagtccccttcctgagcctaagtgtgtgcagtgtttgtggcgggagatgtgaaggagcactgtccatcttccagcagtacttggagaactcagcatctcaaggatgagggacaggagatttaatttagttaaatagtcagtcatgagaggagctatcacaaagttaaatgtccatggttactgtctcctttggcctttcccacagctggctactgtcatccagctgccaatcaaggtttgtgaacaggtggctaacacagcagaataacagctcaggccatgtatatgtgtttagcaggctgtaaaaattcccactctttcccattcagggaaaatgtcacaagcatgctatatctgttggtgaatgtgatgaatcacccagagaaggacagcaaaaatgcaggctttccatataaaaagggaaaacattatattcattgtctccccacatcttcactcatgacatccttggtttctgatagatcatcctctatgattccccactattgtaaggaagtaggcgagctgctctgtgtgtcccttatcacaccagtcgatagtgatgagtaggaatttatcactatgatatacttcatggttttccaactataaactagtttttattctagttttgctaatctagttaggtaagtctccatggcccattcccctggaatttagctgttttaaaacattaatacatctgtcatctgtgcatttctctttcttctctttggctgcatttatccatgctctgagtagctaacttactttcctccgttcactgcaaaggatccacccctttgatgacctgatctttgagggctcttgcaccttactcagtgtctttctggtataattttttccaggagcagcactacaggtttacgttcagatttaagaagcccactatgatgatgataacccatacgtacctctaactctgggccagggactgttccacatgttcatgttaacttacttctcatagccctgtgagcggatattgttgttatctgcattttgcggatgagggagctgagtcacagagacgttaaatgacttatgcaaggtcacacaactgttagtggcagatctgggacttgaagccaggcagtgttgctctaggacctctcttctttaactgctactctatgcccatcctgtatcccttctgttttcattttcactttttctgaaattttcttcataaacgatgtgaaatctctttctgttttgtcctgctttgtttaagaggacccagcaaaggtgcagagagaatgtaatggcttggctcctgatgtcacagcaagtaagaatccatgttgagaagcatggggagaggccagaatcaaacagcacatgctaggttcacagtcaccttctttgttgacagacgccttctttgtggaggactacaggattttcctgtggtgtgcttaagagggggctggctttctggcccatctgaggcagaaggcaccctccaggtaggcaggcttcctttagggctgctgctccttttgtgggtcactcagcctcagttaaagtccccagagctggttctagaaagcggcgctgctgcgagaagaggaactgacgctgctcagtggaatcacatgaggaaccaatagcagtgtttccttggttagtgggtctgggtgtgagactgtgagaacatgtgtgtgttcccagacctcaacataggcacacctaaggagctggccttgggtctaaatgatgttctctgttcctctgtcaggaaccagacaaggcctaagttccacgctgtgtttttgaaatcactgagtcctaggactcattcagattgaatgctgcttctccaggtttaggttaaatattttagccttggatgctggggccaggtttattgcaatagggcatagccaggctggcctggccaccttgggctgccactttcaaatgctttccatttacagaaaaattgatggagcttctcccagggtagatctaatcagttggcaattccttgctgtcactgctaacctatctgtgccttcaaacctctgttgactttgaggacctatctgcctactttctgcaagccactcagcccagccatcctgctccacttcttatgtatctggtatctgggtcagtccagcaccacctttggttccaagcctttgtccttgtgcaattttgtagacttctttggggggtggtttaaagatttgatgcaaagcatgatgtctgacattgatattacactgtcacctgagcccctgtaatggcctcctaactggccctcctgcttacacacccctccctgcaatcttcaaaagcagttttgtacctattgccaatatgatcttttaaaaatgaacattctatcatatcggtttcttgcttaaaatcctccagtgacttctcaatttttggcatattgaataaagcccaagcctgcataaccccacatgatctggtcccgcctctaccttgggcaccattttgtaccaggcccttttgattcagccacaccaaccttctgttttaacacttcaagtacttgcattggtacttgtgtacatgcagtttctgcttcctggaatgcttgtccattgatcttacatggctggcctcttcataccatcagctctcaccttaacatcctcgaggggcattctttcatcactcagtctaaagtagccactctgtcactctttctgcctcttgtatatttgtctattgtctctgtactctccttagaaaataagctccatgaggcggggacctttcatgtcctgttctgttgtatctccaatgcctagaatagtgcctggaacatagtagataggtgttcaattaatagctattgaatgaataaatgatatatggtaagtgctcaataaatgttaactattattattttgttagataaaaacaaaaatgtgaaaatataactggggttccattgagtcctgattctttccagtgatatgttcaaagaaacaactgtgtggcagaaaaatatgattaaaaataacttttactcattccctcaaaaaaaaaaaaagcccaaagtgagagggtgtatttttcacctataacagaacttgttgaaatcttgtctcgccatttctgatactcacagcattcaacacacatggcagctctgccaactgtgtctttctgtctgtttgccaacccccaaccaaagagctcctcgaaaacctggctaagtgtcttcaggtgctgttgttacctcgtttttggccccagtttctaaatcagcattcagaaaaggtcaggagccacacaggcacattgaaacctagagtgaagttgggggtggtggaaatgaggttgggaatactcaagttgatagttttttaacctgctagacatatagcaaaaatagggaactgattaaagatatgagtgtattctaaactgaagagtacttaagactatcctaaatagctgtacttgtggagcattgaatcctagacttttttttttttcatatatacaaaaggttgatctctttaatcttggtatcccactacaaagctttgaacccagaatagaaggagatctctactatcacaaagcttgtgcattaaaaccatttgtttactctataggtcctcctttggaaccttattgacttgctttattattttgtttgcaactactttaggttagaaactggacctaaaagggaaggggaactattagagacaaggaaaagaacatgatactagtcagcctgagtgagcagaccaagatgaaaaatgctctcattacacagtggtaacagtgaccctgattcctaaagtgggagtcagattaaagacaggagtgtgtcctggtcactttttatctctgaattgtttctccagtagtgggttctgtcttccagagccattaatgccctctgttcagctttcttatgtccagcacacatttgcaagacagatctttaagattacaggatgtggtcttgggaaagcaggtctttactgtgcaaaatatccaggtctgccagagcatcttttctgagcccttggcttcattaatacactgcttcaacctgctggcctcaactgattcatcaggttataaacggagttgggaatagaaattatttccctgggggatcccagttatataatagctgtcatttgtatgcagtaaaatgatttgcagagtagcacagctcagagttcccagctgcattctgtttgtttatttctggcagcatatgaaacagtttgctgggtatgtggtttccaaaaggtaacatggacataatagtaacatctggggctggggttttctcccaccccatatagattttagtaggaagtctgcatctaaggaatttgagtttaatgtctgttgcttgctttctaacttcatgcctgtcagttctccgttgcttttactggccacagtcttgagcctctcagctgccatctcccagagagtgccaagctaaagagctacacataaatattcatgagggaaagagactcagaaagcagaggacaggttggggaacccttttttctgagatgggctacgggcttcttgccttactttctttttcctctctccatcccccctagagtaaattaacttatatactggccattgtcttccctgtccagtggggaagaggcaggacagagtggaaggcaacagccaagagaagtgtgggaactacacgtttccctgggatggcatggtgttgtccaaccaacttatgccactgaagggtgcattgtccaaatagtccttatataccataggggtcaaggagggtgtaatgaggacagcagagaatcatgagtgataatagctattgtggtggacagcagaggggtagaggaaggagagatgctcttgtttgccctagccaggctagtggggactgtgccttggagacagttatacaggggctcacactcattcctctaaccccctaaacctttctctaccagaaaatcagatgtaaatgaactacagctgcagccttgaagactatggagagagggaggatattttagacctccgtgcctcactgagaggtgggagagttgatgctcaggggcctgaatctatgagtcttctgataattttgccattgggtgtagcatcctcctcttattgtcatctttctcctccctctgcattgaaatcatccctagctaccaagtttcccacagcttaggctgctggtgaaggccccagtttgttccacacttggttgttctctgacagctacttgtctcagtctcaagttcctgattttcggttttcacaatattccgagctaggatcttgcctatttctagttgcccttacctaggtttccattttataacttcctatcaaagatacacagtctgattaactcttcataatattgttttctctttgtaagcagtagaattggactcttagatcaatttatagaatagttgtcacaaccatctctatgtgtctgccttcacatggactatatttttagtgccgttttctactatataacaagaatacttttattaatctcagcagacaagaccaagtgtcaagtcacagcaagggtgatgggagccaggatttcttactgacttgactgaacacctctgactaaggatagttcttcaggtaattgaacacacaccgatgctttaacacagtttctagcctagcctgtctcctgagcctgataatttgaataagtggggagtctctcagctggacacagaataccctgtgtcatatgattggtgggtctgaatgaaaatctttgtattggagctggaatggcaggagacagtgcgatatagtagaagcaacactgaacttgtagtgagaatcttaggtttgggagcatccttactctggcatcttactgtccacatgatgtggtcaaaacacttaacctgatgttgttcagctgttcatgaatcctgtgtaccagacactgcgcttggcactgctgacacagtggtgactgtggcaagatcttgcagctaagtatgacaaccctggctatgttaggggcctcttgtgacccttgaatgagataatgttaaggggttcttgtgcaccttaaatgatagaagagtcacttcttttgtgaactttaaatgttcacaagagaggtctcatttttattgaaaaaaacattaataatgtacataatttaaagtccacatgggagagcattaatgtatccaaccagagcatcatattgaaaaaagtgcatagctacacagatggagaatgtacattatctagtgggaaaatattttttacacatttgtacacttacagtaacaaagtataaacactacctgcctttgatccaaggaatataaatacttattaaaaataaattatatgaaatgccatttgattctcttagaagctattcttctgtgtcatcattgaacacccagaaagactacaggcttataaagaaacatctctatttacatggtgtatttctgtatcactcttcaggctcaaaagagaagcagagcagagtggctgtaaggcatggattgaggagaatcttcagaccaccctttcctggtgagggaggggctttgtgaaggcttatgttctcctttggaacctaaaaggcagctcttgagatcctcctgagggactaaataccaaagggagattaggcctgggcagacttaaatgcaccacacattggatgattcgaagtgacagagaagagcattttaaaattatatactgtaagacagattacagatctataaaaagacaatgtcccattaaaaactcctcatgacatattggtaagtggagaaaaaaaaagactatagactgttttgtgcatatctcactttttggaaaaagaagtatttgcaggtttatgtgtgtttcagtctgttttggcaccttaaaaaacacacagtttataaatttagaaaaaggagactttattttttcttaagaattatagcttgcaagatgaccatcccgcaggctgagaagcctgcctctgaccaagacccacttcggaggaggtgcgtttgggataggagctttatgttaaacaggttggctaaacatacatgttgaacaggttacagagggggctatgaatattcatgaaggtggtcctaacacatgtgtattagacaaaatgcatgtaacatacacctatgttcactttggggtggacacttaacatttaaatatattacaattaggccctatatgtccaaaggtcttttcagggcatgaaggcacccaagtgggcaacatctgtgaaccagccagaatcagtccatggttggtggtcttctcatcaggagaaagttactgaaatcagtcttgtccaataaagctgtatttatggctgatagaacaggggttcagttagcatctgtgagctggatgagttgtaattgttttaatgttgcttatatcaaggccagtgtttgtagctgctagggaaaaataaaaaccttgtgacaattaaaacatagtttttgttggagggtagggttgggaggagggagagcatcattaggaagaatagctaatggatgctgggcttcatacataggtgatgggataatctgtacacaaaccaccatggcacacatttacctatgtaacaaatctgcacatgcacccgtaaactaaaaatagaagttggaaaaaaatcgtttattttactcataaataaagagttttgtgtccaaaattggtgggttcttggtctcactgacttcaagaatgaagccgtggaccctcgcagtgagcgttacagttcttaaagatggtgtgtccggagtttgttccttctgatgttcggacgtgttcggagtttcttccttctggtgggtttgtggtgtcattggcttcaggagtgaagctgcagaccttcgcagtgagtgttacagctcttaaagcggcgtgtctggagttgttccttcctcccgtccagagttgttcattcctcccggtgggttcatggtctcgctggcctcaggagtgaagctgcagacctgcgcggtgagtgttacagcttataaaggcagtacagacccaaagagtgagcagcagaaagatttattgcaaagagctaaagaacaaagctcccacagtgtggaagggcacctgagtgggttgctgctgctggcttaggcagcctgcttttattcccttatctgaccccacccacatcctgctcattggcccattttacagagagctgattggtccgttttacagagagctgattggtccgtttggacagggtattgattggtgcatttacaatctctgagctagacataaaagttctccaagtccccactagattagctacacacagtgcactgattggtgcatttacaaaccttgagctagacacagaatgctgattggtgtgtttacaatcctttagctagacataaaagttcttcaagtccccactagattagctagagagagcactgattggtgcgtttacaaaccttgagctagacacagagtgctgattggtctgtttacaaaacttgagctggacacagagtgctgattggtgcatatacaatcctccagctagacaatcctccagctagacataaaagttctccaagtccccacccaactcaggagccaagctggctttgcctagtggatcctgctccagggccatgggcagagctgcctgccagtcccgcgctgtgcgcccgcactcctcagcccttgggcggtccatgggactggctgcagagcagggggtggtgcccgtcagggaagctcgggccgtgcaggagcccaccgtggggggacttgggcatggtgggctacaggtcccaagccctgccccgcggggaggcggctgaagcccagcgagaattcgagcatggcacgggtgggccggcagtgctgggggacctggtgcaccctctgcagctgctggcccaggtgctaagcccctcactgcccggggccagtgccaccggccgaccgctcggagtgtggggcccgccgagcccacacccacccggaacttgcgctggcccgtgagcaccgcatgcagccccagttcccacccgcgcctctccctccacaccttcccgcaagcagagggagctggctccagcctcagccagcacagagaggggctcccacagtgcagcggcgggctgggctcctcaagtgtggccagagtgggcaccgaggctgaggaggcaccgagagcgagtgagggctgccagcacactgtcacctctcagtttattccaagggtaggagtgtgtgacttaaccctttcctgtcatggccttacgtcctgtttataatttggtatcttagtgccacagagagtctgttttgtcagtcttatgatctctgttttgacattaatgctggccagttgtgtctaaactgaaaaagggaagggatgtaatgaggcatgtctggcctcccatcccatcctggctgggaactcagttttaagatttttatggggttgccttggccacaagggggcctattcagtcagttgtgggggcaagtaggattttatttttggtttacacactgtaacagaataccacagactgggtaatttataaggaaaaatatatttcttacaattctggaagctgagaagtctaaagttaaggggctcacatctagtgagggccttcttgctacatcttcacatggcggaaggcttgaagggcaagagatcaggggagagagagggaggcgagggggattgaacacatccttttcttaggaacctactgagaggtgaagctggctgggcttctgggtcgggtgggaacttggagaacttttctgtctagctaaaggattgtaaacacaccagttagcacttggtaaaaaaaggaccaatcagcactctgtaaaacggaccaatcagcactctgtaaaacagaccaatcagctctctgtaaaatgaatcaatcagcaggatgtgggtgggaccaaataagggaataaaagctggccacctgagccagcagcggcaacccactcaggtcccctttcacactgtggaagctttgttctttcgctctttgcaataaatattgctgctgctcactctttgggtttactttgcctttatgagctgtaagactcaccgtgaaggtttgcggcttcactcctgaggccagcgagaccacaaacccaccgggaggaaggaacaactctggatgcgccgcctttatgagctgtaacactcacgtgaaggtctgcagcttcaatcctatagtcagcgagaccacgaacccaccagaaggaagaaacactggacacatccgaacatcagaaggagcaaactccagacacaccatctttaagaactgtaacactcaccgtgagggtctgtggcttcattcttgaagtcagtgagaccaagaacccaccaattccagacacactactcccaagataacagcattaatccattcatgcccttgtggcctaatcacctcttaaaggtcccacttctcaacactgttacattggggattaagtttccaacaaatgaactttggggtcacattcaaaccatagcagtatgcaatattaactttgtttatcacttgatgatatagttgtgtactcatctttggactttctgtatttcagtaagcatgtatttcttttgtagtcagaaaagtaattattgtaaacaaaatcctattataaacagaactctaaaatatctatacagcaaagggactgtgttgttcattattttattcctagtgtctggactatgcggtggaatcacatgagagagcttgtgaatgctgcagatttctgagcctcagccctagagatgctggctgattcagttgttgtggaaggagatgctgccagggaaaatggaagcagattctagaacaaatcatactatggaatattatcaaagctatcatttcccatgtaactccagatttattataaccggggacaaaatgtgtaccccagttgaaaattaccactgtagccttccctccatcttggctctagttgttgctctacctgagaagaatgtatctagttctgtttcccctgagatgcttttcaggctctgtgggacttagaaaaagcaattatctatcaaataccagatggctgtgtagattagccccaatgagtaaaaacacagtgatgcgaacaaaagatggtgattagctggttgaataacaacagacgatctcagcgcagatgcactggaaacaagggcgggatcagatactatcatttttattttcttgggttcattaacaatgcattcattatttcagtactgctctgatgttaacagagagataaggagagggggataacttttacaccacagctttctcatttttattaaaataacatttccttaaaacttcatggtaagagatgacttaatgttgttttccatctggttgtaaagaatagtaatgtgtgcttcctgggagattaaaaaaaagaaataattccaaactaagcatttttagctcagtttacataactgttatagaaaaactaatattcccataatattcacattgtccacgtatgcaaacacaggactaagttgtatgaaacagaaaagacaatggaggccacccaaatgttttaggccatcattctggttctgttcagttaaaaaaacttgaaattttctaagatgctacctattcaaagctctgctgtaaactctaggatctcccaactctcagctaaggtatgagtgaaggaagaaaaatcacaggtttaaagcatggttaaaccaaaactagtaaaatgtggtaacaaaattttaattgtaaaaatacttagtttaaaatgtagccaatatttagaaacacattaacacactctaagacatcatccaaaaaaaagcatttaggtattggtggtgtacaagcactaaacatcgttttacttcaacaaaggaatggtcaaaatattaaagtcagagttttaaaaagatcaaaatctgttaaaatacactgctttttttaatgaaagaagaaacagatctccaaggtatgataggagatatatcagtatatatcagttaatacatatttctaggaatagatgccttcaaaaatataggtattgttgctgaattgtggaggtttaattttttggcaaatgcattatcttaggtgtggtcagtttgatttgcctacccctagagaatcaatagttaaaccccgtatcacccagtccatgttcctaacattcagacaagtgatgaagattaggcaactaaaaacagatattgttagcaggatgtatcactgaaaggcaagctggtcatgagtagatattttttcattgttttatttactcatttgtgagcctggggtcattggttccacctaacttctctctctgacatttagataattcaccaccagatagatggtgatggtgatgactggctttctgttaatctgtgtatcgacattatagtttgtctacccatactaggtacatgaaagaagttagcaaagctttagtataaatggatgcatgtgatgtgctttcagagagtatcagttttgcttaaggatgttaggggcacaataatataaacaagttttattgctagtatataattttaaaattatatttttattaaagtcatattgcctactgtggaatataaagcaaaatatgcatgtgtctttaagagatggagtcttgctctgtcacctatgctggagtgcagtggtgcaatcatagctcactgcaacctcaaactcctggactcaagtgattctcctgcctcagtgtcccaaatagctgaatacaggtgcacaccaccatgggctcaaagtacacatttttgtaaagatgaaacaggagatttcagggacatttcctgcttagagaggtcactttccactgtacctcaggactccagaatgtgggattagggtgatatatattagtttactcgcatcttttattagagactcttctataaaaggatttgagaagcactgcatggggcaggaagaaaaagagcataaaatttacttaaatagatgtctattcagttacagttatgagaggactccattaagttacacattttttgaaaaaacctaactcttaaatgagccaagcatacatcactaagtattctatttaagaggattcaacgtttagagaatcaagaagtaccagtggctgcattctcacaatttcctgcaagaatgagtctctcacttatctactttagtgtctcatttaccacttttggtgtgaaaagttcccatgatttatacatacctagactcttactgctaaagattctttacatactttgatgataatgattataatgataacccatacatagtgtttaatgcatgccagacactgctctaaggtttttgcatttaacgctcacagggatgcaattgtcctcatgttttcattttacagatgaggaaactgactcatagagagttaagtaatttttttcaagggcatgtagcttacaaatgatagaacaaagattggaccctggacaatctggttccagggtcctgttcttaaacattaccttttcctgcttcttacagaaattattaaatgtttactgtttacaaggctaatatttatgaagtcattagaaatgatgttggaaaactgctttgaatcacataagtagctattaacaaatgaggttctagtagaatttgacaataatgacatggtaggtaccatttggctaataaaggaaataaaatgaagccctgaaatagattttttaaattactttcattatggttttgctatgcacatcttgtgttaagtaaagaatgttgcatggtgcttttgggcaggggtttttttgtgctttttaaaactttatttcaacataactatgcttacagaaatacagtcatattggttaatagaatgcaacttaggtttaacttataatacacaatttggaccaaaaagttggtacatggtttaagattttaaaaaaggacttgcaatctgatttatttttatctattaccaattgatatggtttggctgtgtcaccacccaaatctcatcttcaattcccatgtattgcaggagggacctggtgggaagtaattgaatcatgggggcaggtctttctcatgctgttcttgtgatagtaaatctcatgagatctgatggttttataagggggagtttccctccacaagctctctctctttgcctgctgctattcaggtaagacgtgacttgctccttcttgccttccaccatgattgtgaggcctccctagccatgtggaactgtaagtccattaaatctctttcttttgtaattgcccagtctcgggtatgtctttatcagcagcatgagaacagactaccacaccaatgtaaaaaagttgagatcctccatcaaatgctgctcaagaaggcagcaaaaagaaggcagcaagaactttgagaaacttagctttggtttgcctcagaaaaataacgttgcactgtataagtttgtaaaaatggtgcaacaaaacattgtaatctttcaatgccagtttagaaagttcagtaactaatgaatatggaaaagggttggagggagcctatgtacacatgtgaaatttgtaaaagctatctgatttagataatactgcatgtaggttgtatatctacacaaaccaagattcagatcatttcttcaacctgaattaacactatctgttcatctgctgaggtcaaccagaaaactgggcacactagctgttaagtttttttgacttatggaaaaaagaaaattaaatttcttcttcaacttttcagttcagaagtgaaggtatattacaggcaaggtattccttccattgtccacattaatgaggtagcatgcaatgtggtctacttgggttttaatttgtatcagcacacatatgcaaaatggtctccaaagttaatgaccatatagctttagaagtgaccctaaaaaataaaatggccagggggtggagccaagatagccaaataggaacagctctagtctacagctcccagcatgagtgacgcagaagatgggtgatttctgcatatccaactgaggtaccgggttcatctcactggggagtgctggacagtgggtgcagtgcaccaagtgtgagccgaagcagggtgaggcatcacctcatctgggaagcacaaggggttagggaattccctttcctagtcaaagaaaggggtgacagacggcacctggaaaatcgggtcactcccaccctcatactgcacttttccaatggtcttagcaaacggcacaccaggagattatatcccgctcctggctcagagggtcctattcccacggagccttgctcattgctagcacagcagtctgagatcaaactgcaaggtggcagcgaggctgggggagggtgcctgccattgctgaagcttgagcaggtaatcaaagcagccgggaagctcaaactgggtggagcccacctcagctcaaggaggccagcctgcctctgtagactccacgtctggggacggggcattgccaaacaaaaggcagcagaatcctctgcagacttaaatgtccctgtctgacagctttgaagagagtagaggttctctgagcacgcagctggagatctgagaatgggcagactgcctcctcaagtgggtccctgacccccgagtagcctaactaggaggcaccccccagtaggggcagactgacacctcacatggccggatactcctctgagacaaaacttccagaggaacgatcaggcagcaacatttgctgttcaacaatatccgctgttgtgcagcctccgctgctgatacccagggaaacagggtctggagtggacctccagcaaactccaacagacctgcagctgagggtcctgactgttagaaggaaaaccaacaaaaagaaaggacatccatgccaaaaacccatcagtacatcaccatcatcaaagaccaaaggtagataaaaccacaaagatggggaaaaaacagagcagaaaaactggaaactctgaaaatcagagcgcttctctcctccaaaggaacgcagctcctcaccaacaatggaacaaagctggatggagaatgactttgatgagttgagagaagaaggcttcagacaatcaaactactccgagctaaaggaggaagtttgaacccatggcaaagaagttaaaaaccttgaaaaaaaattagacgaatggataactagaataaccaatgcagggaagtccttaaaggacctgatggagctgaaaaccaaggcacgagaactatgtgacgaatgcacaagcctcagtaaccgatgcgatcaactggaagaaagggtatcagtgattgaagatcaaatgaatgaaatgaagtgagaagggaagtttagagaaaaaagagtaaaaagaaacgaacaaagcctccaagaaatatgggactatgtgaacagaccaaatttacgtctgattggtgtacctgaaagtgacggggagaatggaaccaagttggaaaacactctgcaggatattatccaggagaacttccccaacctagcaaggcaggccaacattcaatttcaggaaatacagagaataccacaaagatactcctcaacaaaagcatctccaagacacataattgtcagattcaagttgaaatgagggaaaaaatgttgagggcagccagagagaaaggtcgggttacccacaaagggaagcccatcagactaacagcagatctcttggcagaaactctacaagccagaagagagtgggggccaatattcaacattcttaaagaaaagaattttcaacccagaatttcatatccagccaaactaagcttcataagtgaaggagaaataaaatactttacagacaagcaaatgctgagagattttgtcaccaccaggcctgccctaaaagagctcctgaaggaagcactaaacatggaaaggagcaactggtaccagccactgcaaaaacatgccaaattgtaaagaccatcaatgctaggaagaaactgcatcaactaacgagcaaaataaccaactaacatcataatgacagatcaaattcacacataacaaaattaaccttaaatgtaaatgggctaaatgcttcaattaaaagacacagactggcaaattggataaagagtcaagacccatcagtgtgctgtattcaggaaacccatctcatgtgcagagacacacataggctcaaaataaagggatggaggaagatctaccaagcaaatggaaaacaaaaaaaggcagcggttgcaatcctagtcttggaaaaaacagaatttaaaccaacaaagatcaaaagagacaaagaaggttgttacataatggtaaagggatcaattcaacaagaagagctaactatcctaaatacatatgcacccaatacaggagcacccagattcataaagcaagtccttagagacctacaaagagacttagactcccacacaataataatgggagactttaacaccccactgtcaacattagacagatcaacaagacagaaggttaacaaggatacccaggaattgaactcagctctgcaccaagtggacctaatagacatctacagaactctccaccccaaatcaacagaatatacatttttttcagcaccacatcgctcttattccaaaattgaccacatagttggaagtaaagcacacctcagcaaatgtaaaagaacagaaattacattgtctctcagaccacagtgcagtcaaactagaactcaggattcagaaactcagtcaaaactactcaactacatggaaactgaacaacctgctcctgaatgactactgggtacataacgaaatgaaggcagaaataaagatgttctttgaaaccaacgagaacaaagacacaacataccagaatctctgggacacattcaaagcagtgtgtagagggaaatgtatagcactaaatgcccacaagagaaagcaggaaagatctaaaatcgacaccaacatcacaattaaaagaactagagaagcaagagcaaacacattcaaaagctagcagaaggcaagaaataactaaaatcggagcagaactgaaggaaatagagacacaaaaaacccttcaaaaaatcaatgaatccaggagctgattttttgaaaagatcaacaaaattgatagaccgctagcaagactaataaagaagaaaagagagaagaatcaaatagacacaataaaaaatgatgaaggggatatcaccaccaatcccacagaaatacaaactaccatcagagaatactataaacacctctacacaaataaactagaaaatctagaagaaatggataaattcctcgatacatacaccctcccaagactaaaccaggaagaagttgaatctctgaatagaccaataacaggctctgaaattgaggcaataataaatagcttaccaaccaaaaaagtccaggaccagatggattcacagccgaattctaccagaggtacaaggaggagctggtaccattccttctgaaactattccaatcaatagaaaaagagggaatcctccctaactcattttatgaggccagcatcatcctgataccaaagcctggcagagacacaacaaaaaaagagaattttagaccaatatccctgatgaacattgatgcaaaaaatcctcaataaaatactggcaaaccaaatccagcagcacatcaaaaagcttatccatcatgatcaagtgggcttcatccctgggatgcaaggctggttcaacatacacaaatcaataaacataatccagcatataaacagaaccaacgacaaaaaccacatgattatctcaatagatgcagaaaaggccttagacaaaattcaacaacgcttcatgctaaaaactctcaataaggtattgatgggacgtatctcaaaataataagagctatctatgacaaacccacagccaatatcatactgaatgggcaaaaactggaagcattccctttgaaaactggcacaagatagggatgccctctctcaccactcctattcaacatagtgttggaagttctggccagggcaattaggcaggagaaggaaataaagggtattcaattaggaaaagaggaagtcaaattgtccctgtttgcagatgacatgattgtatatctagaaaaccccatcgtctcagcccaaaatctcctcaagctgataggcaacttcaacaaagtctcaggatgcaaaatcaatgtgcaaaaatcacaagcattcttatacatcaataacagacaaacagagagccaaatcatgagtgaactcccattcacaattgcttcaaagggaataaaatacctaggaatccaccttccaagggatgtgaaggacctcttcaaggagaactacaaaccactgctcaatgaaataaaagaggatacaaacaaatggaagaacattccatactcatggataggaagaatcaatatcgtgaaaatggccatactgcccaaggtaatttatagattcaatgccatccccatcaagctgccaatgactgtcttcacagaattggaaaaaactaaagttcatatggaaccaaaaaagagcccacattgccacatcaatcctaagccaaaagaacaaagctggaggcatcatactacctgacttcaaattatactacaaggctacagtaaccaaaacagcatggtactggtaccaaaacagagatatagaccaatggaacagaacagagccctcagaaataatgccgcatatctacaaccatctgatctttgacaaacctgacaaaaacaagcaatggggaaaggattccctatttaataaatggttctgggaaaactggctagccatatgtagaaagctgaaactggatcccttccttacaccttatacaaaaattaatccaaggtggattaaagacttaaatgttagacctaaaaccataaaaaccctagaagaaaacctaggcaataccattcaagacataggcatgggcaaggacttcatgtctaaaacaccaaaagcaatggcaacaaaagccaaaattgacagatgggatctaattaaactaaagagcttctgcacagtaaaagaaactaccatcagagtgaacaggcaacctacagaatgggagaaaatttttgcaatctactcatctgacaaagggctaatatccagaatctacaaagaactcaaacaaatttacaagaaaaaaacaaccccatcaaaaagtgggcgaaagatatgaacagacacttctcaaaagaagacatttatgcagccaaaagacacatgaaaaaatgctcatcatcactggccatcagagaaatgcaaatcaaaaccacaatgagataccatctcacaccagttagaatggcgatcattaaaaagtcaggaaacaacaggtgctggagaggatgtggagaaataggaacacttttacactgttggtgggactgtaaactagttcaaccattgtggaagtcagtgtggcgattcctcagagatctagaactagaaataccatgtgacccagccatcccattactgggtatatacccaaaggattataaatcatgctgccataaagacacatgcacacgtatgtttattgtggcactattcacaatagcaaagacttggaaccaacccaaatgcccaacaatgatagactggattaagaaaatgtggcacatatacaccatggaatactatgcagccataaaaaatgatgagttcatgtcctttgtagggacatggatgaagctggaaaccatcattctcagcaaactatcacaaggacaaaaaaccaaacaccacttgttctcactcataggtgggaattgaacaatgagaacacatggacacaggaaggggaacatcacacactggggcctgttgtggggtggggggagtggggagggatagcattgggagatatacctaatgttaaatgatgagttactgggtgcagcacaccaacatggcacatgtatacatatgtaacaaacctgcatgttgtgcacatgtaccgtaaaacttaaagtataataaaaaaataaaataaaataaaatggcccttcttagaagactagagcaaaatgtctagccatacttacaagccttatcaaaaaaaaaaatgcaaccccttatgaattacacctcaattttaaaaagtagcctcaatataagaagcagctttgaaaaaaagagaaaaacatataacttaaaatatctcgaaaaccattatgaatataggttcaaaagatagttaagaaattaattttcataagactcccttggattaaggcttataatatattctagtatttcaagtttatcactagttactaaatatcaatttttaaataacatgttcttttttgctcttttatcaaaagggaaaattctagcttcattctatctaatgtgggggagagggactagaaaataaataaattcaaaatgttctgtgggaatattgcatttttcaaatggaagaacttccaactgaccagaagttcatactgccaacatacttttcactgaaacaatttttaataaatacaaatacatggcattgaggttttgaacctaatataggcctgacagttaagtcctttttttctggaagaaggcctcaagtcccaatcaatttccagtaacaatgtttttacaaatcaatgtaataataaagggttttattttccttcatatttttgtttttagcattctagtcttaaatactagattagaatttagttcagttccccagaagcaaatagcttttcttttgcaatatgagagaatccacaaaaaacctttccccaaactaattcctaatatttaatatgtgtttaaatgaatctttttctatacaatgtaaatggtaactttggtaaaatgttcccatgagttgttagaaagatttaactagctttgtaatttaagttttaaaacataaatatttgcagcttgatcttcttttgatagtgattgttggagcccagaattcaacatttataaattctcattcatgcaaacaaaacacagaccatcatcatacaacttactcctcatgtcctgagagaagaatcttctacttctttcagtctttggcctcccagtaaattccaatttcaaacaacttttaacacaaacttcactcttagatttttaacaagcttttcacacatacatcattaatgcttcccctaatctttcatgttgtactggctattgggcagttgtgttaaaaaaaaaaaaaaaaaaaaaaaaaaaaaacagcactcccaaagcgcttgatttatttttatttggagaataagagaccttttctcaattgtctttcgataaagataatacatattagataaactgtaggcttgaaagtcatcatcagcctcgttattgacacaggaagctgggcagcataggaaggtgataattccgtatcagtaaaagtatagaggaggctcatctatgaaccatcatcctgtcccagaaaagaagagcctgagtggtcttacctatgccccattactccagatttctacatttatcttcatcataggaaaagagagaactcttctccagcaatcactaggggctacattattccttgtgactaccatgaacttcttttccatatcaggaaagtgtatgtgtgtgtgtttaatttccctctagttgacatctttcttccttagttctatgccttttgaggacaaaatctgcatggtttttaaattagatctaatgtttagagtcacttcatcactaaggtttcccttcccacagcccagacccagacagagattgattgccctcttatgaagaaatcccattgcaaagagattttcaggcacatttaaatggaacatatggggggttgtcaaggaatgagaaaaagtaattatgctccaagaaaattaaaattttagcagacgagattcagaagcacaaattttagttaaaccgaggagcagacattaattatcatcatgttaatcttggactttggtaattgcaacagagattaaccagctagtcaactgaaagtagttcagagtccaggctggagaaattctattaccaaatagcttaatgtgattaaaattaaacttcagcttttatgctttaggccctgaaaatttgaagatggttgacattgaaacattgtaaatattcagagaggtctctttgcccagagtatggagtcacagatattttaagccaaaatgggcctttggcaataatctttgccattaagccccagatcttccctatctcatagtctgccctgtagatctcaacctgtctgggaaacatggcttgatctgccaccaagctgccatttatctgtcagatgtgtcaagattaataatttctacatgctggcttttttttccaattttaatggaagcagagtcctttcttcccagtggtagatcgattaaccagactacattgaaggcaaggaaggttaacttttcccttcaggaccaatagtcctaagtcgaatataaaagatgaaattttgttttgatctaggaaaatacattggtttgatttctccctggagagctgctctgaatttaaatgtgagtaggttctttttaaaaacctgctgagtatcacccttcagagaaagccgcctgagattctagtatgggtttatcactgggtgcacctaagcattagcaaaacatgagaagggaatcctgggaatcccctgatcattaggtgatagtatactgatgtcacgttgaggtctttatgtctgctggtttgaaggttcatgataaggcaatttcctttcatgttttagtaaccttaaacattggcttatgtctttatttgcccattgtgtgctggaaaaactgctacagcaagcagacctcatttttccttcatcccagaagcataaggcccagctagaggcttggtgggatccacctctcctttcgatgaagccttctggaattcaaggaagatacctcttgtgtaataatagcacccaggtcaaaatatgtcttgagaagatagtatttcagccagtggtgcatctaactcagtttttcctctctggtgccagcattctcactgtactgtccagtccagacatctatatataatagcaacaggtattagttcttaactgaaggtagaggagattttataataacaaaagtattacaagttgagtatctcttatctgaaatttcgggagccagaagtgtttcacattttggactttctttagatttcgaagtatttacatataaccagtagaacatccctaatccaaaatctgaaatccaaaatgctctaaggagcatttcctttgagcatgatctttgagtgtcacgttgacattcaaaaaattgcaggttttagagcattttggatttcagattttcaaattaggggtgctcaacctatagttgggaatgtttgtaccatcactttgcaatgataagtaaatatataaatgaaaacaataaatgtgttttcataaatatgaaaccaatacatttccctcttcctcttaaagtcttatcttattcctaaggcatatgattcctaagtcacagtggccttagtactccagcgtaggagatggtggcactggggagtgagaagtcttggtatatttatcttctccttagatatagagaagataagcctggagggatcagctcacaggcttctcttacagtgtgaagaagtttggagtcaggaagaaggatgatatgatgtaaaaagaaaggcctgcttctgtcctggccagggtaaggatggagaggaaagagaatgaaaagggggtagaagacagaagtgagcacaagtagcatctccagagttctctgtgagctttgatgttgggagactggggaattcaggaaaacaccacaggcacaggcacaagattctaccctacattcttgttgaggcagggagtgggcaggaacctgtgcaaggcccttcaagcccaggtgaagcagctcagtttccatagagctgggatgctaaggtgagcagcagcatcataacagatgttagggccgaatggtgctgtggaacagactccagggtctgcagccagccacagctgagggaagctgaaccagcaaacgggagatggccgtacctacttgggggcattgcaggaagggaaagacagggccagcctggtattttaccatcagagaccataagggcacatgatgataagggaacaagggcattactgcaggccagtggatgccaggcagtacagacaaaagaactggcacagcctgcgtaactcccaactccccaccagacaccgggaggactgagataccattatatgaagaggggatgctatcaggagtctgaatattttctaaagggactatttaaattattagaccaaatttgaagctggcttggatatttacttagagtaaaagctgttacatcagatgtgatcggaactaatttttaaaaaatgattaaggcagaatcagaaataatttatgtatataacatttaaatttaatttaatgtaaatgtacattagcaatattttaattcacagccaagactttttcttttcgtattggttttccaattagagttttgcttcttatttcttgcataaatcatcctctaatgtatcagctacatttctacttgcattttctttactgggcaaagaactctttaagatacttgcgaagaaatttgagtgcagaatcttagatttctacagttaaaaattttttttaccattgccttgacacctaattgaaagtgttgttaaagaaaacttgccttaattaagtctattcaaatcattcaacttagttttcatacagacaactcccttcagtcatttttttctcatttggcagtatttttaaattatgtaattaaaagaacaaaagaaatggatgtaaacagacttgtagacaaaactgactcttgaaagcagacagtgtggaggcatcccagagagaaaccctgttacctttagcttctcagtgttctggggagaatcagtaagtatgatgtagaaaaggaatgagttaattcagcaagacagttaaatgcagattaatctctgtaacagcagatgaaggctcaaaaggaaagtccacttacagttgacatctttttaattgtatttagttgcatgtattgtaggttaactttgcaaacccgccacatatattctgtaataaattaatcaaaccataaattatatagctaatttgtaaagggatgtttagtggaacactgatttttctgctgatcattttccattatattcctgatcccatgatggtaaacaataagatttttctttcttgtctgtagaatttatcctagattctacttatacaccttatcaaagatcttttaaaatattatctttattatcgtatttgttagaaagcttgcttcctgccacaaattctccagaagtgtctctgctctgaaaatagactaaataggagaagatgttttaagcttctttccgtgggaaaagtaacttcctaattggggtccaagctagaaacaattgtttcccccattgaatggacatgtggatgcttttggtttaactactgcatttccctctgcctcttaccctgccttcacttctgcctatctccaaagatgctgttgtttaactatttcatgtccagtacctacaggcttctcccgttctatgctcagacatcatttacccatctagtagcctaatctcaactctctatggccacctgagtctgcagtggagcaggctgaagggagagttggtaagcttcttgacattttgcctctgtgtgtcaggtttgtagagccagaaattctacaggccaacccctggctgtagagcagggagcaagacttcagtgagtgctcattgatttatccagctgtcagaaaacttgcacccaagaatgagcaggtgcctccactgcctttggccaatgaattggggaccttgcgtttcttttcttttcttttcttttctttttttttttttttgagacagagtcttgctctgttgcccaggcatgaactcagctcactgcaacctctccctcccaggttcaagtgattctcctgcctcagcctccccagtagctgggattacaggcacatgccaccacgcctggctgatttttgtatttttagtagagacaaggtttcaccatgttggccaggctggtcttgaactcctgacttcaagtgatccacccgtctcagcctcccaaagtgctgggattacaggcatgagccaccgtgcccagctggggccttgcatttctaatcagtcagaggatgcagtgtcaaaaacagagttgacgttatttccaggctgggtgatcaaggtaaataacccattttcttttgtttcattgtgttactgttttctctagaactaacactgttcacttcattaggaaccgttaaaggtggcttcacagtattgattactatttgtgatgaatttgtgacacattcttgaatcttactttcaaagtaccaaagagagaatggttgcttaacagagagaagtgttgcttaacttcccagaaaccatttgagctgatactactgttctattataaatgcaacttacataatttattccttactgtcctatctctgaaacgtgcctacaaagctgcgtaatgtaaactggttttaaaaggcatagcatcagctactatgctggggtcaacttttaatatcctgaaaaggcttaggaatcaaaacccagtttaaaacttagcccagtctatttgtaagtggaaacagaaatgtcagtctgagagcatattgtgacatatctctgggaaatgtgtcctccattgatttgtgtcattgtccctggaaagaacatgtgaggaaataagtcttcccaatccaaatttccttttgataaaaccttggcaaaagcttttctaattgtaggtttcaagtctttaagaataattttgctggatgatgcatgctttgaggatatgatattttaaatatcatattgcttccagacatctgagagtttaacatgcaaattaatatatatcatttctcctctccttccctacacatatgtgaatgtgtgtgtgtatgtgtgtgtgtgttttctgtcatatgaaacacactggttttcttcagtctggttttctgtcagtcagaaaaccagaccttgggcaagtcacttaacctttacaggcctgtcttctcacactataacgtgaaggaattgtactatatttgattgtaagcccttcacagttgtaacattcttttattctactggaaaataattttgagtccacatgcttatgtgtgtcctccatatgcagataacgtagactaggctttatctctgagagcctaaaataatatgattcacatatgcagaactgttttcttaacttttatcttatattttaatatgtaaactagaaggagagatttttaaaagattaaaatctttttgacaaaatattgcatctacacctaaactcaatcttcaccatcacccttccactaccaacttcagtgtttagaaaccatgagaagttctgtaatagattggtgttatacggagctcttgcagggttgagaagtagcagggagaaactctcagcctgagtctccaaggctgtcactaactgattagcataaaaagtggtcttgggccgggcatggtggctcacgcctgtagtcccagcactttgggaggccaaggtgggtggatcacttgaggtcagtagttcaagaccagcctggccaacatagtaaaaccctgtctctactaaaaatacaaaaattagctaggcatgttggcaggtgcctataatcccagctgcttgggaggctgaggtaggagaactgcttgaacccaggaggcagagattgtagtgagccaaggtcatgccattgcactccagcctgggcatcacatcgagactctgtcaaggaaggaagggaggaagggagggagtgtgagtgaacaggacaacatgactggtttcctggttcccatccactttcaggagagtttccttctagattgctttaaactttatgcatatcagagtaacggttgctgcaaaaaaaaaaaaaaaaaagacaggaacaaataatcaataggctatttttaaaaatctgatacctcatgtacctctacttcctagagccactaaaggctgtcttttagagttaattttttattgctgccttgctaagatgagaaccatagctagtctttgcctgctttcttgattctcacacaccattaagattgaagctaatttgtcacattgacactgaggaatgttattattcaaagctgagttaaaaagggaatttatagagagcaaaaccaataagccaagcagctctgacatttaattttcttggaaacctttcccatcgaaccaggcgcgtctgcacactacacatttgcaaaatgaaaagtggtgttgtagtaggataatctcctcatataaatgatgaatgaataatttgaaagagattggatattatagggggccctttctccttcttttgtcctctcccatcctgccctgaaatgacatttgtgggtgggttccagcttttagaggtgatatgttaagttctgttttgttcctttttttttttttatccttaggaatggagggtttggggaagtgaatacggataatttttatttatgtttttggccaccagttccaggtttgtactattaagaaaattacttccttggaccatgagcccaaagggcaataaacactgtccgtctaccaagaattgcttcaaaatcctaatacaaactaatttaggattagttcaggacactattggcttcctaaggtaggctaagctcacaggagaaaccatatttgagtatccatttagcttcctgttttagacaggctgagtaatgctagttgctttaataaaaagccaaaatctcagtggtttgacataataaaaatttatttattgttaacatcctgggcccaatgcaggttgacaggaggtgagctggagagggttcatgttccgtatagtcatttagggacccagaactcatctataatgtaggtctgccatcttctgaaatcagcatttctctgctgagttcagtgtctacctgaaggaaagtgagaaagctagtggatggcgcatcatgcagggtaggagtgggtgggtgtggatccaggccattaactggaactcagtcacatggccccacctaactgcaagggaattttggaaatgtagtttagctctgtgacctgaagaaggaagaagcaagtttggtaaacacatcatattgactcttccttggttctctttcctcttactacctgtacttgcatatgtactcctagtcccagagaaatctacctgtgatgtcaccaaggcatttaatttaactgatctagtggtttggcaaatatccatctgcttctgtattattctatttgcttttctttggaaggagatgacctttacatagagaggaggactttcctgctatgaagggtaaacatgtataaacatggaccctctttaaatcatcgtatttttaaagtggaattgtacagggagtaaatgccaactgttcattatatacacatgggaagaggggatatcatccattcatccattacattgggaaaagctttgaatgattgttcctgtctaccaagtctttcctctgtgtggtagaagagagaattctagggcttcaggatgaccagaagataatcacatgattttttaaaagctagagagatttcagcttgaataataatggaacaaagtatcaccaagatgtctagttaacagaagtttacttgacaatttgagacacagtgttctaaagagattggtttatgccccttgactgtattccaaaattcaggatctaagaaattctcaactcaagttggttcttgattaaggaaccatttagacacatgaaggacttattaaaggcggccaaaagtagggaagaaaattgacaaggaactaacaggagctatggattgttttacatgcatgtgagtttttggcttgtatatataaattttcatcaaatccttcagcaaagcatgataaaggcatagtttggcattattattgggtatgcaaatttctatccatggacattttgggaccatcaaatatggctctctttgcttttggttggaagcccgtaccccaagagggatgtagaaaatgaagtattgctttcttattgattgtagtactgacttcatctgccaggaaaaggctggcactgcaaggaaaaaaaaaatctcatcaccatggcaacagaaatcttaactttgatatcatatgaaaaggaaattattttttctctgtttttaagaattgcaattttgtgaatgtggaagtgacctttgatagcagtgttttcttagagcatctgagccagagggctaatgtccaaggtaaaggcctttaggacttttaatatggcaatcctgattttatttatatcaggggaagaaacaatacttagaccatgcaagatatcattttcctatcaagaaaatgacctcatttttatgccacagatatttcaagggtagaagaataagaaatttcatttgctgaactttcctggatattgccaggcccccagaaatggggtgaaggaggaggtaattaaattaatctatattgaatgttactatcctcttttcctgctaagtcagtgaccaccttctgctgtcattaaaccctttaagatggtggaaccagtcctataaaggacatctgattactctggttgagaaaactgagcttctttaaaaacagagctgtggagaaatcacttgccttcctgttttaaaaccttaaaatgacagtaagtctaatcagccatatctcttcagtaaagcagcaggtcaggggctgggtacaagaagagacctggcatttattggtcacacagtctgtgctgggcactgtgctagctgcttgaagtattcagacaatatatttgtgtttttcttcctcgctcttatgaacaaagaggaatattggctcatacgggatgttactggaggtaatcactgctatatgaggatctaaactaatagttcaagatattctttagccattggtgccagatatgttatgatttggtcagagttattgaagagctggtatttcaattaaatggtagttcttagcaaagaaaaaaaaagttcccagagtaccaatgtggttcatttttattcttaatgattaaaaacattaaatcatttttcattaaagttaattgaagtgacagactatatttttgagtagtactgttatgaatagaactcaaggattggggtgggaggatctataagcaatacaaccatgcaaaagtggttcttttaagaaaaatacatagagggaggcagactcagagtaggcaattagtttcagaaaatcacagtcccctccagagccttaataccaggttttcaattcaccaagttttctctctcactattcattattttagcttagtaagcaaactttcacctatgttagtatgaaataagccccttctcctctgaagttttgagaaatgtttatgaaagtcactatatctggcagggtacgctggtttattctatggtaaaaatcaaccacaaaataacagtaggtgacaatcatacgagtatatttttcactcatgccacatgccaacaaggatgggcttcagctctgtttaatgtcatcttcactctgagacccacgcagatgatatcacctctatctggaactctgccagttttgtggtacaggtaaagaaaatattctctcgtcaatcttgcactggccattaaagtctccttcccaacttcctgcttctacctagtcaagattcatatgttatcactgcccagtggaaagctactgaataatttgaggtgtactagtgtaggaatcagattggatttttagaagctaggaggtagagggcaggaaaccagtgggaggctattacaagtgcctgctgctggacgtggaccctgctgtgaatgaatcgatggggtaaaatcatgatgctgccatcctgttatttaaaacctgattactgatgcacccagactgcttgaatatgtctctgtggtgctgacatgccagagtggcccaacttctcaagaccaatctttccaatcagattagtttcccagctctgcccctatcccactctgtcccaaaatagctccagctggctattttgctgagatcatgtatgtcccatggccaaagctgcacaagctctgacagcttgaagaaccagtgtttggatgcaggaggaagagttacaattgcaagggaaggatacactgaggtttatttcctagtaagatgtagagggcaagagtttcagcttgggttattgaaagagtaagtccattaccgaaatataaaagcagttgaaatatgtattgaaactagtttactcctcttattttggacacattgagtaggagatttgagcagtacttttctgaggagttgtccagcaggcatgtgggaagctcagggaggtgtccgtagttagaggcatcactaatgcagaggtaactaagatttgagagttttgaagtaattgcctagggagagtgtttagaggaagaaaagagtgtggagcctaggataggcaggaatgtccatttaagaggagtcagaggaggagacagaataatgaactgagaggaatgtggagtgaggagaaatgcatcaggaaagtggaatgcctaggaagctagcatttcagtagctagctagggaggaattacagcaggaaggggttttggaggaggaaagtcctgaaggaaacatgtttgaatcgccacagggaaggagagaggacatttcctgtggggagttaatactgaggtggaaatgagcggctccaggcttctttgtgagtatgcacaggaggaagcgggtgaggcggccagcttcatgaggaaggagaatgcattgggaagcaagaaaaggtgagatcgggcaatgctgaggaaacttcatatactagtcaagaggaggcctatatggattcctgaaaaagaagtttacactgtgtgtgtgtgtgtgcgcgtgtgtgcgtgcatgtgtgtgtagaaaaagaagccagtagcttcagcagaaaggtagaaaaatccatgagaaatctttttcaggaatccatacctgaagtgtttgttagcctaggtcaaagtacattcttaaactaggagagaaggctctagaaagaatttgagcattgctttacaaagcaacatttccttttttatgactaagggagcagaagtgtgtggatctaatcttcagtgtgggaggctaaacaagaggcaaaactttgtcattaagtcaacataaaaaggctttttaacagttgcactttcccctcagttaaaaaaaagctatcaaaatcaaagataaatgatgttcttttggtcactttttagaaagcctaaagaaataaatgttcagagataattcaatgaatgaaaagcatttatgaggagcctgtgtggttactgatgatgtgggcatttggtaggtttgggttttcaaggctaatttttaagaaactctacatttttttttatcttgtaggaagaagcatggtttgatagaaggacagtgagcttagcaaagtcctgagttggaatcatggctctgctttatgaccctgagtaacctaaactttcttagcactccaaaaaaataagattgccgatacctattttatgaggcctatgtgaagccatcagtgaaacagtcccatctggcatgttgctgggcacacagtcattgcacaataaatgttcatttcctttgcttttacttacaattccaacatagtacccagataaatgacagggctttaggtatactttcaggtctctttctcatattactgatcaactggaataaggagatgggcatttttcttttacataattaggctttttgtataaaaattgagtttactattaaactgattaaatataaacattagctgaaatcaatcttatttataaaatatttaattgtaaggtttaatgaaatacaaatgcttaggaatagtaggaacattgattcttttttttttttttttgagacagagcctcactctgtcactcaggctggagtgcagtggtgcgatcttggctcactgcaacctctgcctcccaggttcaagtgatcatcctgcctcagtctcctgagtaactgggactacaggtgtgtgccatcacacccggctaatttttgtatttttagtagagacggggtttcaccatattggtcaggctagtcttgaactcctgacctcgtgatccgcccgcctcagcctcccaaagtgctgggattacaggcatgatccaccatgcccagctgaacattaattcctaaatcatatcaacttctacttaatttaaccttatcttttttccccacaaattagtaatataagcaatttcactggacacttccttgagattctgacttctttgagtgtgtttatgccagtttttctgtggacagttttctgaattcattaatactattttttcaaattgcatctcttctgtagaaactagattcatcctaacaaagaaaaataagttgccttttctggtagttttttaaaaaattaccttcctgaatgttcaaacttaccagaatcaaaaatgaaaacaaaagccccatgatgtgttttcagtgtgaaattccatggtttttttttttttctgatcagcaggggaacaaattcactttatctaagttctaccatctctactggccagagaggctacctaggtgtgtgcaaaacacaacatgggttgggaccaatttcctttctaataaggagcagctttcttatgttaaaggctttagatctccttcctggttttaaatgcaatctcatgaaattgtaactatttaaatcctgtacagcaaatcccaaaatcatagaaatgtaaaaattttaaatacagagatctgttcagatatggcataatagttaccatgtatactgacatagtgagatacagtgtctgccccccggcactaacacttgacatgtgtgtgcatgtctctcaaaggacaatagatgacagatgactatttaaacatccattatgtaaatcatgtatgatcttaaatctggaaagaacaaccttgttattatttataaaatatttcttataaacaaaaagttcacatcctgaattttttcacatttgaacttgttaatcctgtttgctctatgtggaagaataataaaaacaatcataataagaaacgacaactaattatacttctttataatttagaggatacttccacatgtattgtctaatgtaatacttgtaatgagcaatccctgaaggtaataccgtgtctcatttttaaaggtaagcaaactgaggcccacaaaatttaagtaatgtataatatctcatcctaagggagagactaagacaagatccaagatctcataattttgtaccctactttttttctatcatatttattgcttttctcttccaaacattcttcttgacatcctttccaccattcatggttcatctcagctatcatcttctttatgtgggtttccctctagtcatcccgtctggaggaaatttttcctattctcttgtaatgcagcatacggtatttctgttgtggctcttaacctacagtgcctttgtgttgtcattattactgtatgtgtcaattaccactcctagatgggtaagctccttgagtccgcgggatatattgtaccacttattggtagtagacatgcaggaaaagtgtgaatgagtgaatgaatggattaatatgaataaatgaaccagtgacattctaagagtctctgccaggaagcagtgttgttatgacttagccaaggatctttcctcttagagttgctaataaagtgggaaaatgagctcagatataatctgaagtggagctttgaacacaaacagtacatgacaaacctatacgtggtgagcacacctattttgctgtggtcttctctttaccaatgtttctttaatttccctttccatgccagtacttcttgcaggccacgttagctctggggcaatcagatagatatgtctcacctttttcttttgctatctgacagttctttcatttggaatgctgaagagacttttcaatctttgtccaccttttacagatatagcaaatcctttagctgttggtaagccattggccacactggtctccttgtcatcttctcattgtttttaatcttcttatgtctatggcctccttgaccactgtgttctaattggagcagcaaggaaattctttttgaaggaggtcacactggctgtcctgataccctgtgatacaatcattgtaggaatattatatgtgctgcttttttgagtaggaaaaataccaagatattttgaatagggctcccacagagctttttatcaccacgtagcctatgagcttggagcctaccagtggtatacaagattgctaatcaaaatggaaaccagttagcaagataattagaaaacaagtacaatatttctttccagaatagatagtttcaaatgatgatggtggccatgtagcttgatgtagtcctttttgaaagtaatttggcagctatatcataaatttacatgtttatacctcttttgatgtgacagttttcttctgggagtctagtcaaaggaaatctaaagttaatagtataaatgcagtgcatcaggtaggggattgcattcagcagtgtcagagaaaccatcacagtggtttaacacaatagacatttatccatctcaagtaacaagaagtgaatagaccaacattcagggctgctgagtcagctccatgatgccattgacatcccaaggctccttcagtgacttttgtcctctttgtgcttttgtgattgtaggatggcaagtttatcacatgtcattcttccaggtgggaagagaaaaagggaaggagaacaggcaaaacttacctggaaatcccgggtagacttctcgtttctcgttagccagaattgtgtccctgctaccagtaagagaggctgagaaattaatatttgggttaggtacactgtcaggttagacaaaattaggaaattgagagaatgactattagtaaaacgatgtattagtaatgtcttctatggaaatcaatgtgctgatgataacaaaagtaagatgatgcaggcacacaatatccattcacagagtaacagataaacaaaatgatataacatagactactatgtaactgcagtatattagtcatagtttgttcaggaaaacagaagccactctctgaggaataggaaacattttagtacaggtaattaaaggtttttgtattacctttggagggctggaggagtgaagatcagaaagggctatcatcatagcttggatcctttcaaagcacagcctaaggcaaggagttatgagcaggcggtttatttgggaggtgataccagggatccgcagtggtagagtgaggaaaaaggaatggccaacataggggtgtgttacagaggttgcatttggtaggtaggagcttgattctatcaaaatctaatgagaagcacacagagtaccttccagaattgtccacccaaagtatggaaggtaggaggatttctctattggctcctaggacttgcccccagggatattaactccctgtatttctgagctgtacacacgtatgtgggcccaactaactcccatggcatctgcattgttggagaaactctacaacagaaagtagaaatgtggagcctgcacccgaggtagaatacttccagcatgatatgagttgaaggctgtatggaactgtgcagtcatggctgaaatcagaggtgaagccaagaaaatatgagccagggtacagaggtatctgctacagcaaatttcagaaactcagacatgagagtcataaggaagtgaccaccaaaagtcttacttcctttctgtaatcaaatgactggtcctctggtttgttagaagcctctgacaaaaccttccatcttttgtctaccactaccccatagctgacactggagaataatggcttctccttctctttcatctttctaatgacatgcaagtatcttcaaatggtgggattaatgcaaatcctgagagaaaagtctctgagagatgtagtttccaggcgtcatgcccctgaggtacaagagagagctcagaagggtgagcgttgtcctgagtattgataaatggtacctggctcatcagcaactgatgaattatttatgaagaattttcgtataacttgtttttatcacctctagttaaacccactggcgagagagggattcccaccctaggattatgtggattttgagaatggcaaaacacacaactcctaacactagatagatgtggtcaatagacatttagtagtcatatatactcatagctttgggagaagctttctttataccattcagggccacatgggagttgcatatggtaagagtgtgaacaaccagaggccattttataggatcaagaggatggggtaccccctggttccctcaagaggataaaattgatttctttgaataattctactgactgacaagtaactgcaaaccactactcagggataagcaggaactgcacctggtcgtttggataaggagggcagtttggccaggggatcttacatgtgaactgaagcctcaattttagaccttacatcatgtgaacagcaaacagtctttactagtttgggtagagaaaaaaagggcacatcttttgtaaagattaaaattaagtgacactcatttaattatctcattttgcaaagaaatcctttctcctcaagatttcctctattatgtgtcttggcattgctcttctcgaggtgtgtctttgtggcgttctctgtatttcctgaatttgaatgtcggcctgccttgctaggttggggaagttctcttccaggagtggaaacactcctgcagagtgttttccaacttggttccattctccctgtcactttcaggtacaccaatcagacgtagatttggtcttttcacatactcccatatttcttggaggcttcgtttctttttactcttttttctctacacttgtcttcccacttcatttcattcatttgatcttcaatcactgataccctttcttccacttgattgaatcagctactgaaggttgtgcattcgtcacctagttcttgtgccatggttttcagctccatcaggtcccttaaggacttctctgcattggttattctagttagccattcgtctaatcttttttcaaggtttttagcttctttgcaatgggttcgaacttcctcctttagctcggagaagtttgatcatctgaagccttcttctctcaactcatcaaagtcattctctgtccagctttgttctgttgctggcgaggagctgcattcctttggaggagaaaaggcactctgatttttagaattttcagcttttctactctgatttctccccatctttgtggttttatctacctttggtctttgatgatggtgacgtacagttagagttttggtgtggatgtcctttctgtttgttagttttccttctaacagtcaggaccctcagctgcaggtctgttggagtttgctggaggtccactccagaccctgtttgcctgggtatcaccagcggaggctgcagaacagcaaatattgcagaacagcaaatgttgctgcctaatcgttcctctggaagcttcgtctcagaggggcacccagccgtatgaggtgtcagtcggcctctactgggaggtgcctcccagtaccccacttgaggaggcagtctgtccattctcagatctcaaactccgtgctgggagaaccactactctcttcaaagctgtcagactgggacgtttaagtctgcagaagtttctgctgcctttttttcagctatgccttgcccccagaggtggagtctacagaagcaggcaggcctccttgagctgtggtggattccacccagttcgagcttcatggctgctttgtttacctactcaagcctcagcaatggcaggcacccctaccccagcctcactgccaccttgcagttcgatctcagactgctgtgctagcagtgagtgaggctccatgggcatgggaccctccaagccaggcacgggatataatctcctggtgtgccgtttgctaagaccgttggaaaagcgcagtattagggtaggagtgacccgattttccaggtgccgtctgtcacggcttcccttggctaggaaagggaattcccttaccccttgtgcttaccaggtgaggcaatgcctcgccctgcttctgcttatgctcggtaggctgcacccactctcctgcacccaccgtccaacaagccccagtgagatgaacccagtatctcagttggaaatgcggaacatgggattggaaaatatttgaatgaatgcacacctgaaccagaaagcgagctcagccaagagagaagttctgagctcactacttatgcttctgcaggcacttgctgtccctagccatccagcagtcgttctcacagtggccatgatgtccatgggttaaacaccactttgtccctggtcggagaagaatacagactcttctcgttgaatctgaaacccaatcctccctgcctcaacaactgctgccacaacttttagcggatttaaaggaaagcaaagagaatccagagcctaagaagcattgcccacccaatctgctcttatatcaatgacttcccagggtcagaaattgtatataatggttttctgtattacacactcattgtttttgtcttatgttgttgtttcctccctagtccccacatttgtcccagcctttattaactatgttgtccaatatggtaatcattagccacatgtagctgtttaaatgtaaatgaattaaaatttaaaatttggttccctagttaaactaaacatgtttgttttaaatgcttagtaaccacatgtagctagtagctactctattggacagtagaatttatagaacatttctatcatcacagaaaattcgcttggacagcaccccttatgttaattttggaggatcatttggaggatcatttggaggatcaccaatatactaaaaaaccaccgtgtgcctgaacttataccaagtacaaaggatactgcagcagtcaagacacatgaaatttctgccttcccagaacttacattttaatttacaaagcctgtatcaaagtgtctgtgtatatccacagcttaagcctggaaacagatggctagttgtttattaaattttagactcatccccactctgatttctttgaggtatagccaattttcttcaacttttagacctgaattttagacctctaattaaaaaaaaaaaatttatactttaagttctgggatacatgtgcagaatgtgcaggtttgttacataggtatacatgtgccatggtggtttgctgcacccatcaacccatcatctacagtaggtatttcttctaatgctatccctcccctagccccccaccacctcctgacaggcccccgtgtgtgatgttcccctccctgtgtccacatattctcatagttcaacccctatttatgagtgagaacacatggtgtttggttttctcttcctgcattagttggctgagaatgatggtttacagcttcagccatatccctgtgaaggacatgaactcatccttttttatgcctgtgtagtattccatgttgtatatgtgccacattttctttatctagtctatcattgatggtcatttgggttggttccaagtctttgctgctgtgaatagtgccgcagtaaacatacatgtgcatgtgtctttatagtagaatgatttataatactgtgggtatatacccagtaacaggattgctaggtcaaatggtatttctggttctagatccttgagggatcgccacactgtcttccaaatggttgaattaattgacactcccaccaatggtttaaaagcgttcctatttttccacgtcctctccagcatctgttctttcctgactttttaatgatcaccattctaactggcatgatatgatatctcattgtggttttgatttgcatttctcaaatgaccagtgatgatgaactttttctcgtacgtttgttggctatataaatgtcttcttttgataagtttctgttcatatcctttgcctactttttgatggggttgtttttatttccttataaatttgtttaattccttgtagattctggagccctttgtcagatggatagattgcaaaaattttctcccattctgtaggttgcctgttcactctgatgatagtttcttttgctgtgcagaagatctttagtttaattaggccccatttgtcaattttggcttatgtcgccattgcttttggtgttttagtcacaaagtctttgcccatgcctatgtcctgaatggtattgcctaggttttcttctaggtttttatggttttaggtctaaaacttaagtctttaattcatcttgagttaatttttgtatacggtgtaaggaaggggtccaggttcagttttctgcatatggctagctagtttttgcaacaccatttattaaatagggaattctttccctattgcttgtttttgtcaggtttgtcaaagatcagatggttgtagatgtgtggtattatttctgaggcctctgttctgttccattggtctatatatctgttttggtactagtaccatgctattttggttactgtagccttgtagtatagtttgaagtcaggtagcatgatgcctccagctttattctttttgcttaggattgtcttggcaatgtgggctcttttttggttccatatgaaatttaaattagtttttctaattctgtgaagaaagtcagtggtagcttgatggggatatcattgaatctataaattacttttggcagtatggccattttcatgatattgattcttcctatccatgagcatggaatgtttttccatttgtttgtgtctgctctcatttccttgagcagtggtttgtagttctccttgaagaggtccttcacatcccttgtaagttgtattcctaggtattttattctctttgtagcaattctgaatggcagttcactcatgatttggctttttgtttgtctatttttggtgtataggaatgcttgtgatttttgcacgttgattttgtatcctgagactttgctgaagttgcttatcagcttaaggagattttgggctgagacgatggggttttctaaatagacaatcatgtcatctgcaaacagagacagtttgacttcctttcttcctatttgaatactctttttttctttctcttgcctgactgccctggccagaacttcgaatactatgttgaacaggagtggtgagagagggcatccttgtctttgtgccggttttcaaaaggaatgcttccagctttggcccattctgtatgatattggctgtgggtttgtcataaatagctcttactattttgagatacgttccattaattcctagtttattgagagtttttagcgtgaatgcgtgttgaatttttgtcacaggccttttctgcatctattgagataatcatgtggtttttgtcattggttctgtttatgtgatggagtacgttcattgatttgcatatgttgaaccagccttgcatccccgggatgaagccgacttgatcatggtggataagctatttgatatgctgcttgattaggtttgccagtattttattgaggattttcgcgttgaccttcatcagggatattggcctgaaatgttctttttttgttgtgtccctgccagattttggtatcaggatgatgttggcctcataaaatgagttcgggaggagtccctctttgtccattgtttgtaatagtttcagaaggaatggaagcagcttttctttatacctctggtaaaattcagctgtgactccatctggtcattggcttttttggttggtaggctattaattactacctcagtttcagaccttgttattggtctattgagggatttgatttcttcctggtttagttttgggagggtgtatgtggccaggaatgtatccattccttctagattttctagtttgtttgtgtagaggtgtttatagtattctctgatggtagtttgtatttctgtgggatcagtggtgactgatcctctctatcattttttattgtacctattttattatgctctcttttcttttttattagcctggttggcagtctagctattttgttaatctttaaaaaaaaaatagctcctggattcattgatttttttttgaagggtttttcatgtttctatctccttcagttctgctctgatcttagttatttcttgtcttctgctatcttttggatttgtttgctgttgcttctctagttcttttaattgtgatgatagggtgtcaattttagagctttcctgctttctcctgtgggcatttaatgctataaattttcctgtaaacactgctttagctgtgtcccagagattcgggtacattgtgtctttgttctcattggtttcaaagaatttatttatttctaccttaaatttgttatttacccagtagtcattcaggagcaggttgttcagtttctgtgtagttgtgtggttttgaatgactttcttaatactgagttctaatttgattgcactgtggtctgaaagactacttgttatgatttacattcttttacatttgctgaggagtgttttacttccagttatgtggtcaattttagaataagtgtgatttggtcctgagaagactgtatattctgttgatttggggtggagagttctgtagatgtctgttaggtccacttggtccagagctgagttcaagtcctgaatatccttgttaatttattgtctcattgatctgtctaatattcacaatggggtgttaaagtctcccgctattattttgtgggagtctaagtctctttgtaggtctctaagaacttactttatgaatctgggtgctcctgtattgggtgcatatatatttaggatagttagctcttcttgttgcattgatccctttaccattgtgtaatgccctttttttgtcttttttgatctttgttggtttaaagtctgtttatcagagactaggattgcaacccctgctgctttttttttttctttccatttgcttggtaaatcttcctccatccctttattttgagcctatgtgcgtccttgcacatgagatgggtctcctgaatacagcacaccagtggtcttgactctatccaatttgccagtctgtgtcttttaattggggcatttagctggtttacatttaaggttaatattgttatgggtgaatctgatcctgccattatggtgctagctggttattttgcccattagttgatgcagtttctttgtggagtggatggtctttataatttggtatgtttttggagtggctggtactggtttttcctttccatatttagtgcttccttcaggagctcttgtaaggcaggcctggtggtgacaaaatctctcagtatttgcttgtctgtaaaggattttatttctccttcgcttctgaagcttagtttggctggatatgaaattctgggttgaaaattctttaagaatgttgaatattgatccccactctcttctggcttgtagggtttctgctgaaagattgctgctagtctgatgcacttccctttgtgggtaacccgacctttctttctggctgcccttcacattttttcattcttttcaaccttggtgaatctgatgactgtatgtcttggggttgctcttctcaaggagtatctttgtggtgctctctgtatttcctgaatttgaatgttggcctgtcttgctagattggggaagttctcctggataatatcctgaagagtgttttccaacttggttccattctccccgtcactttcaggtacaccaatcaaatataggttggtgttttcacatagtcccatatttgttggaggctttgttcattccttttcattcttttttctttaatcttgtcttcacagtttatttcattaagttgatcctcaatctctgatatcctttctgctgcctgatcaattcagctattgatacttctgtatgcatcacgaagttctcgtgctgtgtttttcagctccatcaggtcatttatgttcttctctaaactggttattccagttaacaattcctctaaccttttatcaaggttcttagcttccttgcattgggttagaacatgctcctttagctcggaggagtttgttattacccaccttctgaagcctacttctgtcaatttgtcaaactcgttctccatccagttttgttcccttgctggcgaggagttgtgatcctttggaggagaagaggtgttctggtttttggaattttcagcctttttgggcaggtttttcctcatctttgtggatttatctacctttggtctttgatgttggtacctatggatgggattgttgtgttgacatcctttttgttgatgttgatgctattcctttccgtttgttagttttccttctaagagtcaggcccctctgctgcaggaccattggagtttgctggaggtcaactccagatcctctttgcctgggtatcaccagcagaggctgcagaatagcaaagattgctgcctgttccttcctctggaagctttgtcccagaggggcacccaccagatgccagctgaagctctcctgtatgaggtgtctgtcgacccctgctgtgaagtgtctcctagtcaggaggcacaagtgtcagggacccatttgaggaggcagtctgtcctttagcagatcttgagcactgtgctgggagatccactgctcccttcagagctggcatgtaggaacacttaagtctgctgaagctgggcccacagccggcccttcccccaggtgctgtatcccagggagatgggaattttatctataagttcctgactggatcttctgcctttctttcagacatgccctgcctagagaggaggaatctagggaggcagtctggctacagagggtttgcggagctgtggtggggctctgcccagtttgaacttcccagtggctttgtttacaatgtgaggggaaaaacccgcctactcaagcctcagggccctggtgttgcgaagaccatgggaaaagcatagtatctgcattggaatgcaccgttcctcaggatacagtccctcaaggcttcccttagctatgggagggagttccctgactccttgcacttcccaggtgaggtgacgccccaccctgcttctgcttgccttccatgggctgaacccactttctaaccagtcccagtgaggagccaggtactttagttggaaatgcagaagtcacccgccttctgcattgatctcactgggagctgcagaccagagctgttcctgtttggccatcttgccagccctcccctggacctctgatttgagctgatttgtcaggcgaagtggcttacatgtttgatttacctgtaagtattggctatcatcgtaaagttttttaggttctggatgagaggtttatttgaaagtagttgttccaggatttaattatttaaatcaattctgactgcctttgtttagaattttaattcagtgaaaggtctagttcttaatggttatatgtaaccacaacagagacaagaaattcattgcaattaaattgttggttttcctcacacaaagctcatgttttaatgctcccctccatatgggggtcaatcatatagcattaacattaatagcctaataagtctaataatgaagatgtgtagcatgttaaaattagccattagaattcaaacataccacactcaatgcatgcaacaagatccacaaatgccaacactacccatctgtttgaactaatgagctgtaaacatttcccccactggtgaactaataaattatagcatgttacaattgaaagggaccttggagatagatctttctgttccagctacctctttcttcattttgttggtcctatataaaggtatattatttatccaaggtcacagttgtacagtaaaaccctgccatggcataataggcccagaaattcctgtgtgtaaagcaggggttcccaaacgttagtatacatcctggagagcttgttgaagcacagattactgggccccacccttagagtttctgattcagtgggtctgaggtagaacctgatcattttcatttctaacaagctcctgggtgctgcttgtggtctgaggaccaaactttgagaaccacttgtgtagaccacgtggtaacattactgtgaagttaatggaatgatgaaagccagcctacatagttagccagccttgagttctgaggatctagctgcaggagccagatctatccaggtgtaaacttgggtttgccaccatctagtgttagtcatctaaagctgtgtaaacattgatggggatgattctggatcctgtagctggctggggcttccagctatcccatggttagtaggcatttatttcttctattgatttgggaagattgtgctttggggacccagctcccatcttgctgatttccaactaccaccagctacttccctgtcagtcttgtcctctcctgaatatattctcccctcctctagaagacaagaacattggcccaactctttcagaagctggagagccagtcacattacatccaaaactgtattggggaaggcttttacagcagccagtggtagatctcctgttgtttaatgtactcattctcaaactcctgcctcactgtcttacctctgtgcctttgcattttccatcactcttaaccttcaaggtttagctgaatttccacctccttcagaaaccttgtcttcctactctagaagataacaacttttcttttaaagagaaaatagggcatgattctggtacttttgcgttccagactttgtgtggatgttcgtgtcattttattctcaaaactatcttgcagtatagacgttgtacccattttattgatagtaatgctgagactcaagaagggtaaggcttttaagagacagggtctcacagttgcccaggctgaagtgcagtggcacaatcatagctcactgaaacttcaaactagctcaagggatcctgctgccccagccccttctaagtagctctgactatagacacaggccaccacacctggctaattttttttttttttttaaggaatggggttttgctattttgccaagctggtctcaactccggcctcaagcagccttcctgccttggccttccaaagacctgggattataggcatgagccaccatgcctgccccattttctaatttgttagaatataatttgctatgatataccttgtctaatacaagtgcattagacaaatacataggcaaagctgtctatagagtggtttttgacaagatagtctctctccatgccatgctgcaagctcttaaagatggggagcatgtctcatttgtttttattctcagccccagcccctcctattagcacagtgcatgttaagttgtggcactcagtattttccaaaatggatctcctggcttactgctgtgtatactgcatcttcctgccccgcttctctgtgcagttggctatggtccccagcggggaaggaggttcctttggtgtagtctctcctccattgcccccactcagaatttgcagcatcaactgttttctctcagtctatcttctctatgaatgccatcttcaggaaaaggagcacttttctaccctgagaatgaatgatttagagatgagggtggtttcagcttcatgccaagctcatagtctgggggtggcttcccacaccctcttcacttccctgaacctcatctctctccttttcagtcactatctccttattcttcaagacatccctatgaatcaagcagtagggacaagtgagaggcttatcagagttagagattgggtgaaagatcaccaaaagctcatgttgcttaaaacttgaattgcatgaaaggcattggatccaaatgtttaagaaacactgactcactcctttgctgttttgaatataacttgcaaatgtggtttcatttatcatcccacttcctccatctctcgtaaaactgtcactttcagggaagagaataagtgggcctggcctcactgtggctctagtactctctgaggatggagtaaggattcctggttctcaacccaactatacagtagaatcacttggaagcttcctacattccttcagggagtctgatttccttaatctgggatgtagcatggcataagcattgctgtgttcctccattgttctagtgttcagtcattgttctagtgttcactcagcattaagaactgctagattaggtttttggattccaagacttgctgatcataatagccatattgggagccttttaaaatttctccatcccataacctgggagtcagaatttctaagggaaagacctagggatatatgtttgaagtagattctggccatcagctagtttgggaaattaccaatcttggtactttcagatatttcttctagccttccagtcatcaaagcaaggtagaattatcaacataatgatataaagctattgtattattttatgcatgcttcctggagcaagacataaagataaaactcattcaaaatgttcggaatatcatgaacttcactgtgggactaagcattcctgcacaagtccaaacagtgaacttaattcatactcttcagatgatagctgtgtctgtttaatattggcccaacctactcttgctcacgtattttccatttcactgtaatttttattccagctgtatattcaacagactgcctgccaaccctgtggaaccacttgacataaatgatgtattttgaaagattaaaccagaaacacgtattaaaaccatctttatactagcttaagacttaaagaagtttttatgtggattcaagtggaatgagaggaactaagaacggggaatgaggccccagaaaagcaaatttgaggttaaaggtaaaaattaaaattaactaatttttaatcaacatgccacttggtagcaaaaaattaaaatttattaatgactataatattatgaataatttcacatgctgaagtgtattgcctcttcaaagcatgcctcttgggtttaaatgttcttttcacatgtaaaacgttctggtaagaactgtgcctactttctatgaccttacctccctttctactgtaaaaacatcagcacatctttcaggaaaattgactgctgcccaaaggaaatacacataatttttaggtccctgaattcaatttctgaagatatttttcaggcattgcaaaagaaaaaagaaaaatgaatgagtttgctgtgtacaagaaataatctttttcataagcagtgcagtcaaaatgatagaacatgctcctttagtatttggcatctctacaatatcatttaattccctgacctcaatattcagtctttaacaccaaaaccataaaaagggaagtatgatacgtattcttcaccctgcacaagcaacttcctgtctcctcaaaggagataaatgatcctaattcactttaatgccggaagaaggaggttctgtgtcattctaataagcctcaaactcctggtactatttttaccccattgctgacctcagtggctgtggagagcagaacaccctccctcaacaaatgcaaatagactccagcagcctttcttgaggagcactcaagcaattacttctgagtcctcaagtagaattcacattaattgattcccttttgtaggcttttccttagcaggagatttaacagtttttctcttttgtttggaattctgcatcttggtggaactgacaacctcctttattttattttattttattttttagaaagggaaatatgaaagagaagagcagaaaggagctctattacaggtgggatttttttcccccttgaaaatatcctgagtgatagcctagactccaggctggctggaggacttgcagaatgcagggagggatctgctctgcctcctgcctcagtataaatccctccagggacaggcactctgctcctcagttttctagaaaagtgcccatgtacatttctgaattatgaaagcctctctaaatcaggaattacacagtcctctttcatctggcttgtagtcttggcctacatgaattaattgtcagcattttaaaatagggaaattccatctaaatatccggatttctgacttttcttaaaaacttaggagaaaatttttgagagaattttctgttttcttaagaaaaacaatagaaaagatctgtttggtgtgagtcaaaaaaccactattcccatttgttttctagttcattatactccctgtaatctcacagaactgccacaaagtgacagttattgtaattgtacccacactgttgatcataagttcagaggacagtgaaatatttcttgtacaaagtataaaaatttaaaagatagactaggactagcacagatttcaaggaaaatgagagagaacggccaggcatggtgtctcatgcctgtaatcccagtactttgggaggccaaggcaggtggatcacctgaggtcagtagttcaagaccagcttgggcaacatggcgaaacctgtttctgctaaaaatacaaaaatcagtcagatattgtggtgcatgcctggaatcccagctattcgggaggctgaggcatgagaatggcttgaactcgggcggcggaggttgcagtagggccgaaattgcaccactgcactccagcctgagtgacagagggagactctgtctcaaaaaaaaaaaaaaggaaaaaaaaaaagaaagaaagaagagaaagaaaatgagagagaacaactgtttctttatggaagtgaaggatattcctgcgtttaatatgcaaagcatctgtatcaaaagaatttgactaaaaatgccattataacccaaacccagccctgtggacacatgcattcatttgtgacttatgctataaaaaagcctgagagacattcatatttgcctacctgttgctcatggaacaagatgctcaggccctgagataacatgatgaatattcattccttctgttttcccagttctgtctcttgcaaataaccaaaagcagcatgtctgtacaccattattagcccaggagaaagggagagacatatgatgtgcaagacacatggtaggtgttttagtacatttaattccctaggagtgctctaattaggtatcagccccatttaaaaatgagaaagttgaggctccagagaaattaagtaacttacccaaggtcacagagcaaagctactaagtggcaggcctgccattgtgcttgcactactcattgaaatgctttccctgaattactacttagcacaatgactttagtttttattgtgggttgatcaggagtagccaaacaagagtattctgttcatattctataaaactgctattgaggatgctaatgtttgtcaaaagatctgtctaatgatcttttctttgcagtgagtgacagatgaagtttgtgtttctgaacaaaataaaaaatgtacttctgtttatgtagccagaaacaaatgatactagctatcctttttgccttcatttccaggaagctccaagggaaatgtattgtcccattccatcttatggtaaaattaatcctcccttttgccacattgttttggacctttcttcctggagtcattattgtgctttggtgtgttattaattctgttattcaagttgcatctagttgtaagcttcctcagattccttttaaagaaggcagaagtataacttataaataagacccttaaaattcaatttatacccctaagagtaattaataaatccaattttaatatgacactagatttaacagaaggggctatttggggaatggcccaaaagcctttgggtcatttctggcttcggggaatcacaattaacagagacaactctctcaaattgagctctggcccagtttgtcttgcattctgctactgggcgatagttgctaacttgcacagagaacttactgtgtacctggccctgggccaagtgcttgacatgccttgtctccatctttgcagcaagtatatctagtaccattcttacccctattacaggaaattcaaggatcagagctcaagaaactagtttacaggcacatagataataggtttgatcttgagcaaagaccttgacttcttggtgtccatgtccccacctgtaaagcaggcatatgctcctttctcaatctcctcacaaatctgtgatgttagtcacttctgtcctccccgcccccactgcaaggaactagatccaaaggaagggttatattctatatctcaaccttcctagtcttttattttccctgagggttctctcaggcacgttggccaccaacttaatcgaatcttctcttttcctagggagacggaaatctcatgttctgtcttttctaagctctactattggcctaggttgttggttatcatcacgctttgtctcacaaaatattttaaatctcaattcaactacagtcaattcttgttattcatgttagttacgttatataaccggcatcccccaacccctgggccacagactggtaccagtccatggcctgttaggaaccaggatgcattagcaggaggtgagctgcaggtgagggagcattaccagctgagttccacctcctgtcagatcagtggtggcattacattctcataggagcaggaaccctatcgtgaactgtgtgtgtgagggatctaggttgcatgttccttataagaatctaatgccagatgatctgaggtgggacagtttcatcccaaaaccatgtcccccaccccaggtctgtagaaaaattgtccttctcgaaactggtccctggtgccaaaaaggttgggggctgctattgtatatagtctccatgaatgttgaattatctaatttggaaccatttctcataagagaaatagaaggttagtttcctttgagcctctcacaaacttttatcaactgatcagtatgtacccttcttttatgtgtttctgattaaagacaccttatttagtatgtattgttgattcactaacattgagcttatggccaacagcactgtaacttatgcctgaatgaagctaatctacagcattttctgtaaaagctacatcacaacttactgtgcttagaaacactaaacagcatctcagcactttgcttgcaagccatatttaatagtaaaatcaccaacacaaaagcataaaaatgtaaaaaaaaaaaaaaaagcactaaatagtccatggagaggacatttgtttccagtaaagagctgaaacaagaaagatggagcatcaccttgttcatcttaagctgggaatgtatgcgttgattgactgaaattttttgccactctatgcgtgtccactaatgaccatgaaagcattgcaagtatttattttgggattacaaagaaattttagggatattaaccccttgcctgttataagttgaagagtttttgtttttttcatttttacttttgctttgtatttttactgaatttatatgtataataaagtttatcagtctttttccttattgctttagattttgagtcagaattagcaaagcttctgtactcacaaataatagtagaatatacctgtattttttttcctagtgcttttatgcttttttacatttaaatatctgatcgatttggaatttaagttgcggtatggtgtttggaatgagtatagttttaccattttccatattgctcaaccagtatctcaacatttgttaaatgcttatattttccccaactgatttgatatgctgcctttatcaatcctaaattttcatatatcattgggcctactcgtgtgccaatatcaaatgctttatagaggctttagagtatgttttagtatctgataaggccagcagttgcccccacaccaccttgtttttttttccccagagatttcctggctgttcctccttacttgctcttcatgtacttgtcatttcaagtcaatctgcatatcaaatatcagagcttttcatttggctctttatggctattttctgacaccatagacatttttaattagaacatttttagtgttctatgaaattgagaagtattccttctgactcagtgcaagtgatatatgactgtcccacttaagcttgagaagcaaggttctattaggctcactctccttaagtaaggtatggtccaggttactcatatccctgtgtttctcttgtgctaataatcagtgaagtccccacctgtgccactatgtcatatgtgtggtcaaatgctttcccttgcatattttttatggtgagaacacttaaaatctactcttagtgatttccaagaatacaatatgttattattaactattgtcaccatgttatacaataaatcttttgaatttatttgtcctaactgaaactttgtatccttcaaataacgtctccccaactccctctccccaagcccttggtaaccaccgttctactctgcttctattagttcaacttttttagattaaacgtataagtgagatcgtatggtagttgtttttctgtgctgggcttatttcacttactatcttccaagtttatccatgttacaaatgacaggaattgcttctttttaaatgctgaatggtattccattgtgtgtatatatataccacaatttctttaaccattcatctgttgacagatacttaggttgatttcatatcttgactgttgtgaatattgctacagtgaacatggacgtgcatatctctacatactgatttcattttccttgaatatatacccagtagtgggattgatggattatgtggtagttttagtttttattttttcaggaacctcgctactgtattccataatagttgtactaatttaccttccgatcaacagtgtgcaagagttcccttttcttcacatctttgccaaaatttatcttggatctttttggtaatagccattctaacagatgtgagttgatgtctcattgtggttttgatttgtatctctctgttgttagtgtacagtgatgttgagcattttttcatgaacctctggaccatgggtatatcctcttttgagaaatgtctattcagtttttttgctcattttttaatctggttgttttcttactattgagttgagttctttatatattttgtatattaatcctttatcatatgcacagttttcaaatacattttcccattccatagattgtctcataactctgttgattgtttcttttgctgtataaaagcttgtttgtttgatgtaatctgatttgtttatttttgcttttgttgcttgtgctttggggtcatatccaaaaaatcattgaccaaaccaatgtcatggagattttcccatatgtcttcttctagtagtagatttacagtttcagtcttatatttacatctttaatctatttggaattgagttttatatattggtgacatagtagtctaatttcattatttctgcatgttgatattcaattttcccaatgccatttattgaagagattgtcctttccctgttaatgtgttcttggcatctttgtcaaaaatcaattggccataaatgcacagatttatttctgggctctctgttctgtttcataggtctgtttttatgtcaataccaaacagttttgattactatagttttgtggtgtattttgaagtcaggtagtgtgatgcctccatatttgttctttttgctcaagattactttggctatttggagtctttgtggttcattaccaatttcaggattgttttctctctttctgtaaaaaatgtcattggaattttgataggaattgcattgaatctgtatatttctttagttagtatggacattttaacattaatttttccaatccatgaacataggatgtctttccatttatttatgtcttcaatttctttcattaatagtttgtagttttctgtgtacaggtcttccatcttcttggttcaatttatttctaagtatttttttataactattgcaaatgggattgttttattgctctctttagatagtttgttgttagtgtatagacatgcaactaattatgtgtgtttgtttcttgtattctgcaactttactggatttgtcagttttaacagtgttttggtggattctttaaggttttctatatataatattatgtcatctgcagacagagacatttaatttttttctttccagtttggatgccttttatttctttctcttgcctaactgctttggctaggactctagtactatattgaatagaagtgacagtaatggcttctttgtcttgttcctgatcttaaaggaaaagctttcaattttacattgttgcatatgttagctgtgggtttgtcatatatggcctttgttgcattgagttacttttattgtatacttaatttattgagagtttttattatcatgttaggatgttgaattttttcaaacggtttgacttttgaaatgataatgttatttttgttcttcattctttaattagtagacttgtgtatgttgaagcatccttgcatctctgggataaatttcacttaatcttggtgaataatccttttgatgtgctgttgaactttgtttgcaagcattttgttgaggatttttgtgtcctatattcatcagggatgctgacctataattttcttttcctgtagtatccctgtctggcttgggtatcagggtaaggctagccttctaaaaatgagttgtaattattccctcttcttaagttttttttggaagagtttgagaaggattggtattagttcttctttaaatgtttggtagagttaagtagttaagtcatcaggccctgggcttttctctaatgggagacttttaattactgattcaatttccttacttgttactggtctgttcagaatttctatttcttcatgattcgctcttagtaggttgtatgtctctagaagtttatccatttcttctagattattcaatttgttggcatataattgtccacagtagtctgttatgatcctttgtatttctgtagtattcattgtaatgtcttttctttcatttctaactttgagtattctcttttcttagtctagctaaaagtttgttgattaccacctctcagtttcattgatcttttctattgtttatatggtctctctgtcatttatttatgctttggcctttattatttccttccttctaactttgggcttaatttgttcttttatttctattttgttgatgtatgatgttagtttatttatttgaaatattcttttttgatgtaggcttttattgctgtaaattttcctcttagaaccgcttttgttttgcatccttcaagctttggtgtagtatgtgcttattttcatttgtctcaagataatttttattcttccatttaatttattctttggttgctcaggggcatgttgtttaatttctaagtgtttgtgaattttctgaaattcctcctgttattgacttttagtattatactattgtggttggaaaatatatttcatgtgatttagaccttcttaaacttaagacttgtgttatatatagtctatcctggaaaatgttttatgtgtgcttgagaagaatgtgtattctgctgctcttaggtggaatgttctatatatgtctgtaccatttgctctaaaatgtagtttaagtcaatgtttctttcttaatcttctgtctggatatccatccattgttgaaagtggagccttgaagtcccctgctattattaagagtctatcctttcagatctattaatattttttatgtatgtaggtgctccaatgttggatgcatatgtatttataattgttatatcctcttgatgaattgaacctttcatccttatataatgatgttttttgtttcttcggttttttttttttttacggtttttgactaaaagtcttttttatccgataaaagtatagttaccctgctctctttttatttctgtttgcatggattatttttccatcccttcactttcattttgtatgtgtccttaaaggtgaaatgagtctcttgtaggcagtatatagttgagtcttttttattattattcatccagtcattttttttttaagagatgaagtctcactgcgttgaccaggctggagtgcagcagcatgatcatagcttattgtagtctcaaactcctgggctcaagtgatcctcctgcctcagcctcctgactagctaggactacaggtgtgcaccaccatgcccagcttatgtttcttgatttgataatgtaatccatttataatcaaggtaattattgataaggactttttagaaggagtttattcatttattctacgttattccacttttgaataaaaaatattcaaataaatacatttgaataaatttatgtatttatttacctttactctcacactactcaacacttctgacaccaaatgtgtgagggtatttccctacacatgaagcaattctcccatggacaccagctgagtatcctataattcaatttttaattctgacagtagctacctggaggtaggattggatcctacaggttaagggctcagtcccacaagactgctccctactttagatgtcaatcagaagtagtaggttgtcacctatacttctgaccaactggctgtaaattgggaccaccactaccctctccttgggtttgattaacttgctagagtggctcatagagctcagaaagtgctttacttacatgtaccagtttattaataaatgaaataataaaggatacaggtgaacagccagataaagacataaatagtgtaaagtctagaacagtcccaagcataggagcttctgtccctgtggagttggggtataccaccctctcagcatatggaagtgtttaccaaccagtaagctctctaaaccctgtagttcttggagttttatgaaggcttcatcacataggcatgattgattaattaactcaatttgtagctcctctcttctctctggagaatgtaggatggggctgaaagctgcaagctatattcatggcttgatttttctggtgaccagcccccacccaggagcccaccaagaattgcctcattagaaaaaaagatgctcctatcactgaggaattccaagggatttaggaactctgtgttgaatgctcctatcactcaggaaataacaaaggtcataggggctttgtgtcaggaactggtgccaagaccaaatattagaacaaaagattctcctggcactcctatcactcagtaaattataaggagttttgtgcaatgactaggagaagggtctaatacatatttcttattattttacagacttactactgtcactttgttaattgtttcatggttgttttgtagatcctttgatcctttcttcctctcttgctgccttcctttgtgatcaggtgtcttcctctagtggcatacattgattacattgattcctttttttttttttttttttttttcacttttgtggctccactatagtattttgctttgtgtttaccatgaggcttacataaagcaacttataaaagccttttttcaagctgataacaacttaactttgattgcaaaataaacctttacaattttactccacttccctatattttaaatttttgatgttacagtttacatcttttatattgtgtatccttcaacaaattaccatagctcttattattttaatagttttatattttaacctccatactaaagataaaggtgatttacataccaccattatagtattagagtattctgaatttgactatgcacttatttttaccagtaagttttatgctttcatatgttttcttgtattaattagtgttcttttagctcagagaactccctttagcagttcttgtaagacacgcctggtggtgatgaactccttcagcttttgtttgcctggaaaagtctttatctcttctttatttcagaaggacagctttgctggtttcaggggtttttttggcaatttttttttccttcagtactttgaatatatcatcccactctctcttcacctataaggtttctgctgagaaactgcagcctttttggaactccattttatgttatttgcttcttttctcttgctgctttcaggacccaacagttcaattataatatatcatctgtcttgtttcaattgaatcttattggaagcctttgaccttcctgtacctggatatttatgtcttttcccagatttgaaaacttttctattatttatttttaaactttgtgttcctttgtctttttcttaaccctcctataattcaaatatttgctcttttgttgttgctccactaatcccataagctctcttcattcctttttattatttttttctcctctgactatatattttcaaataacttgtcttcaagttcacaaatttttcttctgcttgaccatttctgttgttgatgccttctattgcatttttcatttctttcattgtattatacttttcagctccagaattgtctactttgttttcttgtttttaaataatttcaatttctattaaatttctcattttggtcatttattattctcctgattttgttgaattgtttctctgcacttaacttccttcatacaattatttgtactttttttttctcactctgtcacccaggctggagcatgattatggctcactacagcttgaacttcccagacgcaagcaatacttctacctcagcctctcaagaagctgggaccataggcacacatcaccatgcccagctaatttttaaattttttttgtagaaatggggtcttgccttgttgcccaggctggttatacaattatttgaattctttgttaggcagtttataagtctctgtttctttagggttggtcactggtgcataattttattctttggtggtgtcatgtttctttgattgttcctcatccttgttgccatgtgttggtgtctgtgcgtttgaagaaatagggacttattccagtatttgcagacttgctttgtttgggaaagccctttttcagtcaacctgtccagagattctgagcaggtcgtctgatgttgtccattagcaggcatgctgttggagtcttcgggcagcctggcttcatatctcggtcagcaggtggtcagcctggtacccgagtgtatggaattgaacctggagcttaaaactactgtagtagacctgttattgggtctataggcatgggcctggagcatgggttgcaagggtgggttgtttttcctttatgcagtgcttttggatgtaactctgtactttcttaggatttcatcccccaaattgttatcctcgtaaattattctctgagggaccagactgatgtgattaatattttctattatatggttgaaagaggcttctgatggaatctaactgtggcttgccatctatccaaagcagcgcaattgacccaagagattcagctgagaaaccatcattagaatagtaagttagttcagtaaggtcacaaaattaatgtcagtcatttttatatagaggcaattaggaaatataatggaaacagaaattctatcactgtgaaaaaataaatataaaatgtctaaaagctataaaacttgacaggactgtagaacttaaagaaaaacactgaagctctacaagaagacctaattaagattaatttttaataaatagccaaatggtgcttctagttgggatagccctgtgtaacccagttgatcccaaatctcctagatttataggctcagttgtttttgataactgaataaggtgaacctgttccatgtattatgggaagtctgtcactttttcaaaaatctttaagaatttccagagactactgaagggcttataatccccttgatcaatatattaaaccacaactgtttctctcttctcttgttattgatcatttatttattcattcattcattgtttatttactaagcatttattgaatgcctaccacattctaaacgctccatagatacccactaaccattgctgtggctcctaaggctgctgcctctgactgcttgtgggtcgcccttgacttgaaacatggtctcttctctttcattgcccctgtcaagcatcactaatacaaggctgttttgtgtcagacttttactgaggttttgacaatactggttgtggatgagcattgtggaaaaggaacacagatgtagcatattgatacagtttggctgtgttcccacccaaatctcatcttaaattgtagctcctataattcccacatgttgtgggaagggggactcagtggaagataattgaatcatgggggtggttttccctatactgttctcatggtagtgaataagtgtcatgagatccgatggttttataaggggaaatcccttttgcttggctcttttctctcttgcccgctgccatgtaagatgtgctttttgccttccaccatgattgtgagtcctccccagccgtgtggaacgtgagtccattaaacgtctttttctttataaattacccagtcttgggtatgtctttatcagcaacatgaaagcagactaatacatatatagtgtatatgtgcataaaacaagaagcaatgaaaaattaaatattagacatcttaacattcatggggcatctcctgtggggaatttctcactttatccttcatccttaggtcccacctgctaccatcttttggagttgcctctcctgtctcaatatttcttgtgtatcgtctcctcagcctctctaatttctagaccctttaactcctttttcctagccatagcctctggaaactcaaacctcctaattttttttttttttttttttgagttggagtcctgctctgccgcctaggctggagtgcaatggcgtgcaatcttggctcactgcaatctccacttcctgggttcaagcaattctcctgcctcagcctcctgagtagctgggactacaggtgcgtgccaccatgcccggctaattttttgtatttttagtagagagagggtttcatcgtgttagccaggatggtctcgatctcctgacctcgtgatccacccaccttggcctcccaaagtgctgggattacaggcataagccaccgcgcccagcccctaattaatttttgtgtaatgtagagcactttatctttctttttcttcctcatacaaatcacactggtggtgggggacgaatttgcctagccaaaaaagtcattgagctgttgtacccccctcccccaaagaagaacacttcccagcccctgaaaggaattcttctgatttccagagcaatacgttttggaatacttatgttcttcctcaccctagctggattttgatgagatcaagtcagtctctcccaaattaataaagcaaatagaaggtaattctgactataatcccaatgtaccttttctggattttaataaagtgatcttaaagtcaattttggaggggggtaaaaaaaaagcaatctcaagtaacaagtctttttaaaaagagtaataatatagaactcactgtacaagtggtttaatttaaacacttattgttctagttgaagaatgagcaaacagaaaaatataaaacttaatacaaagtccagaaacagattgttgatgaaaaaaccaaactccataaaatatttgaagagatttcttctgagccaaatgtgaggaccaagacctgcgacacagtctcaggaggtccttagaacatgtgcccaagatggttgggttacaacctcgttttataagttttataagacatcagtcaatacatgtgaggtatacattgttttggtctagaaaggtgagacaactcaaagcaagggcttacaggtcataggtgtattcaaagattttctggttggcagtttgttgaaggagttattaatattatttgaagacctggaatcaatagaaaggagtgtctgggttaagataattggtggtggaaaccaagattctcattatgcacataaaatggctgcccttagaggtaatagattgcaaatgtttcctgttcagtcatttaaaaggtgctagactctcagctaatctttccaggatcagaaaaagacctggaaaggcaagggaattctctgcagtatgtaaatttcctctacaagagatagctttgcaggaccatttaaaatatgtcaaagaaatatatttttgggtaaaatactttgatatttttcagggcctgctatctgtcatgtgatgctaaactagagtcaggttggaatttggtatcttgttactacaaacaatctgttctgtgagttctaagatcactgttttaatgttaatgctggtccgttttgcttcaaatccaaagggaagaaagtataataaggcatgtctggcccccacttcccatcatggcctgagctagtttttcaggtttctttggaattcccttggctgagaggagggagccattcagtcagttggggtgcttagaattttatttttggtttataatatctaagaataggaaaatatttagaatataataaatgaaataaaaaatactggaagtgtattagtttgttttcacactactaataaagacatacccgcgactgggaaatttacaaaagaaagaggtttaatggacttacagttccacatggctggggaggcctcacaatcatggtgggaggcaagggaggagcaagtcacatcttatgtggatggtggcaggcaaagagagagagcttgtgcagggaaactcccatttttaaaaccatcagatcttgtgagatttattcactatcatgagaacagcacgggaaagacccacccccgtgattcaattacctgccaccaggtccttcccacaacatgtgggaattcaagatgagatttgggtggggacatggccaaactatatcaggaagaaaatatgcgcaagtatttatataatcttggactaaggaaggcctttctttttttttttttttttttttttgagacagagtctcgctgtcgcccaggctggagtgcagtggcgcaatctcggctcactgcaggctccgccccctggggttcacgccattctcctgcctcagcctcccaagtagctgggactacaggcgcccaccacctcgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggcctaaggaaggcctttctaaccatggtagagtgtctgtgaggtaggtagaattcttattaaaaaaaacacttgaaaacctagaatgttatataacattgatgagccttaaaaacattatgctgaggccaggcatggtggctcacacctgtaatcccagcactttgggaggctgagatgggcagatcatgaggtcaggagatcaagaccatcctggccaacatggtgaaaccctgtctctactgaaaatacaaaaattagctggatgtggtggtgtgtgcctataatcccagcttcttgggaggctgaggcacgagaatcacttgaacccaagtggtggaggttgcagtgagctgagatcacgccactgcactccagcctggcgacagagtgagacttcgtctcaaaaaaaaacataaaataaaatgaaaacattatgctgagtggaagagccagacacatatgattctgtttatataaaatgtccagaatagccaaatccatagagacaatagattaatggttgccaaaggaggggaaattggggagtgacttatagtaaacatggtgatttcatttttgagtgatgaaaacattctggaattaggtagtggtgatggttggacaacttttgaatatattcccaatcactgaattgtataccttaaaggctgaattttatgtatgagttatatctcagtaaaaaaaaaaaaattaaagatagatagatagttctacttgggatgtcatgagaaaacaaaaaacctggcatgctagtagagaattgttaaagaatgtaaattttaaaaattttatatacaaatgaccaataaacataaaatgcaaattaaaacattgagaccgaatatttgcctctcggcagagatgaaattattaatttcttccttgggtagagtgtagtctaatgattattctaatatactagtattggtgaggagcaatttggtaatatatttatttcaaaaagccttaatttatgtccttccataatgtgtttccatttctaggaatttatcttaaagaaacacatttgccatgtaaaataaaattgtaaagtaatagtaataacacaaagctatttctgctgctaaggagaaaaattaaattaaaaattaaatataaaatgaaacagaccaatagaagtgcacattcaaaaggctaaagagatacactctaaaatgtgagcagtaatcacctcttatttgtgggattatggataatatatattttcttgtttatttttatctgtattttctgtttactttttctaaataatccataccagaagtatccttgtaatcagaaaataatagaaaagttatttaaaataatacagtttcaagtgtggcgaagctttctggcttgttttttgtttgttttatttgggtgtttgcttgttttgtgagcaccttagcagaaatgagatgagaaaataaattttttgtttctcctgtgattacagagattcatgagagattcataaaaagtcttcaattctgaacccagattctcactagctacccctatgagcttccttcagtggggtgtatagtttcagggttcgaccagttgattagttggtaattttataacatacaccattgtaaattaaactgtggtgtatttatcccaagattttttctctttgaaattgggtaagttaggcattataaccaagatcctattgagtggagttatttctgatttttaaattatgttcctcagatgtaacaattttcttctcccaatttcctagacagaatcatgaataaactggaggataagcaggaccagatgataccatgaagagaagtttacaggccctctattgccaactgttaagtaagttgacactgtatttcttctttcctaaaatatactaatgttattatttgctgggtacccacaacttactttttggacggagaccagggttggatcggtgaaagaggacagtaaagtttcactctgcttcatctagatgaagtatcaagcgttaagtcattctaagatctctgttttaatgttaatgctggtcagtttttcctaaattccaaagggaagttttaacatcagttatagttacaacttggacatcagttataatttaaactccattataataattctaaattgatgtattaagcatagttaatttgggaatgagtgtccaaaaacattattgcctttagtttagtattcttccaggatgacctgctgtagattcctcatgaagaggaaatggtaggttgtattttctgtattttaacacatagaacctgttgccatacagcctttggcttaaaatgttatgcatagctatacatggttctcaaataacaagtggtgaaaatgtgacttcttggttttgtggtggaataaagagtgttcaattatgactttctttttgcacatcactcatgtgttttgggtatagtgccacaaagcaccaattgccatgtagtgattgtactttctttgggattagaattgctactgaatgaatgtaaaagccaaaaccaattggtgggtttgatgttccagttaacccacttaagacaataggcattacccgctccaggtcaaaccaaagccagtgagttggaaaattgggagttattgtttgtcttgttcttgctaaggtaaatgaagtacctatctttcctaggctgagtggctccttgttaacttttgttgagagaataaaatgaaaagatattgagatgcaaatcaccagtcagtcagcccttagaatttagtaattcagcttatgttgtacccccagtgcaaagcacttcatctacagacagcattctggccgggcgttttaattgactcatttcttctgctgaattctaatccctaaaacacatatcacgtcagcctgtttcagcctggtggaaagtcgccaagtgttatagggactttctcatgttccttttccatgtgttctatgggactgccagtttgttgctttttaaaaaatgataagcttgtttgttaaagaataggctttaaagattaaagaagcaatgtcatcaaggaatgattaactctgccttgatgggagaggagacatatgaaggataaataggattttacatacacacatacacacatacccctcagagaagggtaggaaggctttgtagccagaaaaacaggaaataaagaacaacagagtagattttggaacagcaaaatgtttgttgagttcacctatgccgattgtatgccccaaagtttgcataatattttagggtcgtatgttatttgaaaggcatcagtaaattatcctgcagtccagagagacaagacttatcctatgacgaggtccatcctcttatattgagcaactctgaatgctgaagggggttcaaacatcatctggctagctacagaaaacgactgtgtcttaacaccttgctgtttgcaaagcttgctgggaaatgcaaacagtccagaatatgtagtttcctgctggttaggaggtaggtagtggccctcactaaaccaccctgattactgacatgcatatacacacaatagctcctatatgtcactggtcagccagttattaagttatgtgtatgttaacattgtccacaaacagaatgtttttaagacatttagtctgtgtctaaaatagacttgagaactagcatcaacacacacaatatgttattttatataactcatatattttatataactcatgataaaaatatatatatttttaatttggataaaaaatcatgattgagtattctggtttttcattattacataacaaactagtctaaaaccttgtggcttaaagcaaataacagttatttatttcgttcatgaatctgtaatttgagcagggcttagcagaacctactgtctccactgcagagtgtttgggacctaggctggaatgactctaatggctgagggctccctgaggtcatctcacatggaaagtttgggctcccccacaacatggtggcttcagattggtcagaattcttataaggcagctaccagtatgaggcttgggcaaggcttagaagatttattatgaattaatcttgaaagtcccagaataatacgcatgccacattgtactatctgaggaagtaagaccaacagtaactcaggggaagaggaattaggcttcacttctcaaagaaaagaggagcaacagcttataacagttatctttagtctgctacagagaatatctatttgtttaaaaaaacaaaaacaattactagtggacattagccagttcataagtcattattaatatagaagctataccctcctttgtgcctactatgttcacaaggatttgctgacagtttacctaagtctcctcaattattccagaggcagatgcttcaagatgaagaagcattacagatggataagcaaggactggcccagggtgctcagtgagttcagttcacagccatgtctctctgacccctgcatatgtgcccttttcttcattctgccatggtgccctaccacacacaggaaaaatcagcagtgtggtccctctgctgcccttatagctaagatagggagagttctagcccataagcagtaaagtttgcatcttgcgagtgatgttagatgagtgctggggtttggatatctgatccctccaagtctaatgttgaaattttatcccgttttggaggtagggctaaatgagaggggtttgggtcatggaggtggatctctcattaatagattagtgctctctctgggagaaggaaagtgaacaagttctagctcttttgttaccttgagagatgccccaagagctggttgtttgaaagaatctggcacctccctctaccttgcatccactcactcaccatgtgatctctgcacatattggctcccctttaccttccaccaccagtggaagcagcttgaggcccttatcagatgcagatgctggtgccgtgcttcttgtttagcctgcagaactgtgagccaaataaacctcttttctttatgaattacacagcctcaggtatttctttatagcaacactaaacagactaagacagtaagaccaaaataaaaagatgttctttagatcactgaatcataatcaatagtcactgaggcttgtatgtgcccagctggggctaagggatgcagtctttggcaggcaatgctattgaggttttaattgtttacttttgttacaactgactatctctgcctttgtttttatttcctgagctctactcaggaatgtggtactgagtgtttcatcccactggctttagccctttcagaaggtttaacacattttacatgatatcttggaaaagctgaaagcttgagtatgagggtggtgatgagagcctttatggttatataaaaaccagatactgtcattcatttttctttctgagacctaaataatcaattagatgttaaagctagtcctaagaatacttgtgtttttgagacatcagacaggttcaaatcctaggtttaccactttcgttttttttttttttaattttattattattatactttaagttttagggtacatgtgcacaatgtgcaggttagttacatatgtatacatgtgccatgctggtgtgctgcacccattaactcgtcatttagcattaggtatatctcctaaagctatccctccccgctccgccaccccacaacagtccccagagtgtgatgttccccttcctgtgtccacgtgttctcattgttcaattcccacctatgagtgagaatatgcagtgtttggttttttgttcttgcaatagtttactgagaatgatgatttccaatttcatccatgtccctacaaaggacataaactcatcattttttatggctgcatagtattccatggtgtatatgtgccacattttcttaatccagtctgtcattgttggacatttgggttggttccaagtctttgctgttgtgaatagtgccacaataaacatacgtgtgcatgtgtctttatggcagcatgatttataatcctttgggtatatacccagtaatgggatggctgggtcacatggtatttctagttctagatccctgaggaattgccacactgacttccacaatggttgaactagtttacagtcccaccaacagtgtaaaagtgttcctatttctccacatcctctccagcacctgttgtttcctgactttttaatgatcgccattctacctggtgtgagatggtatctcattgtggttttgatttgcatttctctgatggccagtgatgatgagcattttttcatgtgtcttttggctgcataaatgtcttcttttgagaagtgtctgttcatatcctttgcccactttttgatggggttgtttgtttttttcttgtaaatttgtttgagttcactgtagattctggatattagccctttgtcagatgagtaggttgtgaaaattttctcccattttgtaggttgcctgttcactctgatggtagtttcttttgctgtgcagaagctctttagtttatttagatcccatttgtcaattttggcttttgttgccattgcttttggtgttttagacatgaagtgcttgcccatgcctatgtcctgaatggtaatgcctaggttttcttctagggtttttatggttttaggtctaacatttaagtctttaatccatcttgaattaatttttgtataaggtgtaaggaagggatccagtttcagctttctacatatggctagccagttttcccagcaccatttattaaatagggaatctctgaattttagaccaatatccttgatgaacattgatgcaaaaatcctcaataaaatactggcaaaccaaatccagcagcacatcaaaacgcttatccaccatgatcaagtgggcttcatccctgggatgcaaggctgtttcaatatacgcacatcaataaatgtaatccagcatataaacagaaccaaagacaaaaaccacatgattatctcaatagatacagaaaaggcctttaacaaaattcaacaacgcttcatgctaaaaactctcaataaattaggtattgatgtgacgtatctcaaaataataagagctatctatgacaaacccacagccaatatcatactgaatgggcaaaaactggaagcattccctttgaaaactggcacaagacaaagatgccctctctcaccactcctattcaacatagtgttggaagttctggtcagggcaattaggcaggagaaggaaataaagggtattcaattaggaaaagaggaagtcaaattgtccctgtttgcagacgacatgattgtatatctagaaaaccccattgtcctctcagcccaaaatctgcttaagctgataagcaacttcaacagtctcaggatacaaaatccatatgcaaaaatcacaagcattcctatacgtcaataacagacaaatagagagccaaatcatgagtgaactcccattcacaattgcttcaaagggaataaaatacctaggaatccaacttacaagggatgtgaaggacctcttcaaggagaactacaaaccactgctcaatgaaataaaagaggatacaaacaaatggaagaacattccatgttcatggataggaagaatcaatgtcgtgaaaatggccatactgcccaaggtaatttatagattcaatgccatccccatcaagctaccaatgactttcttcacagaattggaaaaaactactttaaagttcatatggaaccaaaaaagagcctgcatcaccaagtcaatcctaagccaaaagaacaaagctggaggcatcacgctacctgacttcaaactatactacaaggctgcagtaaccaaaacagcatggtactagtaccaaaacagagatatagatcagtggaacagaagagagccctcagaaataacgctgcatatctacaactatctgatctttgacaaacctgagaaaaacaagcaatggggaaagttttaccactttctaggtgacttaccttaggtaagttacttaagcctctgtgagccctagatgtaaaatgggatgtgatcactcactacctgaggtggtattgaatgagatgacatgccatatagaagtcctacataaatgccagctttcttactggccttcctgcctggaaaacataaggacaatctaaccaggagctctgctctaactaacatttgtgtggaaccttctggttcacaaagcattttcccataatttggtcctcacaacaaccttgtaaggcaagtggggcattattattgaccctattctacagagaaaggaattgacatgatcaagactgcttttgccaagccacatcacaattttttgaaaaagtttttaataatggaaggtaaagagcgtcatcacaatccctgaagaccatgccactgctgaggagggtctgaatctgagtcttgatttagcagatgtggtgtttgcttgggtactgtgtactggaaaattgttatgctactttgttaagaagactaaggcaattattattttatgagaatatgatgtttttacatatcaatatctattcaaatcagaatagtttaaatacttagaattaagcagtgattatgttttgtaacttcagtgtttgctatacacccagacatttgaatttcttaaatcatgctctgtattgttactctagtacaccctgctagctcattcatgcaccctttgcatctactggtctgtgtcaaatcacacaaagtaattttttgttcaactcagataactgtctgtaggtccctatcttaggaaaaggaggggaagaaggagaaaaaagaactactggtatggatttggacccctactctatagaatttagaaggaaaatacacccccttttctgccatctttacctggggcatggagatcatgtctcagtctcagatttgaattatatgtatgtatacgcacaaacacacacacacaaatccatattacctgtctgtagatttttctgggcctaatgagaagctgcttgggagttcatttccacttgaaacctattttctgatgggatgatctgcttctcatgtgatctctggaactgagtggaacccttgaaaacactttaaagtgagagaactctctttggtgccttttcaactctaaccattccttcttgcctaccagctacccagtgactattctttcttccagttacttcttaaactagaaggatccacataactatatctttttcaagagactgacatttcccctctctttttcttcttccatgcttatttttgtcccatattagacccaaagcccccaacatgctaccttctcatctcagatgtcctcctgtggtctgtgatctgaagttctcatgtattccattaagatggaaagcaatttgactaaactaagtaataccaagatgtgcttactggttaaggagagttaaggagctcctccctccttagctgtcagagatatttgcattttgaagtgatttggtattgttttaaacagcattgagtacagtagtttaaagaggtaagcttcctagggtctgcgcatttgtctgtgtctctcagagtcatgggtcaggaatctgcatatttcccttgctggctcatttcttcttccttttttttgtccagctaacaccagaaatgatcttcttatgctgtatgtacacctttgtattatcaccatccaaccagattttgcaatcccaaatacatgaagccatccttgactttcctcccaccctaccctggatgcatttggatactagcaatactagctcctgttgaacttaacacatgaatccattcatgtctctgcatccccattgtctcagctttagagaacagctttctatgttctttctggaccattttaatagtcctctgtttattgtcctattctcaggtcttctccttctaattcatcttcacattactgccaaattagctgcttgtcatctgataatctttccatggctttgcattaccaaaagcagcagttctcataatgtgatccaagaatccctagggacccctgaggcttttacaagaagtctgtgaggcccttctttttccaactatacatatttataaagccagatttttttccatgtactgtacttcaaccaaaataacatatctcaacagattgaatgcagaagctgataagagaaccagctgtctttcataagccagacactaaagagatttacaaaaatataaaacaatgccatccttctaattttttgtgttagcaaatgctttttcattaaaaatgctatttgttaagagtaatgagtttgtcatgagttaatattttttgttttacagctttaacttttaatatagtaaataccaatagatataacctatattttgaaaagctctttggggagtcctcaataaattttaagagtatgaaggggacatgagaccaaaatgtttgagaacctctgacctaaaggataaatcctaaattccttaggttagtgttagagtcattaatagtctggtcccggactacctttccagcctcatctcttatcccttctccctttcatatccctcctccctcactcacacacatacaccacacaattctacccaatagacaaacacagtgtgttccagccatcataacacatactctgtccaccacaaaatatttagctctgattatacatgtgcttgttttctttttgtctagcttctcaggcatgggaattctatttcatcatccattcctttgtttccagtctaatcgggagcttgattcataatgggagtcatacatgtttgatttaattaacatatttcgtcaaatctaagatgctagtagttttaagagccactgttattttatgaaccactaaaaaagacaaaacgtttcttaaacaatcacacactatcaattacatcttacaatatggaaacacaagtatagataaaatacagaattatttggattgtggctaactgggaaatgtactttctgagcctctgccactaaattctcctttagtatcaggtctcagcaaacccatctgtagttctagctcccaccctaggtgggcctcatggaacaaaagaatttcccttcagaaactagagagagattcaaggagctgggtcatctctagctgaagctggctcatgtattttgtcttcatggcttgtttctcatgataaatgagaggaaatttttcctgtagttgaggaaggaaagttgatatgaattataaatgacatagtatttaggtccaaacaaattttgactccaaaaatacgtgaccttttagatgttacagacaatcatacagatattgccattctgtatacataagagtcagagtcatttccctagtgtgaggagatgaacggaacttcaccattctttatggggtcttcctttcctcctccacctttcccagtgaagttgtcttcccttgtgttttacactgcttggtcacagccttcatggacagtgattaagactgcgtgagttcaagtcctggcataccacaaattattttccaaattattttcatccttttccatccaaaacataccactgctaaataggtgctgggttttgtgtcccccaccccttacaaattcatcattcctgagctatcaaagactcattgctcttgaggaaataaacagcatttagtggcgtagaccagttcatcagcctgcagttcccttgtgctactagcagtggctgcagtagcagtaatgacacttctggtcatcagttggccttatggatattggagggcatccacttcattgacactaaaattcagtattttagactagattaacttgattggctttgattagtgtttcccaaatctggctgtacactagaatcacctcgggaactttttttaataaatccactttcccagaccccgtcccagagcaattaaatcagaatctttgggcatggggctggggcatccagtgattctgatgcgcaaccagggctggggtcactagctttgatctctggttcttaaactttagtgcacaacagaatcaccttaagggcttatttaaacactgatcactgggccacccccagagtttctcattcagtagatctggggctgggccaagaattacatgtctaagtctctagtagtgctgaagctttggtccagagaccttgagaatcgctattgtagacttatgaagggctatccaggagcaggagacgcttttagcttccctacctcacttgggctacatgatggagaagtgagttctggaataaaaccaggatcagttaggaaggagaatggagagaaggtgacagagaaggagctagcagaattcctctcaagtgttgtgggattaggaactgttagaacttgaagtttcatgttattcttcaggatgtactggaagttagtttttactctgttttaagaatgagaagggcacaaggaatgggctggctagggttataaagcaaaaggaaaacaccttttgagtaactcttggtcttgactgcttattgcagctgtctcattttagaacttgattttataagactttttttcttatgctgtgtaattcttttgcaaatcaaaaattagaggctgtttttggggggcttgattatgaagagatttgcaaaagttctctagggagaatagatctctttacttctgaggggtaagtcattcacatagaaaatttgaggaagtgactctttccaagatgatattaacccagaaagtttaggcataccaggtccttgaaagtgtcatgttgatttaatgtcttatgttttaggtagtgattttaaatttgcataagtcaacaattctcttctgcagataaaacaaaagtttaataagacattctcattgtaaacaatgccaatggggactaagaaaaaatattttaaagaaattcaattttatgaatttaagtacattccattacactgttggcagaagaatgtaggtgagggaagtagtgctcatacttaggagagctgttgatttatgtaaattcaaatgttaacccttaatgagtaaacccaattttctataggaaagtatttttgctaaaatatatggtgggagaaagcatagaatttcaagctctcatgttgtctcttactagctatatgactgcacagagtgcttcagctcccagagctccctcattgtcctcaactacaatgcacaggtgaccagtatattgtctaccttagggattgttgtgagagttaaatgggtagggtataaaaacatttcatgtgttgaaaatccctttcaaacatgggtttgctgtattactatcattaaataacattacttttgttgtaatattgtaagcaaatcttatttttgtttggcaaatcttatttaaaaaaaaaagaaaaagaaatgtgaaaggtagtctagatgtcctcacccagatttgaattcagtagaatgctcattaatacacataaacctcatgaattggggctatttttaaccaacagagaactgtcgtctttgttaaaatctggtataattctgggagatttttctgaagaaggaaaattcaaacagaatattttaaatgaaaaaagagttttttccagcagtttcatattgtctttgtaataaatatctgaaacatttttgaaacacttaatcattgcctttatatatgtgatggacactggagattcttcaagctagaaccccaaaagccccccaaacctaagatacattgcctttgcagcatcttctttcttttctccctctcctgttcatccatttccgttcccttcctttgggtcatttgcatcaccaagctttctcatctctttgctcctcccctcagaagttttctagcctttctgctcaagggaatcaattatctgctgcaagcatcctagcagctccttgaagataaatcatttgcctttgttccgactgtaccaggatatcactcagctatgagctgtgggcagccgcattgctcatgtcctccagagcatcttcatcagtttccctgtctgtaaaatgagtgtttgtattagtttcctgtggctttttttttttttttttttttttgagacagaatttcgctctttttgtccaggctggagtacaatggcatgatcttggtgcactgcaacctctgtctcccaggttcaagtgattctcctggtcagcctcccaagtagctgggattacaggtgcacgccaccacgcccagctaattttgcatttttagtagagacagagttttaccatgttggccaagctggtctcaaactcctgaccttcggtaatccacctgccacagcctcccaaagtgctgggattataggcatgagccaccacccccggcctcctgtggcttctacaacaaattaccacaaactttgtggcttaaaatagtagaattttttttcacagttttggaggccaaaagtccaaaatcagggtgttgaggggaggccacactctctctgaaggctctaaggctccaatctctgcctccgttttacatggccttctcctcttttccatgtatctctcctctgtcattggatttaaggcacacttggataatctatcataagctcatcccaagatgcttaattatatctgcaaagaccatttttcccagtaagatcatattcagaggtttcagggttaagatgtggatatgtcctttgggagaccaccattcaatcaactacactgtgatactgctattctgcatagagttattaatatatgacacacttagcatagtgccgagttcagaaaaggtgctcagtaagtggagggtacaggccaagaagtaagtagaaggtgaagagatggaaccatgagtttatacagttttttggagaagtttaaccataaagtgagagcaagagaaggctacaactggcagggatagagagctgagtgttttaaaaaccaatgtgttgagctggtctaaaagctcccgggaagggtgtgtggggactgagtgctataggcatgtgagcttcagatgaggtgagatgcacactgatgggcaggaactgctctacacgtgattctcatgctcacatgtagcactggtgctcagggtctctcctgcccttgtcaaccagtgctagtgctagatgcatgattgttccgtgtttgatgagaagaggcaagaatgagaatcccctgtcctgtgatcagtgagtcagattaacactgagtgtaagtgctttgagagaacagtgtaagatgttctctcaaagtcacacaactatttttccacagaacagagcccaggctctgtgctggcagcttgaggtcagctaagtatacagcagctcaggagagagccccagaaccctctgagatgaaaagaaatgcagcagtttgctttgaaattccttggttagatgaagaaattgcaatgtgcccactttgcccaaaaggcagagaaacaagggtccaagaatcacccagggaagcaatattgtgccagggaagcaatatcatgcctgggcatccctggaagcagtggaagatgaatgagatggaagggctggaagctctagagtgggccgcttgagaagggatggtaattgttcagattccagttgctggcccggaggtcactatgaggtagggacagcccctgagcctgaggagtgctgtttaaaagcaagtgagagtggctgggcagcttgcttgtataaacacatggggtcacatctaaccagttctcactgtgacacaggagaatccctgaaggaggaaaaggaggcttagacaaatatagttaacgttctttaattgatgttattgttattttgacctgcagttaagtgtaaaataattgagctaaaaaataaaatataattcttatttaaataacctagctatacaaatttcataaggaaaaatgttcatatttcacactaaaattggtctgattggggaaatattcatgtctttttttctggggcggggggtgggggggacggagtctcgttctgtcacccaggctggagtagagtggcgcgatctcggctcactgcaagctccgcctcctgggttcacgccattctcctgcctcagcctctcgagtagctgggactacaggcgcctgccaccacgcccggctaattttttgtactttttttagtagagacggggtttcactgtgttagccaggatggtctcgatctcctgacctcgtgatccacccgccttggcctcccaaaagtgctgggattacaggcatgagccaccgcgcccggcctcatgtcttttttaatgagtgtcgtaggttgggcggtccctagaagcagacctagaaccctgagaccaagagtcctgtggagtgacttattaggaaggtttcccaggaataactgataggggaaaagggtagtgggcctggaaagggaagaaaggatgagtatcaagcaaaactccacagagattgactttgttgcagtctgtcttgagagttctggtgagattataggtcacaccttggacttgtcttcatcgggtgacagagtattataatctcggatctctcagtcattggttaagggcactgaagatgtgccaagctctgtttaaacattttaaattagtgacctacatgttaacatgtttgattggtttaatatatacaaagcattttaaaaagtgctataaatgttgggctgatgttattcttaccatcatcatcatgtgctcccctactcctcccatctctctgaatataaagtaaaacctcatctcgcttccattgctaggaccttgttcctggttctcatgtatcatgttacaaatacaacttactgcatcttcctcctctcctctatgaacccgtcctaagtctcattctctgaaaaccagtatggaggttccatgtaagggctggagatggctggtgaagggctgattgttaaacatttgtcatatgcccctgggttagagatgtaattgaagttcgccctggatgtagtcccatgggcctctcttttgcattattaaatcataatgataaatgagtatgaccaggtattttattctttccctggagatgtggcttttatagatgtggtctccttgataatgttttgccacagaagaaacttttggcagaatcattgccagcctgacaatcctccaaatttcccgaagttcaaggaatacttcgaaaacgtaaagttctgaaaactagaaaatattgactttcataggaattgtagtctaattataaagaagggcagtctctgtgcaggacatctgattgtatttgtgaggaaggtggtccagattttggaggaaaacattcttgtgtgtacaacagggaatttagaagtttaccctttgatgttatatgagagtgggttggctagatgtcatgtaattttcatttttttaaagaagagggagaggaagagaaaggtaagcatcagataagcagttgctaaatctttaaagggtcagagtgtttctgtttgtttcctctttctttaattttctaggacaggacttttattccctagaatatacagaagagtcacaaaagtctatgccgtcagacctgaaaggaagatcctttagtaattgccactgtgtttagtgcatgaggaaatggaggccatcctgagtggagaagtgacttacccaggatccaagcctagttgatgtgagagaagaggcttaagcatgagtccagattctcagtgcagtgtgcatgctaggatgtcctctcctacatccctctgcacagcagtactccagtcacactgatgttcttttccttcttcaagcacttcaacttattccttgcgaagttctttgaccagttgtttgtcccagcctggcatgggtggctccctgctgttcagattacagccccaggacctccccacagcagttcccctcaccactcagcataaacacatcacccagtctctctccattacttttccctagtttaagttctgcacagcacttgaaattatacaattttttttgttgttctttgtttattgcctacagtcagttaagagcccacatggtgtattcttagcctagaacaatgcctggcacatgggagaccaaagaaacatggcattaaagtggaatgaactggacagaggaacaatgagcaggtttctcaagtggtccatattgttggatgagacttcattagagagaatgagaattatggtctaggttggcccagtctaatggacatagaacacaaggcacatatgtaatttcaaattttctagtagccacagtagaaaaagtgaaaagaaataggcaaaagcaatttaaataatatttgtatttaaaccaatgtattcaaaacattatttcaacatataatcaataaaaaaatctagtgaaatatttgctttctttttttttttcagaccaggtcttttaaatctcctatataatgtgcatttatagcacatcttcaatttagacactgaatttttttcataaatagttggttagatttcataaaacttacgattggaaaagtagacttacatacttaaaatgtttctagtgactgaattagctatcaccttttaaatttagttaaaaataagttttaataattcacttcctcagtcacacttgcaacatttcaagttctcagtgctacatgtggtcagtgactgcacaggtccatatcagttgcaccaaactattagttttgaagttccttagcccttcctgtcccatatcagctctgtggaaatagtctggcatgtggggctcattgagttagaacacccaggcaggccttatgccaggaatacatgactgtgccttgagtccagcagttttttggccattgtgttaagagataggagttggtgaatccttttaataccttgaaagttgaattgttttattctgatttgtcctaaaaaaaaaaaagcaaagttaggggattctcacagcgtccacagagcatatagtccaaaatgcagtgcacaggtgcagacatctctggaagcacagctcagggcttaaaaaacacagaaacaatcacataaagcagaggacctgactccacaacaaccctgcccaggtggccacagctgagtaagccacatctcatgcactcactccactgaggcaccgagagtttatctgtataggaaggtttgttgtctcagatcctctgcaaggccctgaactgaggagcagcatacttcacaagagtgttttgaggtcctcaccccttacagagacctctgcatgccatctcatcttagatattatgttagcagattctaccagcaactccaaaggaaattgtttcatggtgtgtgcatcccttgggagaagaacaagggttgttatattctgaaacatcagatgtcacaggcttctgtcatggctctaacttaattaccaagtgacagttcctctctgctatggacattagcagaccaactctaattaagatgtccagggctcagatgcccagatagccagggtgcctaacaagtaaacagaagctgaagtttctcctggggaaaactgtctcaaataaaaccttcaatcacaataatttgcaggtagtgctattttccaaatgaacaaactgtcaagaatgggatccttagaagacagccctcctttaaatccctctctgcttagttcatcgttattttttactttataacatggttgaagaaaagtttatatcaagaataatagaagtgtcagcctgccttttgcttgttgttcacttgtgcttccattattagcattgccttcaatccagtgtttatttcagatgtctttttaagctacctgcccatgttttaggagctaacatttcaaagtagataacagaataggcaaatcccctcacttggatacaagtaaactgcaaggcttcctagtgtcctgagtgttaaggaaatagggtaggccccacttctgagccttcccagatggggagcttcccctctttcattaagatgccacctgtctcagaggccaaccagaaaattttgaaatcaccaaaaggactattttcaatccatatttatattcactgttattcataataatcctaaaaaaaaaataaaaaataaataaatccctctctgcaacccctgggtggcaccagatcatttggtacccttctgttttcatgatctttcaacacacttttataaagaatctactatgtgctaggtattatgctaagcactgggaatgaaaagacatgaaccctgccctccaagagttcccaggccagtggagaaaaaaggcttcacatagaaaactgtggtacaaatgcagtctcctttatcagatagcacacctgctggggttatggctgtgtgaaaaactctagggatgcagagagatataaagcataatttcttctctccaaaagcttatagtataatcaaggagaaagggcagaatatgaaaaaatagtgtgttataggatacagtaggaagctataagtcaagccatgttcttaaatccaacttaactagtaataaaaataatgtttgatccacctctgactcctctatgtatgtttgaattagttctgaacttggagagaggcaacaattagtcctcttaaccaatataacaaccaaaggagactgacgataacaagccttttgtactttatggtgttttcccatctaatatgctgttgactcatcctgacaagcctgttgataggcatcattttaataccatgttactataaagaaaatacaatgccctaaaagccaagtgttatgcctaaaatcctagaactaggaacatggactgagattgtcttactccaagtccagtatattttccagaatcccagagcttcggtaggcaccgcctttgtatttggaaaactgtgacccactgaagacagttgtgccatctgattgtgtgtctcttgatggagtttataacttcagccagtgaactgctccagcctttcccttgcagtatgctttatcttgttttagcagctttagtagttggtctttttgtttctcccctgggtctgtttaaaaaaataaaacaaacagtagcaggatagaggtactggctctcaaatcagatattggctgggtaatatttaggaaaggaaatgttgcaacccattatggcagtgggttattccttttataagctgaggaatctgtagctcatttagcctcattattttttggttagcaggctctggttgtgccatccttatggctgtatttttagaagtcttggattattatagcaactgtgaaaaaggatggggaaagaaatctggcttctaatatacatccacttaattgtttcttgaattaaattagccttcatctagccctcagagaatgcactcactcctgctgctgattaaaagctgctacctttgcgtggtcactgagggggttatcagatgatgaaagaggtatttcagggtgctggtgggcctcctcctcatccagtttattccaggtaccagctgggcctgggagggtagaggtaggaaaggccagaaaggaagcatgtataatcatgacatctccttcacagtgccaaaagaaatattcacaatttgcgtcaagtctgatactctagttgtggaacttaagcctcttcattgaagctgatgtgataggaggaagagacagtaatgggacagccccactgtgtttcagagggtgaaaagaaactgaggaaataaataaagacggaaaactattaggctgcatcagtgcagtaaagggcagagaatgttagcccttaaactatttctgtcacactgtggttaattatagaaaagctttgaaggggttgaggggaaaaacgagagtagggaacactctgagcatgacagatgtaaaccgatgttttactgctcctccttccctccaccttccagtagtctccagtgtctattgttgccatctttatgtccatgagtacccaatgcttagctcccacttataagtgagaacatgtgccattaggttttctgtttctgcattaattcacttagtataatagcctgtagctccatccatgttgctgcagaggacatggttttattcttttttatggctgtatagtattccatggtgtacatgtaccacgttttccttatccagtccactgttgataggtacctcagttgattccacgtctttgttatggtgaatagtgctgagatgaacatataaagtaccataattttaaattaacttctgtggtgaataaattttcactacattaaggaacaaagagcttttaaattatttgagtaatatggtaatttaagtgactatcatgcatataatagaaacatttttaataagaaaaggaaatttcagtttatgaaaatcattatatgtttttaatttttttaagagaaagggtctcactatgttgcccaggctggcctagaacttctaggctcaagcagtcctcacaacttggcctccagagtagttatgtgtactttttaaacttcaaacaattaagctcttgaggtgtcagtagagtaacatcaaatgatctagaaatataggactctggcttagttctagataggactatgctaggaaatagacttctcatgcattatacagttggcccttgaacaatgtgggtccacttctatgtgaattttctcccatctctgccacccctaagacaacaagaccaacccctcctcttccgctctacctcagcctacgtgaagccagtgtgaagacaacaaggatgaagacctatatgatcatctacttccacttaatgaatagtaaatatgttccttctttcttatgattttgttaataacattttcctttctctagcttactttattgtaagaatacagtatatataacatacaaaatatgtgctaatcaactgttttgttatcagtaaggtttctggtcaacagtaggctattagtagttaagttttgggtgagtcaaaagttatatgtggattttcaactgtgcagggggtttgcacccctaattcctgcattgttcaagggtcaactctattcttgatgttagcatgtccacttgtacagttagcagcaatagcctcagtaatttttcaataggattttgtgctatatttgcaaatcatgaaatgttaaacaattgtgtttttcaggctaccatatgatttggggggatttctgttctgatatggaaataatactgagtagcaaatataataatttacaacataactattatctctaaccataggggtgatggtgtatttttttaatgtatccatcctttcaactctaaatttactttgcctctcatttttctttctctttctctcccatctcttaaagcagaattctttggtattgagccacttgtgttaaaattgtatagcatgttatcaagacaagaatctcttgaattttgtttgcttgcttgtttgtttcacttcatttgaggtttagtttttgactcatatagctttgctgggtagtctgggctggtgaactttcctaggatctcagccagtccatgatcagtcattctgtaacccaaagggacatggaatgagattgatagacaaagataagcattagtttcatttattcaacaaatatttcaatgtctgttatatgtgcaagtattatatgtgctatatcctgggcatatcccttaaaagtcaattaaaacaaacaaaattttaaactctcaagaaggatggctttaaaagattatccttctccaaatcaaattgttatggacatttattaagcacttactataaaagacactgcagaggttataatatgttaagataaggtctctaaagagtttcatacagccaaccaacagatatttattgtttcagtcagtataggccatctgctataacaactcaaagatcactatgacttaacataagaaaagtttgtttcccactcataggaaatttcaaaacaaacatttctggttgtctgggtttcctccaagatgtaatcagggactcaagcttctcccacttagaatcccatcatcttcaatgccggccttcaaggttatcatagaaagggaagagatattggataggtatcctcctctgactagaagtgatacatataaatttttgctcctatcccactgtctagtcacgtggtcctatctagatgcaagaggacaaggaaatgttgtctagatttggggagccacttcccaagagcaaatctacactgtgggaaggaaatgtgaatcttggatagtcaactagtcatctctgttcttagctctaagcttaaaaaactctaggtgcaaagaaaactaatgaaataagacagactgtcaagcattggatttttctgacggcctatgatatgtagtaaaataaaggtaataggcatgtttttcagacataactaattctaatcactgttgctatgaaactcctacagcactgttttattaatagtttcctcttatggagttctgttgttactgtcaccatcgatgtatctgttgatgtgggtgtccttgaaataatgactgactgaccagaaccaccttaatttcaaggtttgatagactcatgggggtaaatattgctattcacaggattgaaaagactgaaagagaaagaaaaacatgattcatttcaactctctgttatggtggtattaaaagaattgaaaaattctgggtatgtgagatgaatgaaaacaggactaccatctaaggttattcaggttgtttgctgcacaactgtgggggcaccattcacattctaagctgtataaattgtgtcctccaggtgttgtgtggctaatatgtagagaatctgaatgaaaattttagcaatggagtaactaggaaaacaatagcattttaatcacaattcgtgagcctgcaactatacatgcacactggaatctagctgataacttgctctttaggttttgctaattcaagttctgatcaacatttcttaaaatagtatgtaagaaagtcttgtttcttaagcagatatttcatgtttctgtagagaagaggcaagaaaaatcaagaggaagagagtttgagagtataatgaaaagtagagaaacaaaaaagaaaagatgaaggggtcaaggagttatgacattttgagaactaaatgagtagatttggagacttctctgaacctccgaacttctgatcacttatctgtaaagtgggaggcttagactaggtgatctccattcttgcatacagtgttcaaagaaacataaaacaccatatgtattttccatctgcagttgattgaatgtgcagatgtggaatctgtggatatggagggctgactgtactacccaattttatataaaagacttgagcattcataaattttgatatccaaggggaatcctggaaccaatcccttctaggtacagaaggccaactgtattatgtgttataagtaatcaagaaactatttgaagtatacaagaggatgtgtgtaggttacatgcaaatacaatggcattttattgcaaggaacttgagcatctgtggattttgttttcttcaggggtcctgggaccagtccctcaagtataccaagggttgactgtacagagaaacctattacagttgttgttttactcaagaaataccatataagacaagaagagtggtttggtggcagaaacatttgtctgagattcagaaaagatagattctaatactggctctcctaccaacttgttgatcatttcacctttctggacctcagtttacccatttataagaagtctcagtttactcacctatataaagtgcatcaagtgatctgtaaggttgtttcaactcttcctagtctctgattctagaattcttaaatggatgtatgtttttgccctaaaaaaacaacaaaaattagcccagaatgtcatcagatctgcacactggaatcatataacatgggaaaagcccaccaaaggccaaagaagaaacataaattatgacagtatgtggtctcttcaagttagtccatcccagttgttactgcttactaaatttatcaaattctttaactctttaggtattattagatttgtacagaaaacagaaacacataccaccctttctgatagggtttttgaattctaaatccataggaagatttcgtgttgccagtggttaatttaattttacctgctttcattgtttaccaggtttcccttggttggctgacagccatcttcaaaaatgtgttctgagcatctcttgggcatattgcactgttgtagtcattatgaattttaaagaaaacaaaaggaaaaagataacatgcctgatctcacatagttcaaaataattccaacaaattcgggaggtaactaattagataattttaaagactaaattgtcaacctggctgcagcactactggggttcctaaatatgtcatgtaaaggaatatatgtcatattcctataaaagaacattaaaaagtattcaagccaggcacagtgggtcacacctgcaatccctgtgctttgggaggctaaggcagatggatcccttgaggccaggagttcaagaccaacttgggcaacatagcaagatctcatctctaccaaaataaataaaattattaaataaatgtttgtaggttgaatgaatgtacctaggaaaatttcatctataacaaaggcagccagtgaacaaacctattggtcagtagtggctcttagtggagaaaaaaatagtgacaacaaaggcttcccttgagaattggaaaccataggcctgccctcttgtggttttggttttgattcctattaaatatgcaatatgaataactctaagatgccatgtaaataaaaatagttccagttggtaacaccttctgggacccagctaaaacaaatggaaattctcttggtaggaaaatgttctcaaccaaggtgcctcaagatacttgcatattaacgtcagtcgaatatgtgatctcagtaaaaagttaccaaatacataagaaagcaagctatgataagcaagactcagcaaaagggagaggagaaaaaaaagagattgatgattgattgattaagactgccaaaaacttagaattatcagatactgaatatgaactacttgatattctcataatctattaatgtttaacaattaccccagaccttcgtggcataaaacaaccatgtattatgctcatggagtctgtgggtcagtgacttaggatataggaagaatgatttgtctctgttccatgttgtctgggtcctcagctagatggcctgaaggctgaagtgacttgacagctgactgctgcaatactctgaagtctcattcattcatatttctggtggttcatgctggctgtgaatgggaccttagttggagttatcaaccacacacccaaatgtggcctctccatgtggccttgacttcttcacagtatgttaattggttcccagggtgtgtgcagagagaaccagatagaagtcatataatcctttctaacctaccttcagagtcatgcagcatcacttccacaatattttactcattaaggagattacatggcctagccaggcttgagggaagggaaaatgtatttcatttcttgatgaggattggcaaggttctgagaaggcatttggagccagagtattgttgcatccattttagagacagtctgttacactatataaaaatactgaaacaaaagatggaaataggggaggaagattatgagacgatagactactcaacttgaaaaaagacccagctacaacttacaaaattaaaaacatgtaattattggaatttaaaattcagtggatggcttaactagcagattaaacatcttctttaaaaatatcaatgtactaaaacagagcttaagaaattacttggaatatactatggagaaataagaaagtaaaaaaatgagaaagggtaattgagacacagaagctagtatgagaaggcctaacataagtacaggtgggggttcaagaacgagagaatagagacaatgggggagacgtatttgaaaacataatggcttagaatattttctagaatgtatgaaagatatgcatactcagattctgggaatactgtgagtctcaaaaataataagggctgggcgtggtggctcacgcctgtaatccaagctctttgggtggccgaggtggatagatcacctgaggtcagcagttcaagaccaacctggccaacatggtaaaaccccatctctactaaaaatataaaaattagacaggcatggtggtgcacgcctgtcatcccagctactcaagaggctgaggcaggagaattgcttgaacctagaaggcggagcttgcagtgagccgagatcatgccactgcactccagcctctgcactggctgacagagtgagtctccttctcaaaaataaataaataaataaacaacaagaactgcatgcatgcctggttataaaaacagcaaataaagagataatcctaaaagcagccagaggaaaatgttccttataaaggaataatatttaaactgatggttgacttctcaacagccaccacagaatcaaggagacagtgaaataatatctttaaaatgctgatagaaaacaaccagcaacttggaattaaagatctgatcaaataatcattaaagcacgagggtaaaataaagacattttcagatattttttaaagtagaacattttcacagatggacattcatttacagaacttctaaaagatatgcctcaggaaaaagaacatttcttctgagaaacaaggtcttaaatataagaaggaatagccagcaaagaaattggcaaacatagtagtcaacccaagcaaacattttctgtatgaaacatataataatgtctaatatgtggggttaatgaaaaacaacacagaataaatatactagacaataatagcagttaagttgggaggggatgaagagaatcaaagtcttataaattccttgtattgttaggatggaaaatatatcaattaacttaggcatagtcaagttttagtaggcatggcaaaatttcaaggaaactactaaaagacatagaattcataacttccaaaccagtaaaacagaactattagaataagaaagaaaaaactcagtccaaaggaaggcaatcaagaaggggaaaatagatatagagaaatctggataagtaggacaaggcagaaataaatccaaatgtcagtaagcacagtaaatgtaaatggaccaaactagccagttaagtgctccacaattcacttcatgaaattactataaccttaatgcaaaagccagaaaatgatagtatgagaaagtaaaattactgagtcagtcttacccgtgaacatagttctaaagtcatggcttggtgagagggatgacaatcatgaaactgaaagggaaacagtgcctgtacttaccatccctgatgtcaaaatgcctgcaaggacactgccttcctttagtttatttcttgggtagagacgacaggaggtctttattgatattatctcatttgagattgtctcttaatattcataacctaaggctgctatacagtgcctgtgttatataacagcacctcttttacaactcaggatgtcacagtattatgagtaatgaggtgcttgtgggagttattgaaggattaactatagacttgtaaccaatccaagaattgcaggagatgaggcaccctcgtaaagaatttatcaaagtaatttgtctatgttgctgtggacagattacattcttattcactctctgaaagtttattgccagtctctgagtagttacaaatgcattattaataatccttagaaaagcaatacattgttgcatggcttaagctttgctcgtgtctagaaatttggaacagttgaacctgacttcatttcactgcctcttaaaacttgatccccctgaaacaaaacctaaagaagtattgtgtttctccctctaaattcagtgaatctacttgtcatttattcagtggtatttgaaagcttaagttggcaaattagactaatattaaaaacttagatatgcctctcttccttccccatctttgagagctgttactgagtaaaggagcaaatgaaaagggatgaaactctctggtagttaagtagtgtatctaaactaagtggagtagatactgcctagttgtaaacttcagccagttgtctgttgagaaagacaggtgcaggggcttttcttttttatttttcatgcaacaacttacttagtgtataacactgagctatccctgtttggaagaagccagaggcccagaaaatttttgctaaaggaggggttgctttatgtatctcctttaaagggagatgggtaggacaggattcagatgctcctgagtcccatagtgaaaataccatttataacctgctgtagactgtatgtttatgatccccccaaattcatatgttgaaacctgaagcccaatgtgatggtatttggaggtggggcctttgggaggtgattaggtcatgagggtggatccctcgtgaatgggattaatgcccttataaaagagaccttaaggagctttctcaccccttcctccgtttgaagacatggtgagaaggtatggtctatgaaccagccagcgggccctcaccagaaactgagtctgctggcaccttgatcttgggcttctcagcttccaaaactatgagaagtaaattgctgttgtttggtattttattatagcagccctaacagactaagatcctcaccatagtttccatcaagctacaagaagggcatgttgtgaaggcaggaaagcataccatgtggtgggcccaggctgaaaggagccagctgcccacaccacctcgcttttgataaagttggatggaggggggtgatggaagtccaaaggaattccttaggtgtttgtgtctcacatccttatctctgaggcagctgctgccagctcatctccctgtccctgcagctcagagggcagagaggtgcattccctagaaccagtcagcattcagagctgtttggcatcaccactgcctcatactgctattcttcatcctcttcagactgtatccactctgactcagtggtcatccccaaaactttgcatgaagcaaaaggaactcttcattcagacagagagagagttggagagggaaccaggtgagcatacctcatggcctgaagaacgttatccaagagaaaaagtttattcttagaattgttatgtaggcaacaattcactgatctctgcctccaagtggcttaaaattcactgacaagatatagaaaagtgaaatgtaagattgagagaatgatttgaaaataattgcttttgttttagtatttgcaggcccatatgcaataatcctttcatttttcccttggtttatccttcagtctcagactgtcctgatgggtagctttttaaatatagggtagcaagtccactaacatttctcccagttaccaaggagaccttattggccttaatacattaccaccactaagtcagaagtcttacataattaagtgttgtcatctgtttcacttcgtactttaataaacctggactgattctttcattttgcttctaatgcttgcttctctagcctgtggtgagatgtcattctttcctttataagaattgtgttttgatgaccgaagaagggtttttggtgttgtgaaattcttctggagttctggaattatctctttcctatgaatgcttgaggaaccactagaggaagccattgagaagtgggcaagaccacaggttctggactagcctccctccttggctcagatgtggagtacctacaaagtgcatgccccactgctttcgcatatttacgtaagaggtaggtggtgttatccccattatacagttgaggaaactgagactcaataaggttaaataatactcagggttaaattggctgcaaataaataattgaattaagattttaattcctggcctctgactgcaagcccggtgttctttcagctatttgatattggcagttaggagaaataatgggttcaaggaaatagaatttttcaataggaggacaagagtacctttgggtcccgatacagggcccagtggccactagtgatgatatcttaccacagaggcaaggaaagtttactaatacctggagtatgggtgtgattcttaaaaacaggacaaaccttggaggaatgggtctctcaggagatcagttctttatttggcccaaagagccaaggaggcagttcctgtgtcagtgcagaataggcggatgcccacagaaggctcttcagagtccagataggtgaaggcgtgtggtaacagagcccaggaaaggatctgcagggcccagagccaagaagagtaagaactggttttataggcacaaagagattagtgaggctcctgccagatgtggaaacaaccgtaccagttcatctgcaccttgagccaggtgttaagcgtctttgcttcagtaaagcattaatattttcttgcttgtaaagctgctcacctgtgactgtttgggtcttcttttcattttttcactaagaatattggatacctactgtgtgccagtcatcattctaggtagctaataagacaaataagatatcttccctcctggagcatatagactagttagggaatctagacaatagtaaaaaaaaaaaaaaaaatttattatcagcatgagatccctactaagcagagaattaatggggttactatgatggcatgtgattagtagctagtttgggtggtcaagaaagcatctcagaatcgatgacattaggttgctttgtgaatgacacctgccaaggtgaatagaaaagaatttgcagatagaagaacagcagaggtaaaggccctgaagtagggacctgcctgagattgttgaggaatagaaagagggccaattgtggtcagagcatagtggtgagagagaaccagtggaatgagatgaggtatgcatgcagttgggcagcaaaagtaagaagtttgggttttatcttaagtgtaatgaggagcccattggaaaattctaaacagataaataacatgatattctttatgtcttgaaaagatacctgactgctttgtggagaattgattgtaggagtttaggagtggaagcagtgtttccagttaggagttgattacatagtcaggcaagaagagatggtgacaaattggactaaggtggtagtcatggatatggggcaatatgagaatcaggaaacatcttggaagtaaagtcaaaaggattcgttcatgaattggatgatatagagtgagagaggcaagttcagtcaacccagagagtcaacagagtaaaagatgtcctaaccagataggttttaggtccaaaattgctcattataaagaaagagataatgagctttttgtgacctcagtgctgatggcaacaacagcatcatatgtagatcctgttgtggttagaacacacggacagtgagaaatcacaaggacaaaaaactagggccatctctggaagtggtacctgtttcattcatttattcattcatcaaatatgtaatatctgctaggcatagataagtgttctgaatataaaaagataaatttctacctcagatgctcacactcttattccttatgggaattttcacaaacagtccaccatgaagtcacacctttggattgagacctctgtggacatcaagttagttgatgtctgcaatcaacaaagcagccctttaatttctggattggttttggtttttctacagcagtaataacttagacccttttaaaaatgcatttctgaaaagaaagcagacatcgtcactcttcctggctgtgcatcagtgattgtgctcctcatactcttacttacctcttctcacctgcccactcctgagacttactggcatatagtagctgaaagtattactgttttcctggaggattgtaaagggtgtctgaaagcactctatttttccctctcacaagatccaaactgcattaatttatcattgaatatttccattttaagaagctgttaattccaataaacgttgatggaggtttgaagcccaaacattttaatgaagccataaatcaagaagccatggtggctttcttcaaatgtcctcacacaaaatgatctgcaggagggaaggttttctatggtattttagcggctgcttcaggcagacagatgcattcccagcttggatgttaatatgttatagttagctcagtgtaaagctggtgtggaaaaccatgagtttgtggttcagttgtcagctacttcatgtcctttctccctcacctgtctcaaattctggcattggtcataaagagccttgaagttgcacatatcagagggcaagtatcattaacatatgtatttgtttccttaggttatccctgcccttcataactacatttgccaatgtactttaccattcaggttatagctcagtttaatattctgcctccactcagcatagtctcatacactcatttttggaattctgcagctattacctttatgtgttgaaatgagtgagtgtcttatctgcctgtggactaaattctcactggtattttttcaaatgtcttaaaatattcacttgcttataatttcatactgaatgcagttttcctgggctcagtggatctgtttcaacatattgtatctattctgtatagtgtcatatattatttaaatgtatttattataaaataggacatgcacaagttttgcagattgccaaggaagttgccctctgggcagattttctatgaactacatcaatctcatgatctcctcctcctccctactttcatttatagagcatcctggtaccagacgttaccatagtgatgtagaaagattgctcaaacaaaaatgggagagacatagcagtgagcttttatcttcactgctttgggttgctgtgcacccaccaactaagatacagcatgtggaaaagcagggagacatatcctagaggctactaactgtcattagagatgagggtgttgtaatacttgtgaattcctgagaagtcagttcattagctagttattaagtccccgctgtgtgccaagccccactaggcgggggatgcacacaagagaagatatggttgctcccttcaaagaacttacagtctagtaattgcacccctttcactcaaaagagttgctttgcagaaatcttgacaattccaaatatgttcccttttctgacaggcgtcttttccaaatctcttgagaatagattcctgaagtatatgattataaatcaaatttttgtcctgaataccttgctaatggagtgaaaatgggaacctgtattgaaatacttaaaacttgtgtatttttggaagctctctgttgctgtagatcataggcaagggtttgtaacactttgtaaaccaattgctatgttcccttgcaaaaatcctgacctattgagaatgccccaggtgaggtagagaccatatgtgttgtaagactccagacaaccttgtgtggtgaactggaaagcttttactttcttagagaaaaataattgaaatactgtagtggtaaattaaagggaaggaactggagtggcaagtgagaaattaggtgaattccattttctgcataagcaagtaggtagcaaagaacatgccatctgaagctaagttattacctgagtgtttgctgcctttaaaagctccatcaattcttctagtatactttgtttgggactgtttgctacgtttctattctatcctgatcacaattaaagtaaaataaaccatttcagtgcttggagaatcccataaatataacaatgaaatttttccccaaatctgtgaacactgtagccttgttccctgacctgttggaaaggtgaaaagaagctcttgagtgataatacttagagattctaataacactaaaaagtcaaatttgttgcttaagtttgaattttaccattcatgtcaaccccaggaaggacagacttctaaacagtgaagtagcccaaaattagcaatggaagagagagaaggacacagataatcccaaaactatgtaatcaaaacttgcaggcagcatttgggcagggtggagaagtcagtctgccatgctgtctttttccagaccacacagctgcggtgagaggacaagggataggagagctactgcaaaaggcacatccagttcagaaataattgtttttttcctttaacttgagcctttttcagagcagttattttgtctgtttatggaatagacattctttcatcctgcaaaggaaataatcattttccagctcagaggtgaattatggagtatcagggaagtagaagtgaaaatttttagatattctactttcaagaagtaaataacagaccaagtgtgatgatgcatacctgtaataccagccctttgggagatcaaggcaggaggatcgcttgaggctaagagttcaagaccagtctgagaaacgtagtaagaacccatctcttaaaaaaacaacaacaaaaatagaaaacttttttttaaaaaattagctgagtgtggtggcacatacctagtcccaactgctcaaactccatgagtttgaggctgcagtgaactataattgtgccactgtatttcggcctaggcaatagagcaagactgagtctcaaaaaaaaaaattcacccgaagaaagctatctatcatgctattttcccagttaataatagattacttcagccatctatgttctcttgtccagattgctcatgagcaggagccacatttgcagctgcacgtctgtggttagaagtttattctattaacttgaaactgtgatattctcagcaagaagccaactaacttgggattgaactaatgtccacagatgtaacaccgttttgtagcaaagatagcatcattcctctgcaagttgtcattatattgtttctgtctgatttggtcacaaattcatcacacacaaaaaaaagtagtgatagtctaagtgcatgcactggcttttggaacagtccatgaagcaagtataaatttgtggagaaaacatgagttcatgaatatgcaaagcacttaccataaaaagaacagggtttgaaggtcattcgtaaaacaagcagtgatgaagttacctaccctataggcttactgaagggaccaaatgaaataatgcaggcatgtcagtcaggaaaacagtgcaggaaacagaaatcactctaggtatttcaagcagaaagggattgcatataaggaattatatgcttccaaaattactgggaaggctaaggcagtagatggtgggaactgtggtgtccaaggacacactccactgtagcagcagtccggaggtcaggaatgactcttgctgggcaccagcactcaccacagtcatctctaaacaccaacaagatggtgaccaagatactgaaatgctgaatacagctgcctcactgctggtcattctgaacactcacattaatcaaagattacatatacccagatggatccgattagcatagatctgctaggaatcatcatagccagacgtaggcaagacaggatcctttggttatgtgttctattaacttacttcctccagacagcttttgttcctgtctctaacattttgtatgtctttgaggtttgatgttctaccttgaagctttgaaatagttcattttaaaatgggtccttgagctcccaacctgttggtaggcagaacacatactttgggttgaatgtgatcactgtagcctgcagtacagtgcagcactttcggcactagcacttgcagataaaatataactatcctcctatcatttgctgaggctgcagtgcagtgattctgaacccaatgtgtgggagcctttgcgaaccaatgtgctcacatttaatccacacctctaacctttccatctcaacctgccatccttgacaagcagagctgcagtgagagaaaatcccaagtttggacttccaagtaaggagatggaatgaagaggtgtctgctgttgggcttttgcggaaagcctgaatgagatcattgaaaataaatggaatatgcatgctttttcccctccagattccatagttctcctatatcaaggcagataacagggaagctatatactttattatttggctctttgtagaaataccttcaccaacctaaaatttaacattatgcttttgactttttcttgaaaatggctgtatgtgaaacattcctatacttttttgtttttaaaaagtttaccaaagataccattcattgtgttgtccggtgcctcttatatcaagacctgtaagataaattcctcttataattcaatactaggacaaaggttgtctttactgacaaacttatatgctactccttgcaaatattgataatagtgtaatatattcagatctctttttgccttgactccaagaaagctcttaaaaaattagttcacttgcagtagtttccttagcctagattttctggataatattcttcctccacccagccttatcatcacttgtgggggttgctgttaggttttttttgttgctgttgtttgtttgttttactaattgtattcttataaaccacctatctcccttggggcatagattagatatcaaattcatgaatatcaatattggtatgaaaagtcacctatagaattcaaatatgcatgtctggagcttaccacaggactagtgacttagaatctttgggatcaggactgagataagaatataggaagtactcacataacattgtccataggtttttggcaactgtgactttaagcaaaaccacatacagtaggtcctcacatgacacattcagtgttgtttcgtcatagtgtagaagagaaaataaaattggttttgttgtaagttgttttgcttgaagtctcagcttcgaagaacctgtggatgacattaaatgaaggtttactgtatagtttttaaatctccacaggtaattctgatatgttctcctgattaagtgcactaaagtcagtcagtcagtgagtggtgtgagcaagaaccggaaattaaacagtcaatggattgcatattggctgacccatgtgacatggctggtcaggcgagtagtgacagttgtttaaagaatgcccaaggtggccgggcgtggtggctcatgcctgtaatcccagcactttgggaggctgaggcgggtggatcacaaggtcaggagatcgagaccatcctggctaacacagtgaaaccctgtctctactaaaaatccaaaaaaaaaaaaaaaaagccgggcgtggtggcaggtgcctgtagacccagctactcgggaggctgaggcaggagaatggcgtgaacccaggaggcggagtttgcagtgaagtcgagatcgcgccactgcactccagcctgggcaacagagcaagactccacctcaaaaaaaaaaaaaaaagaactcccaaggtaaagggatatagttgctgtagagccaccattctagtgcaattgactcgttcatttatttattccaacatgtagtgagtgcctactatgtaccaggtactctggcactgaggataccaaaatgatatagtcctctgcctctaaggagctcacagagtctagtaggactgtcagacatatagataataactacacattatagcaaatacaagaatggagacatgcccagggcatcatggcagcccagcggagaggcgtctgctcaaatcttgcaagaaaacgtcaattaaggcttcctggagaaagcagctagagagtggatctcaaaggatgaacaggagttatcctagatgaaagatatcccaagaagaagggccagcactatgtgggaaactatatactgtgaataggagaagtcaactattgctgcataacaaattaccccaaaacttagtggtttaaaacaataaaaaattattacctcacaatttccatagatcagaaattcaggagtggcttaactggagattctaatgaaatgtctctcatatgattatggttgtggtcaaggggtcagcaggagctacagttatctgaaggcttgactggggctagaggatctgcttctaaaatcttttactcatgttgcaatggacaggagccctcctcagttctttaccatgtgtgtctcttgatagacctactcacatgtccttgtgacatgacagctgtcttctcccagagtgaatgattgaagagagggcaaggtgaacaccaaaatatcttttatgtaataaccttggaagtcacacagaatcctagaggttacacagatcagccctattcagcatgggaggggactacacaaaggcacgaaacagggatcattgagtagatcttgaagctggctaccacacaaggccatcaagcttatgatctggaatggcagaagctggctaggtacagagccccatcctgaaggagcccaaagaccatcaataaggagctgagacttcatgtgtgggcatcacgaagccattgcagaggcagtaagaagagaattgatgatgtcagatttacattttagaaaggcttcttggacagtatggagaaaggtccttggaacagaagggccagttagttgtcacagaaatccagcaagatcatgtgggcccatatcagggcagttgtggcatagaaatatagtcctttattgttcaaaatgtggtacatggacaagcagctttgacattacctgggagattgtagaaatgcagactcccaggcatcaggttagacataatagaatctgattcatgtggacctaaaagtttgagaagtgctattatagaggatgttgtagaaataattaggaacacagaggagaggagaccgactctgaagtcatgtttattctacttcaaaactagaatgcatattgtaaatttttactgaaatctacagaatagatccagagagctttgggcattcacagcatcagtaatgatatggtatgatctaataacagaagggctttctctgttattataaatggtaaccatgtaaataaatgttgccagcagaggaaacctactgaatacttctctgctctaaactttacatcattttccaaccagcttatttcttttgtctcagagtctgaagaacaagatagctaaattttcagaaaaggggccatggggaatggaataatgtgataaacagagatttggaaagctacaagataatgcacattctggaaaatatcctgatttccagatgacctttccaagcattgtcttttctgggattagatgtgggagccaattaactactgggcttcacacagtaaatgtctgccaggaaattcattacttgcatatggtcaacaggaaccaccatccagtagtttttttttaacttgttaagcacaagtgcatcttgtgatgttctcctggtctgccggctggcaagtgccatctgccaacattggccatgtgtcaatctttgtttttccccctccattcttccacctacctctttacagttaagaaaattatataaatcaattaatgctggatctcagaactcagatgaatatgctgctagttctgcaaagagaaatagagaaagagggggagggagggaggcagcaagaaacagatctaccttttaaaaactgataaatgagcattgaaacaatgagaatactccatcaatacaattgatggaggagggagagtttcctcttgcagcatgttcaaatgctttggtggctaatgatttcagacctcccagagccttagtcccattcttctccaggcatgaaccgttgtccctactactaatcaggaggtactttatgtaaactcatcaaggagcactggggtcactggctccaggagctgctagagattaaatggcttcattggcatatgtccagatagaggaaaagtgaaagggaaactggtaccttttccttggcccttctgtctgactccctcctgtgttccaacccctgatagtttggtttccaatgagttattgctcatttattgagtcagtttttaattggactctcacatgatatgaagttttcattgctatttagagtggttagacatgtttctgactagtaaatctgagactgccagtaattacagagccttagggagaagagctcaaagctgcttgtcacctataaacacctcctcctctggggttcccaaggaatatgtagggaagtttgcaattgtaccaccccatcctgaacttcaaggactttcatgtcaatactcccacaccaaaccttgagtgagtattaaaaataagatctacttcctcctcctggagtgagctagtgttgggggaagggatgctaattaagaatattcccaaatcttgtgaaagataaacctctttttcctatttttgattatctcagcttaataggcatcatatccccatttctcagaggtttgccttagaaaacattctctgagattccagaaaataagatattagagattttgcagttctcccctcccccaatcaaagtcctcctttccttactcggctctatttcatcccacaatactggtcaccttctaaactacagtataggttattattatctttaccctctgcctcccaccactagaatgcaagctgaggacaagtattttagtcttttgtgtttgctgctgtatttccagcacctagaaagtacctggcacatagtaggcactcgataaatgttatttgaataaatttaagattctaaaggaccttgaaacctgtttagtatctttatttggagataaaccaattaaaaccctgagagtttgtgacgttccctaggttgcatagctgatctgcagaggcaagtctaaaaggtgaatccagatctttctcctaaccctgtgtccttcctaccacctgctgctgcttttggctgctggatggagctgggaagaagactggaggctactggtcctaatccatagaagggattttctgagtcctgcccagaagtaggcaggtatcatgagcatcttctgccctcaagaggatcttggcagtcaaatatggctgcagcctggctccattccttggtcataatctccaacttctgctgccaggattttctccctgttttttttataagactgcctgttcgaagaatgtacacacacacacacacacacacacactcacacactcacacacacacacacccctacccctccaggctcactaaagcaacatacagctctgtcaggaaaaggatcataatctcagccctcactcactctggtgcagcttgggcagagggattgctaatgaaattattgaagttccaaagcccccaagccatcctcttgacacaaccactgttttggcactaccttctgttattctttggtttttgctactcctagttacctcaaatgaacacgctaccctgctttcaatccacaaactctaccccaacatctggccaatcttgccatgcccttcccccaacaccatgccctcctcaccatccccaaggggccaaaatggacaattgtagagaccaggcaagactcagctcactggttgagagaggaggtcaagagttctgctgtagaacggaaagagttgggaaacaggaggaggaccagagaataggcagtgcttgaaaaccctgtggaggcaaattgtctgcggagttggaaacaaccacaacacatttgtccttagaaaaatattaattttttaaccttttcaatactatgttcaaaacctctctcacaaggtccacaaactttcctactacaaggctgtcatttttgactaggaaaatttgaattcagtatttcaaaagtgatttcttggaaataatttcttatgtggtgtcaagtctctggagaaaaatgcagaaggtctttctgcccattagatgctgttcacgagagagaaatagcaggaattaacagtatggtggcttcacacgattgcccagatagtgtgtgagttcaggaagtgtcttgtttgcagggagagagtgattaacacaacagacgctgctctgactctcctataggagtcagaggagacaaagcttggagcctacatttacaaactgtcatgagccagccccacctagaagcacgctaagcttgttttagtcatctcatttctctctagcccatgggccaaccttattcctgcttttttgcatttatctgggtctctactatgtttcagcctctgtgctgggcttgtatcaacaaggcaaagagaaattttacatgatctctgtgttcaaagacctcatgtacttgatacagaggtaaatagattagcaaataacagctattgacaaaattaatgaatcaataaaaatgcatttaaattatgttttgagcgcttaactctgctgtaggagctaaaggaggcctcttagaggagttaacagctgagctttgtgcctcacagtttccttaaggctgtgcagattcttggattctcgtcaataaggccaaataggatattccctcccataagactttttctcttaggcatctcatttgtgtcatctaacacttagggtaatggggcggaggggtatgtggagtatcttgctctgactcagccttataagaacaccatacacgtacgtgtgtgtgtgtgtgtgtgtgtgtgtgtgtgtgtgtgtgtttcctaaaggaggacttattttaatatctgagaatagacttctaggaacttccttgatgtacagaaatctcatagaccctatggtcattactgcaaagaatcatcccattttagagctggcatttaccttctaaatcaactcatcctttttacagttgatggaggttaaagccagggatgctaaaggactgcccaaagtcacgcagctaaccacgggcagagccaagtctaggaccaaggcctcagttctatgcaatttttatggtaccttgcaggtccccccaaggggcacacatctgtcagcatagtgggatgactaggagcaagcattacactaggggcaggggttaggagtgatgtatgagatactactgaatcatagagctggaagggccactagaggtcatctcgcttacctcctgcatttttctgatgaagaaagagaagatggggaaagtgaacctgatcttctcagccaggggaggtattgccctctaagagggatatggaaatgtatgggaccatttttggctgtcacaatgactgggaaatgatattggcacttaatgggcagatgccagggatgcttaacatatattgagtggaacagttctaccaatgacaaatcacccagccccagatgtcaacagcgtccgcattgataaccatgaaaagagcccccattacagacagagaagggaccaggctctgaggtggtttgcccagtagtttgtcattgtgtgtacatttaggggtgggtcacaaacccctctgagaatcaaataaaaacttccttttcatagaaacctacacatacacaagaactttgcccttaattttagtgggttaatgagcccctttaacccatcaatgaaccacaggtaaataaccctagtcttaaaagagacttaaaggtggagaaaattaaatatgtatgtgttttcttatggataaaaattgtcttatgatgtgtccaatggaatgaagagtaaatgtgggttttttccctaccaagtgaacacagtggtatccagactcttagattctttcttttgttcattcatcagaagccttggatttttatccatcacttaagaagtatagctattatttcctattgatagtcaaactaaacaccacgtctacctcccacaccttccttccctttctctccccacagtaagtactcagcaggactgacgtaggaagcaggagtgggtgctgacttcaaagggtccctctccctgaactttggagagtcccttcttcaggagtgtgagttctgggtgagtggtggaagaactgcaggctttaaatgctagtcaaggtgtaaatcagatactgtgttttaaaatgtgctgagtaatttctgactcattaaatcagttaaattacaaaatgctccatttcaagatgctctatttcatccatttgcaacaagtcatggcaaacggaagaaatagattagccaatcatgcctccatggtgttgttgaagagaatagaggagaggagagatggacgactcactaccactctgtgagagaagacttagggtcaggcgtaacagtcagaccaagcagtcttataggatagatattcttcaagggttttacatctcatttactcctgacagcaatccttcggggcttattttcttgtctattttactaatgaagaaactgtggctgagagaggttaagtactttttcagttgagtcaaaattcacacccagtcctatgtgactcctaggccaagttcttttcaccccaatgcttcccagcgagtttgtatgaacacaggtaatgctgctctcaaacagctaaaattatctgcacagcggatgcatgccccactgccttcccatctacaagatccatctcagattgttcttggttattccagtatgctgaggacaagccttctgactttggtttcattttgttttgtttttcataaactgtgcttctgtcgaggctgtagagaatcctgttaggacagtatgtcgtgatttaaactgtggctgatgagtgactcccttctttccttctcttgcctcaaacctttcctttctcttatgatgggagagaccaagtgtacttctgcatgcacagtgcctggaggtcttcccaagcctggcttggaggtatcaaaaaggaatctgtacctaactttcacagaatggtttccacttagctgggggctttgttttgtcccccaaagtagctggtgactttgttttgtcccccaaagtgtttcattctttttcccttgtagatttgtttctctgtgaatttatctaaagacagtggtgtgctgttgggcaagaagtcctttcctactgcctcctgtaggagagctgtagttactgctgaacaaatgacaacctgcccactgcaataataacaaccatttccctgggtgacaagtatctaattaagtgaatgccttgggtcaaggggtcatatttctgcaggcagtggacctttgtaccatttgccagtcagggggttagacacattccctaccctccctgctgggtgtgagtttctacacctgagccattgccagcagagctgatgaaggaacttacctcagagtctctaaatgaagtccactgctcttagatctgctaagaaatatctcaaaaccattggttccaagttgattgattgattttcctatttccatcagcaaaaaccataaatactcaattaaactctaaaagtggtcttagaattccaacaccaagtatagaggacttaattattttaatgggggaggggaaagagcgctagatcaggagtcagaagactaaaggtttagctctgactctacaactaactgcccacatgaccccagtaactttcttatctagtttccccaattgaaaatgggagttttttccttagatactctttaaaagcagtactgtccactagaaatataataggaatcacatatgtaattcttaattttctgaattttagcaacattaaaaataaaaagcaagtaaaattgattttaataatatattttatttaaccagtatatgcaaaatattattttaacatgtaattggatttttcacatacattttccatattaagtttttgaaattcaatgtgtattttacacttacattgcatttaagttcagactagacacatttcaaaggttcagtttggccacatgtggctgatggctactgtattggataatgcagcctggactcttttctggctattaatttttttgtgtatgtcccaatccgttacttgcaactcttgaggttagatggataatttagaattttttatgttttaaaatgaaatacagtatttattatttattaataccccagggggatctggagcagcactccatgatcaaacaaataaatatttctgtagcaaaaagtatgacaatacacactgagataaagaaagacaataaatagctttatataggttgggtattgctgccaagtgagtaacaggaaaaaaaaactttcatttttcagaggatttgccttttgaaattgcagataaaggattgtgagtctgtatcacaaaaactgttcagtattaggttcagtatttgcttagttgctttatttgtcaaaaattggcctagcattactatgacagtgcagttgtcctttgactagccatggacgtggcattctggttaaatcatctcccttgttttgactcttagtagtggtaattgtctccagcaagctgaaagggtgacccgtggagccatggagacttaggattgctagattaaatataggatgcccaggtaaatttgaaattaagataaatagcaaacacattttaagtgtaaacatgtcccatacaatatttgaatttcatataaaattcaaattttactgggtgtcctgcattttgttttaactctggcacctctaccatgttaaaagccatttcagcaagtggttactgattcttgtggggccagccaagggagtgtaagggaagactttctcatcttgtatcacgtttgctcagaaagaccatataaagcaggctggatggttaaggagaatggaaatctggttgttttgattctagaatccaaaaaattaggaatgacaaagaattcagctacaggtatggcatttgcaatcctgatgtgggccttgatcatggcagaaggctaatctaacaggtgttcttaattgactgtcttaaagcccttaagaatcttgtcaggtcatagccacataccaattatgtagcccctgatttgggggtttcttaatctctatcaaggattccagaaagaaaaccgaagagagtaaactaggaactatctctatttttttaaatatggggtgggaagtggtgggcgtttgttgagagcataactctttctctaaatgcctcagaaattaagaggtgccaagaggaagtgctgctttaagaaccatctggctcacccaggtgcagggctggggaggctcagagcctgcatcaaaagtggcttcggcttctgtaaacagcgtcattcccagcattccttgccaagatggggctttatgtgtcccagagagagtcagcagaagcaggtggcaaatttgacagactatggagaggatgacatgatatctgttcattcagtggggtacactcagggtccctcaaactttagtgccaccctttctaatgacgtgtgaggtgctggatcaagagcagtgacctgactgaaactgtttcagatcaaaggagactaaaaggacatgacaagcaaatgcagtatgtgttcttagatcgaactctggaccagaaaaaaaaaaagttcctataaaggacattattgagacaattggtaaaatttgaatataggtcatttattagacagtagttttgtaattgttaaagtttctgatcataattgtaccgtggttatgtaagagaatgcctttgttcctagtttttaagggtaaaagatttctttatagtttcaaatggctcagaaaaaaaaatacagtcatgcatatccactttaaaatgtggcaaaaagttacgtattagtaaatctctgtaaagagtacaaaagtttattatactattcttgtaacttttctataaactgtttaaataaaagataaaagaataacagcatgacaccatccaaagatagatgttccaaagggatagccatgggagaggtgaggatccctgactccctgaatcaggagctgcccaaattagaacttcactgactttcagtttcaggatttggtgtagtggtaagagcccaggcaccagactcagtcagccctggcattccgccgggcaccgcattgttctatttaaccttgctgagccttagtttcctaatctgtaaaatggggcactgtaacttacctcacagcctttctgctgagattggaggtgatgtttgcaaggcaccttgctgagtgccatgcaacagatatttccccaaaattaaatatgtctttgtttccatagaaagaccatgacttgatggctccagagtcttgtattttcatcaggtgcaaggagcagcaatctgtcaccaaatctgtggaccagagactcaggctctgccccatttgaaacattcttattgcaaaccccagtggaaagcctattcagctggcaacttcaagcagtatttccaagcatgattcatttcctagtggcataatcactttgaacaaaactacggcaagccttttcaagaatgcttttgaaaatcttttcttccacagctgccacacggcatgagaagcaaggtcaggttataggcttaaaagttttgaaaaggatggaattaactctggactttaaccttcagacaaatgacctcacaagacatgggaagtaaaagtaaagagaaaaaaatgtctggagctgtgagtgaatagcaatgatgctgaactagaaatcaaaagacttgaattagaatgctggctctgccacttagtagctggtgattttaaagcagtccattccaagcctattgctttatttgtaaaatggggacactggtgttccatatagttggtggattaatcaagtgagataaagtacagtgctgcattgcttcacaacaggatatgttctgagaaatgtgtgtaggtgatttcatcatgctaacaccattatgtgaacattgtagagtgtatttacacagacctaaatggtacagtatactacacacctacgctctatggaatagcctattgctcctaggctacaaacctgtacggcatgttactgtactgaatactataggcaattataacacaatggtaaatatttgtatgtctaaacatatctaaacatagaaaaggtacgatgaaaatccaatattataatcttatgttaccaccatcatatatcagtccttcactgaccaaaatgtccttatgtggcacgtgactatacatggagacaattggtaaactgtaaggggctatgtaatgtacagcctagctacccagtgtagttcagcattgacatcaccagggataaaacgaataatgcagactctcaggccccacccagacctaatgaattagaatttacattttaacaacatgtaaattgtccggagcattcatgaaaagtttgaggacatacatgaaagtttgaggagctctgaggtaaaacaccacccttgagttgattcttgaggtggcgcctttaaagaggcctaagggggcttacttaaaaccaggcccttcaaggcctagtgttttgcctattcagactatcgagtgtatcttgtgagggttgggcaaaccagcctagtctgtagtggatgttaaaacaccctgtgtcaaagtaagcacttgcacttagacacaacttctgcctcagcacaggtctacgtgcatggacgaaatcctctgttctacctccccatcatcactgtggtgtacgacaatcagctatgagttttgagacacctgttactcccaagtcctgctttctgtctgggtctggagaccaccatgtctatcatgagaccatcctagttttgatgagaaaggaatgtaaagacataacccaaggtcacttgcaagtaagaattaggacagcctgtccggtctccctttgctgccggaagtggcagatagtaatgaccctaaatgaccctgctcacccttgggtaggttaaaggaaaatattctggggcctctcgtaactccacagtttcttgaatttgctctacttcgggccatcccttggttggctaaggcagacccctcaaaggcaggaattgaggggactttatcttcattcccagcagccatgtaccacactcagtgcctggacatggtagatggctgcctaatgaatgaatctgatgaagactccagcacagcactttatagatattaggtgctcagtaaatgcctgttgtttgattaactaggtcagggtaactttcctgttaagcacttacaggcacaaagcccagaatagaatctatgagcttgtcagggcctatgaaaatgtttcagacctgaacattaacaacagaatgactccaggatacaaaaaggaaactgcaaagtagatactaaaatgtgtaattagctggatgtaaaatataatattatgccaactagtcaagtgcaagttgccccttaagagttctgtgtagattatattaaattttgagatgtgggcacattttaatatgttaaatgtggcatgaaggaagccccaaaagttagtgtctagagcttaagaaggatttaaaagatccccagtcagaggagtcaggtgaggtggtgtttcttctcccctgctgaggagtctgaagcagggcagacgagatgctgcctatctgagatagactccaagacagagggaaagaaacagtgcagcaaaaatcaggaaagtcaacatgtaggaaaaattacacggttttcaccctgtccccagatgattttccccaatatatattttgtatggttttgtgtaaagagaaaattttctgcttcttgtcttactaccctagcattgattaatggcatgctctatatcctgtgcatttctatttatttccttaatcacaggcggtagatgttggggtgggctgagtgtagggggaaagtgaaaatcaaatgttcatcagtttttcccattttcccattcccttcaagaaaatttttattctaaattttcattactcatgtagataatgtacagaactaagtaggaaacgtaatccatttgctctgtgaggcccgatttaattaacattcctgtggacacaaataaagggatctatatcagttagcttttcctacataacaatgcccccaaaaacttagtggcttaaaacaaccatcatttatttggcttacagttctacaagccagcaacctggaccagattcagcaaggtagtccttctggttttgactaggttcactcatgcctctgtgctcagctgccaagtgaattgcagggatggctggtctcagatgacctcatttgagactacttaactttatccacatggtttcacatggtacagcaggctagctcaaacttattcacgtggaggctgaacaggtgtcccagagaataaagatggaaatatatgagacttcttgaggtccaaccttaaagctttcacactgtcacttctaccatattctgttgaccaaagcaagtcacaaggcaagcctatattcaaggaatgggaaaataaacttcacctcttgatgggaaagaatttcagagtcacattgtaaggggcataaatactatgaagggaagaactgcagtcctttttgcagtctaccagagtcaaacacaacgaaggaaatacagtcttgaatgaaatgagtaaataatgtttaaactgcagggcaaaaaaagagaggatgggaatcagagggttcccatgtttaaatatagtcagatcaaagcgggaaaatgagagccagggcctggtcattctgttggagtttctaaatttggttttgatgggaaaataaataaccactttagaaaaaatagggtgtgcacacacaggtgtgtgtatgtggtttcaccaaaaaaccaggcttcaagagtatgcagagttataacgtcagataaaagttaacctttgtggtagacaccatacacagctaagtacaattatagctgttaagcatctttttctttgcattgtaaccaaggacagcgtagtttagtttaaacaaaaactgttacgtcacgtggctaaaaaagtgatgagcagaggtggtactttgaggcagaagtacaacggcagctggcacactgggtggtgataatgaggcatgctacagtgagcagcggagggctggttcagggtagcatttctcctggtcttgcctctgctgctaagcagctctgtgacattgcccaagtcactttccctctctgggctttggttaccttctctactgcgtaagagggtgggtttgatcatccctatgactccttctactagtaagactaaatcggttgaatatcccagcacatgatggcttatcccaaaagatagacaaggacaggctgggcttggtggctcaagcctgtaatcccagcactttgggaggccaaggtgggcggatcatgaggtcaggagatcgagaccatcctggctaacacggtgaaactccgtctctactaaaaatacaaaaaattagctgggcatggtggcaggcacctgtagtcccagctactcgggaggctgaggcaggagaatggtgtgaacctgggaggcggagcttgcagtgagccgagatcacaccactgtactccagcctgggcgacagagcgagactccgtctcaaaaaaaaataaataaaataaaataagacaaagacaaaagagtatttttagaaaaattttgattttgactccagctgagttttcttggccacaggcctttctgccaaacgtacttttgctgcttttctttgaggtaagagagtaattaaggaaataagaatcaaaagggactctaaaacggctttacaaggctctccttcccaggttttcctagttgtatttaaagctacatggagctccctgctggattccagagatacaggatcacagtctcatttacattcttctcccaccacaacatatccatgtttctttacacagtcatcttgtttcttacatctttgcgtaaactcttcatctctggtgggcttagaacactttcttcagcttgtcattttaattcatggatgtttaattcaagttttcaggtggtacccaagaagaatcccctgtacctggcaccagttgaaaacacgccattgttttgctattgtgcttctccatttgcccatcataattttatttctccttctgttttttgtaaagttaaaaatgtatttactccctgtctccatgcctctttatgaaaggtgaagtacattgcagcattgtttgtaataatgaaaagtggggcataatgccccgtaaatgctcataaagaaagaaattatttgattttaaaaaaaaagtaccactatttaagggactactaaggagcagttaaaaagagcaaggttcattggtattaacatggaacgttttccaaaacatatggataaatgaaaaccaatgcatggtgttacttgtgtgaaggcttatcttagtgtagacacgtatgtgtgtaaacaagaaaactcaggaaggtcacacaaataggtagcaacagtttactctgggcagcagagtagatgaggggtagcaagagtggtgagaatttttgtcttatctgcattacttagattttaaatgttaaaaatataattatttatgccatttaaaaatatttttaaataggatttttgtaaagagtgaggtggcggtggtttatatctacctctggatttaagcaaataaaagggagagaaaaaatttcttccccagattaataacccagcatcctatgcatggaggtgtggtaatctttctgattatctaccagtgtgagggaaaataatgcaacgaagatttcaggaaataaccatgtattccatcctggacaagaaccatctgaaaacctctgcatttcaggtcttaattaccctgtcatttcagttttattctcagagctaattctgagaagtgacagattttctcatatgctgtgcaatttaattacaattaactccttacaatttaattacaggaaagtgctattttttcagaatctgagcaaccagaaagttagcagttttcctctatagtctgctttttgaaagtgagacaaataagagactgaatcagggaactcttccaaaaacacctttcaagcctctgtcatagggtcagtccagatgaagcttaatttcttacaccttcagcaattatagtactgtgtgctgataactgatgtttctaacaatggcagtgagatagcgcatgcgaactttgaaatttcaaagaaagataaaattgtagttggtgtctggtgttgctgtctgtgtttttgaaaattataattcatatgccacgtatttagtgtctctcagatactcagaaaactcagcaatagcatttctgaaccaagagatgtaagaggcaagacttgtgcagaatgtttccaggtagcaaacgtggacaagccacattttaagcactcagtcgtcacatgtgcctagtggctaccatactggaaagcacagttctaaagcattctgacaggaagtcttcttgaccactgggctattagagattgcatggtgcttcagggtcagaggagggtgtagcttgccctgcagccagctatgtctttctcatccttctgtttgggctcctctatttagtcaccagctccaagacagcaggaagaggcagcatatatccccctgcagggcatgtcatgttccagccatttctattgctcagctcttgacactaccttcagtctctgtcagagaggtggaatcatgctggattctgcagggttagccctttcctccaccttcacaccctctgttgaaagtctcatacttcccagagtcctaagtaatttatacatagaaagggccgtttgttcaaggggctagcagtgcttaggcctcccacctgggggcctacctctctcaggcaaactagtttctaagcaccaacaacagattctccttgttccttcagtctgtcttcaaatggccaccttcactacacaatggctgacattcctaccttgtcctctttgcataggataggagcctgaaaggtcacagccagcacatccctggaaatgatgaatcccagctcccatggctgctgtgactaagaactgtttggtgatcagccagctgttttgagtttacctcttccaaaaaacggctttcttctcttctttgcatattatttttctgaattgctgcctctgttgttcaaaccatcccggattaatgacaaaacactatcttattcaaaccaagaattatctacaaccctccttctcaactagtttttgcaagatcatttcagtttttctttttgtgctacatcctggattaattcttcagttttgtcttctcttgaatcactacctaaggcttattccatgtttcaagttttttgttttttgtttttttttactttgatgagtatgtttaccaacgctttcttatttatttgttcttgcctcattttggcattctttgttttataatttcttttttcaagtggaagatatttcttcatttatcttttgagcatcataaatttgttttaaaatccttgctgaattgttttgtaaaatatatttcatctacagtgctgtgcaataaaataaattatatctgcactgtccaatatggtggctattgagcccttgaatttcatttgattttaattaatttttatttaaatgtaaatcatccataaggctagtggctaccatattaaataacacagacgcagaataaattttaaaagcaatcgctgattttgttagtattaggtttcctcttgtgttttagaattttgattttcaagctcattttaagtggaagataatttattttttctgtggctgggggaagcggagttgggaaggaagtccacccttcctatttagtggttttcagtattctccactgggacagcagtctagaattatgtctttaaatggtgttttgaagctcttgcctcagagagacgttgttaatattgaagcacgcacaggcagcttggttcagtttctgatcagaccgtgtctttgttcttcttttgtagacctaccacttgctaaaagctatagcccctagcagtagcaagcaatggcacatttttttactctactttttcaagcaaaagagccctatcttagccccaaacatgaggccatgagcctaatcccgatcccctagtttttatgagtcactttagtccctttttcctgcaagagctagaccaccatcactgcctgcctgcctccagactgggcgcccagctgcttcagcccccatcactgctttgcctttctgttcgttctggcccttggatatgtttatcttgttttgcagtccagtcatatctttttagttttctatttttgtattataactggcattgctatgtgtttgaggtggagggggcacctcatgacatgaacttacgaagctatcttgacccaatggtgtcccctccaataatatttccagttatagcacacacatgaagactttcacaactacctcatcattccctaagcatttggtcacttgtgtgacagaacacaataggttttccgtaaatgtgcgttgaattaataaatgaaatatcaaacatcaagacaaacattacctccagagtggaaccccataaattttcaataaactccttctatagtatctcaatgggatgatgtaaagtgataaaactctcttcttctgagccacacaaacctgtagaaatagaacaaacacataattgggagaagcagcaaagaatctgtggtcatctctaatttaccacacccagcttttatttatttattttttttttagaaacaaggtctcactctgctgctcaggctggtgtagagtggtgtcttcatagctcactgtaaccttgaactcctgggcccaagggaccctcccacctcagcctcccaagtagccaggactacaggcacatgccatcacactcagctaattaaaaatttttttttgtagagatgggactctcactatgttgcctaggcaggcctcaaactcctaggctcaagcaatcttcccgccttggcctcccagattgctggtattacagctatgagccactgcaccaggcccatactcagcttttcaacaattctgaaaattctcaaatgtgatttacatgttcctacctctatgaaccttgggctacatagtataatagcaaggggaacaaaacagtagtgaaatatctgggccgttggccactaaatggtcctgagcacacctgtatatccactgaacactgacatagatcctatctctagatccccactgccttagtaactaaaaaaacttctcttatcaggaaagcagaaaacagaccaatatgagttggattggtttgatttttttaggtagtctctttctgctatctgcttctctaaccctattttcttagatttgcaactagtttatacccacatttgagtattctctatttttccgcttccaacagttgaatcccgtgctcttctttgctgtaaaaacaggcagggagcttggacaagtaggaggctcaggtccctcaaagacctgccttggtgctactagaattgaggctgtggctggctggcaagatggtttttggtattcttaataactcacctgctccagacatttttatatagtgaggtttagggctaatgagcagatcacttataaagaatatggattaaaattcttcccaaaccttacttataaaaccttttaaaaaaaggatcaaggttgagtatatctatgggtatgagtgacctcagttaatgattctattaacccagtaaaaactgggtttaaacaaagcaccatggattagtcaagtatctaatgcagtatatcatgcgtatctactccctgaacaagctactgacaaatgtgattttattgaatcccaaccctctcttctgtaggttgtcctggaggttaatagagttacttctagccagttcattctgtttgccaaaaaatgtttttgcttgctcctttgtatgggattgtcagttgtctctgggaggtgctagatagaaattacaatataatgatggtagatgataaaatgaacactgagagaagatatgttgataagatttcaaaacatcttctaagatatacttatcacctaaaacaaatagatgtttgctatagatggtttaattttaaaatttgctcttaaactaaataaaaccaaaaaagtttttagttagggcctcttttagattggttaccaaacactctcaaaataaaaatatatagatcaataatttgtttaactttgttgaacacagataatcacttaggttcaagagcaagcaaattcagaagcactgaatggagaattttgctgctgtagcataaaaatcaaagatatactttatgttcccaacgtcatcccttgctcactgggagccttaggctgggttcagcatgatggacctggagatcccaaaagagggacaatttcagttgcattttaatcaagccccaggatagaagggagaattatgtgaaattgttaataaaaaagagcatttgtttcttgcccgcatggtcatttatacacctcatgcctgaacaactagataaattagtagctccaccttcctcacaatcaaatgtgtatgcaggacagtttcaggaaagttcaacctcctgccctaaactgatttttcctaatacttctgaatttgtgctataacagataagcagcattctgatgcagttaattaagtaaaacctcactgcatccaaagcagcaggagttaagatagatggatgtggccttaagctttccctcacccaaagaatatttctacccagaacaaagaaatcagaccaagcttgatgtgacttggttgtttatatgtattctttaaatcggatgcctttagaacataatgtgttctccatgggggggtgaatagaagttccttgtggagagaatgtttgctcaaatacgctagtggtacgtgcatttgcagcagtcctgttccctgtgatcatgggtgtacctttatgttgtggaaaatcacatgaaacactccacctcctacctgtctgatgatgcttccctgcagaggaggcattgagtgtttatatataatacctaacactttaggatgctcagcactgtgcttaatgctttatgtatattaattcattaagaggtatttttacatataataatttgggggttttttgagatggaatcttgctctgtcatccaggctggagtgcagtggtgcaatctcagctctctgtcctccatctcctgtttaagcaattttcctgtctcagcctcccaactagctgggactacgggtgtgtgccaccacacctggctaatttttgtgtttttagtagagatggggtttcaccatgttggccaggctggtctcaaactcctgacctcaagtgatctgcttgcctcggcctcccaaagtgctgggattacagccatgaggcaccatgtgagtccccatatagtaatagtaatttttacatattttaaatatagaaatatttccagatgagatctggaatttatgtcctaactatggggagtggagcatagaagtatgtttggaacagggttggccatgatttaatggttcttggggcttggggatgggatttgggggtccatcattttatcctgcacacttttatgtacgtttgaaatttctccataataaaaagaataaccaaaactttgaggtagatattattcttgtcactttcttatagatgggaaaatttgcccaagttcacacaatttcagagaatctgcattcagccactgtactcaaggttatgaaacagcaccaaagtgccctagggtactacagtgaactgactgtggatggaagcacagcagtactcgacatcagtcagacaccacgtgaactaccatactagctcaaattcacagtttccacattagatctcactaccttccttttgatgatgtcatttctttggcaagctgggttttcagcacttgtcattgagggcaagcaccatgtgaaaatcaatgtggaacaggaactgtgggtaatggtgtgcaatccgactgtgaggtttgaaaagtagtgtagtgccctttaggtatacatatcccattaggaagtaagggcagatttaagaatgaaatcatttttctctcactttatatgtaatttttttcaaacggctactaagttgttaggctataaatttttaagttttttggacctaaccaagggccactcgaatcaaaaacatttgggaatccctgcattacgttatgccacctaagatgtggaagctaaaacatggaccatccaagtatttgttccctaagctggctcacccccctcattagaagcaatgtgtgtttattcacatatccattcaaccaatacatgttgaacacttactatgttccaagcactgtgcagatgggggcatatagcagtgaacaagacagcagagtccctgccccgatgagtctgctgggaggaaagacagacaataaacaggattaacagtaagcatgcatcctattagattgtggtaagtgctaagaagagggggacagagcaggctaggggataggaaatgtggagggcagggaggaggtgaaattctagacaaggtgaccagggaaggcgtccctaagctgacaatttggtaaagacctgaaagaggtgagagaactatcaaccacttagctatctctctcttttttgttttctaacccttttctatgagacttagttcttctcttcataagctgattcagccaggtgcagtgacttacgcctgtaatcccagcattttgggagcccaagctgagtggatcatctcaggtcaggagtttgagaccagactagccaacatgacaaaaccccagctctactaaaaatacaaaacttagctgggcatggtggtgcactcctgtaattccagctactgggaaggctgaggcaggagaatcacttgaacccagaaggcagaggttgcagtgagccaagttagtgccactacattccagcctgagcaacagagtgaaactgcatctgaaaaaaaaaacaaaacaaacaaataaacaaaaaaaccgattcagaaacagaaccctgaagttaaattatacaacaaataggaaactgacaggaactagcctgcatcagatagagtgattaatgaaaaagcaaaagaaaatggcgtgtaactttttttcttctctgtggattaccttcactttttccagtggaacctgaactttggagcatgagggaacaaaggtaataaaaatcacaccagctcagccctatacctcatttgcaatgagaaatgaagaagggcccagagattttatgcaaataagtcatgttatgatttcagatggtaaatgacactaactaaaatggtgagatgttttaaatgggatcaacactgtgttaacaccagctgctcatataataatattttgcttttgtatggagatattttgtgaagatgggagcaaagggccataaggagaattttttaatcaagccatgtataacatacagaggtcaatcccagaaatgttgttctaatagcaatttagaaccatcaatcaaaacaagcagtgggttgttttctttctgtcaccctataaagcccatataaatggaaataccagaagaaaaaacaagtttaaattaccaccgtggagtttttttttttctgttgttgtcgtttgtttgtctatttttgagacaggatctcattctgttgcccaggctggagggcagtagcaccatcacagcttactgcagcctcaacctcccaggctcaagcagttctcccatctcagcctcccgtgtagctgggctcataagcatgtaccaccacacccagctaattttattttttgtagagacacggtctccctgtgttgtccaggctggtctcaaactcctgggctcaaatgatcctcccacctggggctcccaaagtgctgggattacaggcgtgagccagcacaccaggcctaccagtgagttttttttaatgggacagcagcaaccttcatggagctatggaatttctctgagcctcatccaagagagaggtggaatttttattattattattataagccccttagatgtcctatgtccctgaacttgtccttaatgaagccatcaaactcattatattacgctgcctaagatgcagaaggcagggttcctcaaggtacctggagccgtttcaactcctttcccatctatctcggcctttctcagctccagactcttgacaaagtacagacatacacgatctctctactgccttcctcccttcccaaaacattcagagttaatcccactgtaagtcatgtcttgttgaaaatcatttggctgagcaggatctgcagtggttcccaaccctgactgcacatctgaatacatcccctcaggagcttgataacaagagaaatctagatttagtacatttgggatgaggcccatgaatttgtattcttaagaagtgcctcagatgattctgttagaaaacactttgtgggaaccttgatggttgcgtagaagtttaccagattggtaaagggaagaagagaatgttttttttatacatgggatataaaatgccatgtgtgcaagtatggataaggaaatatgtgtggcaagttcaaggttttcaaactgtgctccaaaaaactgctcaggtaggacagaagttgttttataaatatcaaggttcttcataagatttcttcaaataaaggtttcactgctaagctcccctccagttccattgtttttacctcacaaagtgatggtttccttgcccagtcctcattaggcccattgccagggtttcggttgatctcaggctctcctttgatcctaccattgtctgcctcttgcttgctgttagctttggcactgattgtcatcataagagaaataaacaacatgcgtggaacttggaattctgctgcttataaaatgtgtcaggcatgaacagcccacccaagtgttctgcaattaggtggtaggcacgtgtggttttgtttcagagcctgcctgctatggggaccctggagacagtttttataaagttttttttaaagcatctgtttcaaactctaaagcaccaaagccctctccttttctcagagacacagatgccttagccacaactcccctgctgtaaaattctgaacttagcagtttgatcaagcaaagctttgtagagagctctgggcttgagatagaggatgcttggcttccagttctatttcatatgccacttgcttacaccaacttaagccaaataactggccaaatgagacattctctaggtcatagtttccctatctataaagttggtatactagcatgcttttatttctgagaccaggaataacaagtgatgtcttaggtgaatggagctttgagagaaaagagtaacattctataaacataatattcttaagaacaatagggaacagaattgtgcataatttaaccttgtaagacaagttgctttttctgagacacaaagaggaattagtttaccagtaaataccttttaggaaatgttaattctcattgatagagtattcatttaaaccatctgccattcatcaaaggatccagcctccaactttcttcaacactgagtccacagatgaatcaatcatgcctacctttgaattctcatcaaatttagcacttctctccatgaaagcctttatcacactcctcaagggtagaaaccttcttctttgtatctgttcccaagcctaacacagagcctggcacatagtaagcccttgacaagtgttggcttactatgtgccaggttctatgttaggcttgggaattaaattgttggctattaaatgaatgaggtttggacactgtccagtattgaattagatgcactcaagaccaaagattaataataaaatacacattcctggattcgagtggatcttaaggattcatctcaccaacttcctgccttatgccagtgccaactttcaagcataactaggaccctttatttttagttccttcctaagacggatgttgagtggttttgctggctaactcgtcaagcatgagcattctttgtgcagcttaagtccattttctttttctccacttacatgaaattgaagtagaacatgcctacatcttgtgtgtgagggtttttttttaacatattgaagattcctcttatctcacagtgtcttgtctagttcagattggaagcagagaccatcacctcaattagagtataacagaagagttaagaggttgtcaacttgaattttaaaattgcatccagtggcagctggcaacatagaaatcagcttccgtacaccaaggggagatgttgcaaactggaacactgccatcctttgccaaagatagaccaggctactgtgcagaaagtctcagatttgttatgactgaatattaatgtaccactctctgtaagtgtttggtcctctttgccttatttgatgtgatttgaatgaatttaatttactagaagtgcttttctgggtaataagcatttatatttttcatccttataaaaaatgcacggcatcttcaggcagaaaataagtgatagtgttaaatataaggaagaaagctttattgtacagtagaaatcttccaaccttagggttattttgagctgatagcaacatggcactaaaattctcagaacttctcagaagaattaggtaataaaaagtgaagccaccatttttgtgttatttactttttaaaaaatgcaatttagggttgagaagctaaagaaaactatgagaatacaaaaacacacagccttatgtcccagagccatcacctcatgatgactcatctcaggatgttttctctacttccttcaaatatgattctttccggataatttaatttaaataccaatataatgattatttctggagatgggggatttgcctcctatgataattctcttatctgcagaaggatagaatcaatttaattcccaagtagcaatattgagatgtatttttattggtttgcttaattattttttaaacttctgtaactactgatggaaactaattaaaactaaatgcacattagcttttattaaatggctgctactgagatggtgaagttcaggaaattgtaggccagcacattccctttaataatgttggctgattcacaattggggtaatttcagatttatgagatttaaagcatccatatgtcctatttcctgaagaatttttaataaagaaattaatgtatgtgccatttcaatctaatgagaacagaaccactaactgaataatgtacattctttgcctgaaatcaaatttcaccaacctgggagtgttacagtggagaaaagtacttggggtttatctatcaagtaaacggaagtctttcaccactgatttatgaagtatcccctccccactaggtacttttgtaacaacaaattatggtaaaatgatgaatttaaataaaatttgagatgctgcagtcacatattattaacatttagatcataagcacttttttaaatgtttatttcattaaaagggcaagtttggagattgacatcagttatccaaatttttttatgcagaaactagaaaaagtttgcccggaaccctgagaaccatagcatttgagatctggaaggaggctttgagcaaagcttttctggagggagggatggagaagtaaggagagcaaggagctgagaacctagagctttagcttccctgctcaccatcgtctagcatgtggtggtaggcccattagggaactcctgggcccactgtttcattctctgtaattggagaggctgatgactcatatgcctacctggcaagtagtcagcatgaaatgaaacatcctgagagcattttgtgaactataaagccccttgtcaggttgagttgttattattgttatctagaaaggccctccttacttttcagaagagcagaagtgtgcagtgacttgcccaaaagcattatttggtaaaaccaggcttggaatccaagatgttccaacctccagtccagattcttcctgatcctgtgggacattgagagagccaggagggagatagtgagtgcaatgttaaggccaccactggcttctgggcaacttggttacattactttgccttgtaatttcatgggaaaacgtaattacaggccagaagttatgatgttggataagcaacatcagcattgcagctgggcccgctgaagaaaagaaaacccacatgttggtggggtacacagttcaccaaggccccctgaatgaaaataatttgttgccaaaaaacggtaacaggactgtctattggggaacaacctctcttactaacatgaaagagctggacggataactttaaaactgagaagggctcttgtccaaattgactattttccccccaaaaaaagtatccttgtcttgttttcattcctgctgtttctagcatgtctaatgtctgagtgcatatctacccttaatgtctagttcaaacattaggaaaagcacccccctttttttgttttggttttctcttagtcatgtttaagttttctaaagaattttcctatatatcaaaggcaggcaaaaaacaaagcagaagtaatagaagaatcgttaaagctgtcaaattggtggagccaagatttaaatctcggagtatctgcccccagagcccttgcttttttgagttcattaaatgcagaataacatttgcattcttaaaacaggaattacacacacaccagagtcaaggggcttagaaccctcatggggatttatatttatgcacaaagaaatcacatgtttttccctgtgttcccagacccgaaatatcaactagccaggctaacgaagtatcacataagtattaagctattaataccaggttgctaggctgccaaaaaaaaaaacacacactaataaaaagcagtagtctgatgtcttcattgagccttatatttgtccagatctctgtcccagtccttgtagggagatggacaggctggaaaaggaacatccctaatccaaagcaacccgtgtgtcagtgagtggtagagtaggacaggggggacttgggggctgttgatggacagtggggctgagagctggcatagaaggattaggagcacacatagagggagtgtccagcatgactgtcagaaattaggttagaatgcaaagcatgtctagctaattctcaagtatagaatctctgcagacaattttctcatcaggtagaaggaagaatagagggtactagccagtgagaatgatagcccccctagtgatatcaactatccccactttcttaatggttggggggatggtggtggtctagtccccagataaccagtcaagacaatagaacaaggcccaggtctgagcttaaattctcagatcctcttggtctctgaaggaggtccgaacaatatcaggctaacagtagctttttcttaaatgcatgcagatacgctaataatgctcattaggcttatagctcacgcaaatttaattcagagtatttcatttgtgtcttcgctgtagttgccaggacagatgtgtgcgtggctgaggcacacttccctctgcctgagacagatgtcagggtattggaccatgctgacacagcaccagcatgtttattagcaaaaatagattgtcagccttctttcccccaactgagggttttcatttttgtagttaaaatgcaaatcccagctcagaaaaagagacagattttaagagatgtagaggaagatggacgaagtacagtgaaagaagagaagaaaatagaaagtgattgaaagaagaaagagggaaagcttcaggctcgtcgcttcctctcactaaacatgatctagatgatttctgattctcacacataactgagatttacctgggggtggggggagactaaaaatgcagaatcctgggccccaccccagaactgctacttcataaggccagggaactttaagttccctgggagattctcagtcacttcagcagtaggctatgggtcagtcttgagagccagtgggctgaggcaatctctgaggtttctttctagtcttaagaactgtaagaagagagcaaaaggagtggtggggaccacatgaacacagagggcgcacactgctgtattcatgttgctttacactgcagaacaagcacccctccaggcgaaagctgataagatactgagatcagagaatgaggaaaggaaggaatgtttggccttgacattggtagtttgtgttgatgttggtattgacacctctttcccattattggagatacttatttcactaaatgtgcacaagtccctgacaaatgagagtaatgcatccctaccttgtaagtctcagatgctttgatctctttgtccagccatctaatctgccaggatgctctgagctcctgccctcccctgatgagccacgctactggagagaattggagcaggtagcaaggaggtggcagccccactgactttagactgtcttcctggcttctggctgatgaaacctctctcttcatctgtctttctctttgaagatagtttttattagtaggattctattaactctctgggtagagcagacaaccctcccagctctgccagaaggaccaagtgatttgtttcaatcagaggcccaagaagaatgtttcttccagcgccttcctcttctaaccctctccaagcctcctcaaaacttctttgacttacaaaagcaatacagaatgtctggaaagcagaagatcctctcaacccaatacaactatgtttatttcatctagtcccctggtgaattttcatattcgtattttacctagagtgcttgtgattttatgggacttttttcttgtttcttgataatcatttgtaaaagctgtaaaattcttcttctagaacaggtaccactttgtttatcaaatgcttgcatagtgcttcctgtgtatcaggtacataaatattataataaatattaatgcagttcattctcataatatttataaattcgtttcacactcaaccatattatgcccatgttacaggtgaggaaaccaaggctgagaggttaggctacctgcccaaggacacagagttgtgagtgacagagatgggcgtgtgctcagctgtgctcataaccactatgctatgctggcattttatttaaccacctttctactgtttaatatttaaactgcttatagttttttataattataaaaaactacaaagaccatcggctgcctgtggcattttattcttctggattatttgtttaggataggttttccaagagatctgcctgccacacttgctgttttgagctgacagacaggggtgacagtcttacatgaattcccattggggaaatctgaactgtggggagaaggaacactttttcatgagtttgttagtgcttgattcatggccagtgtaatctaggaacaataaggggaaactatataaagctcacagtttagtgaaaatgaaggcttcagatgttggatgataccttgcagccagctagtgctcaattactgtctcctggttgacttggcagccgtaaagccactcttcaaataagaaaaactgtttttatttatttcagtagggaaataaaaacagaatagctctttagtggcagatagattaaccaacagttgagcttagtctttctccttcaaccttgatgttttgacatcctgtagacagaagtttggtttggaggtcaagccgtgttctctagaatttctgtatagacggggttggagttggcagtccctttggaaggaggtgctaaggggacttgttgtgaagccgtgtttgcatggcaagcataggttttcccttctgcagtacgtttatatagaagatgacttggagcagaggagctcatgaagattatgccctcatcatgcttaaggttttccagctgatgttgggccaaaattgtcacaggtcctgatatctcacagggcatttctttatgttttctcatatatggcacaggcccactgttcttctttgcttagaatgatatcataatatcaaaaactgaagacaatttccatttgggagagccaggccatcatacgtcttcaacccaacacacacacactcttctggcagagggacgttcttctcctggaccatcccagttttaacaatcatacatctgttccccattcttcccaattataaatgtaattaccatatcccattagcacattttattaaaacagtcttcctatcacatagaagtgataaatctgaaaatcagagtggagaaaagtggaatgtcagagtaagaagaaatagaaacagctgatttctacccctaagtgttcaggtaaattgcagtgagccaaagaggcctcaatgaagtgtgttaatggcatagttagaatcggtagactacttcattggtccacaccttcccttactccatagctcactgtatcatttatcaagcattgaaagcctccaaaatgtttgtttaaataagcaagaataccctgtggctggtatgggggggtgggtggtggtcctgaccacatttaagaatgtaaaatgagtaagtaaataagacctgaaagagacggattaatgtccgtaggcagtatgcaggatacctgatggtgttgcctggcaacctacagccagtcctgcagcaagagtcccagacaaagaggggaattgaggatgtgttcagatgaattaggtttatcaccccacccctgtttttttactttggcggcaactgggtaagggacctctttttaaacatgtagctgggatttgttttcatcagatgtggtaagagttgcagacgtggaaatgactgtcatgaaggaagaagtttatactcagaaagatccctggaaagaggaggtactgcacaccatgcagtgccacatggggaagcaccaggtttaatgaggacgcagagagcctttttgtggtttttataaaaagaaatgggtaaggcagggtaaccatggtagacaggtttagtttgaatgattttagtgggctctgggctatagggattgtccctggttgccaggtacctagccctggagtgattagggctgagggatagtgtcctggactgcaagagactgattaaaggagatggggggtgggaggtatatgaactctggtttggtggatttgcacatcaaaggtgtgcttgcagacaagtttactatctctaggaattatctaaccctggaagggtcaacccctacccagatgcagaaggtctcagatgccacagcgtaagaataaagaaaaaaaaaatacaattaatacagaccccagtacacacacacacacacacacacacacacacacacacacacacacacacacacacacacacaagttctactttgttttgagacataagaggcatctctgttttagaggctgatgttcacagagcgtgtaaggaaccttaaagagtattattggaagatctcttattccctgtccctttgatgccaagtacacatcctgcaagtccgcagtcagttctaatgccaagcaaggtgcctcacttcattcttctttcaagatttgctcttaggacctaatgaacattaaaggattttatacaacagcagcatgtattccatgagtcacaggcttgaaagaataactccaagaagtgcaggactcctatctggtcattttggttgtctcgacgcaggaaagtggaaaatgcatttttctcagctcacctcataggtttaaccacagttcaggaatgaactgtgtcatttcctatcatgcacagtgggcattgctgaaaagcattatctggaaatactatattatgccatttttgaattagtttcagtaatgagaataaacatttgcagagccttttgtgtttgtaaaatgatttacaagcaccggctagctcacttgttaataattactttgggggattcttaacaatgcatatttaggagataaaagtgattatttggatgggattaggggaaaaaacaagtaatagaaaagcatttaacacagtcattttcagttttatactctctgcaagcctgtaccgactaactttatcattttcattgaatttcatcccatattcctaatattcaaagaccagcacaaaaacactcaatgttgggtagaatcatggtttaagctttacattatcactcttccttgttgccatttcctgtcttgatttgcatatagagtgggtgcaactcaggaagccctccacaaacacacccacccaactcccatggagacaggaaactcagctccctgcccttcctctgcctctgatgtaatggatgaccctaagaatttcactgcatctctaagcctcagtgctcccacctgtaaaatggctgaggaaggaaggatgcagggcaaatgggggagtctataaattcacaaatctgtgatcttgccactatcattgtctaaagctcaaactggctcttaaatctagtgaatccatgatcttgccatttttgttgtctgaagcttggaattgtgatgccgtgcatctcactgctcattttcttgttaaaacccaaactgtgacacatcagtgtaaccacatgagtgcatgcgtgcgcgtgcacgggtgtgcacacacacacactgcttaccagactttacctaggagggaatttacaccattggtgaactgcagatattccaaaaacacttaaaaatgtaaaatttcaaatatctcttgaattttctttttctttctttctttttttttttttttttttttttgagacagaatcttgctctgtcgcccaggctggaatgcagtggtgtgatctcggctcacttgcaagctctgcctcccgggttcacaccattctcctgcctcagcctcccgagtagctgggactacaggcacccgccaccatgcccagctaatttttgtatttttagtagggatggggtttcaccgtgtgagccaggatggtctcgatctcctgacctcatgatcctcccgcctcggcctcccaaagtgctgggattacaggcgtgagccaccgcccccggccagtatctcttgaattttctattctaatctcagtttaatattacagtatttttactcgaattgtttggtaacattgaccctttagatcaatgttatcctacagcatttgggtatcttcgggccaccccacacgtgcaccatgcctgctctctggtataagaagagtagttgaagcctcatgctccacttatttcacgccttggtgaaccctaagtctgaagttaggttgcagatcaaacagtggactccatttcctctgctctgtttttaaactgtctcttgatgggttcttaaacccatctactggtaaagcctgaagtgttccaggaaatatgataagaaccaaagacatgtttgagaataaagctattctatggggaggttttccatgacgctcatcttcaactttactgtataactcttaactgattttttagtggtggtacatatctcaataataatcactgtatttatctattatttagggttatctatgaagcacttgtgatgtttttgagcagtaaccaccattttttgagtatgtacatgttacacagcctgtcatataccaatcatgtcagtcaggatccccacagggagcagatggcactcaactggggtaagtgggtaagtttggacctttcaaaggtagtgtttcataatcacaacaaatctcatggataatgaaccttatcaaggttttccataaacaattcttttctggtaccttcctaagcatttcactatgtgtagaaaatcagtgtgatttaataagctgcggattcagtatcctgaaaagaacttcctaatgtcccccttctaaagtaaaaaaatcttaagccccaaaggaatctggtcattgtttattcattactcattcatgaattatgttatcttaatgaacatgaaagcatgccctagtcataaacacacacacacacacatccttaaagatgaatattattaacttaccctagattgattgatcaaatcacatgtaataatatgataattcactttgaaaaactttctgctatcataacaagatatcaaataagtccaattttaattgattaaaaaatctattggaaagacaaatgattctatagtaatgtggttgctgtttccttcctgcccaagcaggaaattggagtctctttctgttaatgtagcttctgattttattcttggcttggggctttccttttcctaggctcatgctacataatccagcatagccatgtggtagctgttattttcagtaagtctcacgatttgagatccagcttcaacccatagtaatatggctctgccatgctaacaacttctctgagcccaaatctgcaaaatgggaataattctcaattttgttggctgtcatgatgtttaaataggacaatgtaagaaaatgaaccagcataatacctagtacataaaaggagttcaagaaatgctcaattcttttcttttccctcatgtgtataatacggctgtggtcatctcactctaagacagtggtttatggacattctgattcagccatgatcataaagaatggtctgacagagaagtctcatatattgcatgttccttctaaacttggctatactgacatttttaacagctttagttaagtatttattgcatatcgtcaaatttacccattgtaggtatacagttaaattattttcataaatgtatggggttatgtaaccctcaatatagtccagtcatacatttctgtcaccccaaaaagtttctttattgtgcccatttatagcacttcactcccacctccagccctatgcaaccactgagctgcatttttctctgtaaatttaccttctccagattattcatatagatgaaattatacattctgtatagtctcttgcatctggcttttttactatgcataatgtttttgaggtttattcatgttatagcctgtatcaaaattttattcctttttattgtgtaataatattccatcataaggatacgccacaatttgttcacctattcactaggcaatggaaatttggattgtgtccagtttttgtctgttaacaataatgttaggcctggtgcagtggctcatgcctgtaatcccagcactttgggaggctgaggcaggcagataatttgaggccaggagttcaacagcagcttgaccaacatagagaaaccttctctctactaaaaaatacaaaaatcaactggatgtgatggcgcacacctgtaatcccagctactcgggaggctgaggcaggagaatcgcttgagcctgggaggcagagattacggtaagccaagatcgcaccactgcacccccagcccaggcaacagagcgagactctgattcaaagaaagaaaagaggaagagagaaagaaagatgcctatgagccacattttcttaatccagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccacatattctcactcataggtgggaattgaacaatgagatcacatggacacaggaaggggaatatcacactctggggactgtggtggggtggggggaggggggagggatagcattgggagatacacctaatgctagatgacgagttaatgggtgcagcgcaccagcatggcacatgtatacatatgtaactaacctgcacaatgtgcacatgtaccctgaaatataaagtataataaaataaataaataaataaataaaagaaagatgcctatgaatattcatatacatgtctttgggtgtacatgttttcacttctcttgaatagattcctaggagtgaaattgcagtgttgtgtggtttgtgtttaactctttaaaactgacaaattgttttccaaagtggctgtaccattttacattcccatcagcaatatataaatattacagtttctccccatcaacaccaatacttgtattgtcttttttgttacagccattctagtgaatatgaagtgatattcattatggttttaatttacatttccctaatgactaataatattgagcatttttcaatatatttatttgccatccatacgtcttctttcgcgacatgtctattcatgtattttgcccattttttaattggggtgtaagagcccaattttttattgagttgtaacagttcattatatatattctagatataggtctttagcaaacctatgttatgcagatattttctcctgtggcttatattttctgtctgtggcttatatctttattttcttaatagtacttttcgaagcacaaaactttttaatttttattgataaagttcgatttattgagtttttcattaatggtttatgcatttgttctcatttttgacaactctgcccaacacagagtcacaaagattatctcctgtatttacttctaaaagtcttaaaattttaactcttacatttaagtaccatattgtgttaattttggtatatagtgtgaggtaagaatctagttcattacttttgcatatggctttctagttatcccagcatcattggttgaaaagacttttccctccttcaattttttttattatactttaagttctagggtacatgtgcacaacgtgcaggtatgttccataggtatacatgtgccatgttgatttgctgcacccattaacttgtcatttacattaggtatttctcctaatgttatccctcccccagccccccactcaatgacagttcccagtgtgtgatgttcaccgccctgtgtccaagtgttgtcattgttcagttcccacgtatgagtgagagcatgcggtgtttggtttttctgtccctgtgatagtttgctgagaatgatagtttccagcttcatccatgtccctgcaaaggacatgaactcatccttttttatggctgcatagtattccatggtgtatatgtgccacattttcttaatccagtctatcattgatggacgtttgggttggttccaagtctttgatattgtgaataatgccacagtaaacatacgtgtgtgtgtgtgtgtctttatagcagcatgatttataattctttgggtatatacccagtaatgaaatcgctgggtcaaatggtatttctagttctagatccttgaggaatcaccacattgtcttccataatagtttaactaatttacactcccaccaacagtgtaaaagtgttcctatttctccacatcttctccagcatctgttgtttcctgactttttaatgattgccattctaactggcgtgagatggtatctcattgtgattttgatttgcatttgtctgatgaccagtgaagatgaccattttctcatgtgtctgtttgttgcataaatgccttcttttgagaagtatctgttcataacctttgcccactttatgatgggattgcttgtttttttcttgtaaatttgtttaagttctttgtagattctggatattagccctttgtcatataggtagattgcaaaaattttctccctttctgtaggttgcctgttcactctgatggtagtttctttgccgtgcagaagctctttagtttaattatgtcccatttgtctattttggcttttgttgccattgcttttggtcttttagacatgaagtccttgcccatgcctgtgtcctgaatggtattgcctagtttttcttctagggtttttatggttttaggtctaacatttaagtctttagtccatcttgaattaatttttgtataaggtgtaaggaaaagatccagtttcagctatctacatatggctagccagttttctcagcaccatttattaaatagggaatcctttccccatttcttgtttttgtcaggtttgtcaaagatcagatggttgtagatgtgtggtgttatttctgaggcctttgttctgttccatcggtctgtatatctgttttggtaccagtactatactgttttggtaactatagccttgtagtataatttgaagtcaggtagcctccagctttgttctttttgcttaggattgtcttggcgggcccttttttggtttcatatgaactttaaagtagatttttccaattctgtgaagcaaatcattggtagcttgatgaggatggcattgaatctataaattaccttgggcagtatggccattttcacgatattgattcttcctgtatatgagcatggaatcttcttccatttgtttgtgtcctcttttgtttcattgagcagtggtttgtagttctccttgaagaggtccttcacatcccttgtaagttggattcctaggtattttattctgtttgtagcaattgtgaatgggagttcactcatgatttggctctctgtttgtctgttattgacgtataggaatgcttgtgatttttgcatatgggttttgtatcctgagactttgctgaagttgcttatcagcttaaggagattttgggctaagacgatggggttttctaaatagacaatcatgtcatctgcaaacagaaactatttgacttcccttttcctaattgaataaccctttatttctttctcttgcgtgattaccctggccagaacttccaacactatgttgaataggagtggtgagagagggcatccttgtcttgtgctggttatcaaagggaatgcttccagtttttgcccattcagtatgatattcgctgtgggtttgtcataaatagctcttactgttttgagatatgttccatcaatacctagtttattgagagtttttagtatgaagggctgttgaattttgtcgaaggccttttctgcacctattgagataatcatgtggtttttgtctttggttctgtttatgtgatggattacgtctattgatttgcgtatgttgaaccagccttgcatccgcggggtgaagcctacttgatcgtggtggataagcttttcgatgtgctgctggattcggtttgccagtattttattgaggattttcacatcagtattcatcagggatattggtctaaaattctctttttttgttgtgtctttgccaggctttggtatcaggatgatactggcctcataaaactagttagggaggattctctctttttctattgattggaatagtttcagaaggaatggtaccagctcctctttgtacctctggtagaatttggctctgaatccatctggtcctggactgtttttggttggtgggctattaattattgcctcaatttcagagcctattattggtctattcagagattcaacttcttcctggtttagtcttgggagggtgtatgtatccaggaatttatccatttcttctagattttctagtttatttgtgtagaggtgtttatagtattctctgatggtagtttgtatttctgtgggatcggtggtgatatcccctttgtcattttttattgcgtctatttgattcttctctcttttcttctttattagtcctgctagcagtctatcaattttgttaatcttttcaaaaaaccagctcctggattctttgattttttgaagggttttttgtgtgtctatctctttcagttctgctgtgatcttagttatttctcaccttctgctagcttttgaatttgtttgcccttgcttctctagttcttttaattgtgatgttagggtgtcaattttagatctttcctgctttctcttgtgtgcttttagtgttataaatttccctctacacactgctttaaatgtgtcccagagattctggtacgtcgtgtctttgttctcattggtttcaaccttaatttttttctaccttaattttgttatgtacccagtagtcattcaggagcaggttgttcagtttccgtgtagttatgcgggtttgagtgagtttcttttttttttttttttttttttttttttttttttttgagacggagtctcgctctgtcgcccaggctggagtgcagtggcgggatctcggctcactgcaagctccgcctcccgggttcacgctattctcctgcctcagcctcccaagtagctgggactacaggcgccagccgctacgcccggctaattttttgtatttttagtagagacggggtttcaccgttttagccgggatggtctcgatctcctgacctcgtgatccaccctcctcggcctcccaaagtgctgggattacaggcgtgagccaccgcgcccggccttgagtgagtttcttaatcctgtgttctaatttgattgcactgtggtctgagagacagtttgttgtgatttctgttcttttacatttgctgaggagttcttttatatttgctttacttctaattatgtggtcaattttagagtaagtgtgatgtagtgctgagaagaatgtatattctgttgatatggggtggagagttctgtagatgtctattaggtccacttggtccagagttgagttcaagtcccggatatccttgttaaccttctgtctcgttgatctgtctaatattgacagtgggttgttaaagtctcccattattattgtgtgggagtctaagtctctttgtaggtctctaaggacttgctttatgaatcttggtgctcctgtattgggtgcatatatatttaggataattagctcttcttgttgaattgatccctttaccattatgtaatggccttctttgtctcttttggtctttgttggtttaaagtctgttttatcagagactaggattgcaacccctgctttttttttttttttttttttttttttttgctttccattctcttggtagatcttcctccatccctttattttgagcctatgtgtgtctctgcacattgaggtgggtctcctgaatacagcacactgatgagtcttgactccgtccaatttgccagtctgtgtcttttaattggggcatttagtccatttacacttaaggtttatattgttatgtgtgaatttgatgttgtcattatgatgtttgctggttattttgcccgttaattgatacagtttcttcatagcatcattggtctttacaatttgccatgtttttgcagtggctggtagcagttgttcctttccatgtttagtgcttccttcaggagctcttgtaaggcaggcctggttgtgacaaaatctctcaacatttgcttgtctgtaaaggattttgtttctccttcgcttatgaagcttagtttggctggatatgaaatcctgggttgaaaattcttttctgtaagaatgttgaatattgacccccactctcttctggcttgtagggcttctgctgagagatctgctgttagtctgatgggcttccctttgtgggtaaccttatctggctgcccttcacattttttccttcatttccaccttagtgaatctgacaattatgtgtcttggggttgctcttctcgaagagtatctttgtggtgttttctgtatttcctgaatttgaaagttggccttgctaggttggggaagttctcctggataatatcctgaagagtattttccaacttggttccattctccctgtcactttcaggtacaccaatcagatgtagatttggtcttttcacatagtcccatatttcttggaggctttgtccatttctttttactcttttttctctaaacttgtcttctcagtttatttcattgatttgatcctccatcactgataccctttcttccacttgatcgaattggctattgaagcttgtgcatgtgtcacaaagttctcgtgccatggttttcagctccatcaggtcatttaaggtcttctctacgctgtttattctagttagccattcatctaaccttttttcaacgtttttagcttccttcgaatgggttagaacatgctcctttagctcagagaagtttattaccaaccttctgaagcctactgctgtcaactcatcaaagtcattctccgtccagctttgttccattgctggcgaggagctgcgacactttggaggagaagaggcactccggtttttagaattttcagcttttctgccctggtttctccccatgtttgtggttttatctacctttggtctttgatgatggtgacctacagatggggttttggtgtggatgtcctttttgttgatgttggtgctattcctttctgtttgttagttttccttctaacagtcaggtctctcagctgcaggtctgttggagtttgctggacatccactccagaccctgtttgcctgcgtatcaccagcagaggctgcaaaacagcaaatattgcagaacagcaaatattgctgcctgatccttcctctggaagcttcatcccagaggggtgcccgcctgtatgaggtgtctgtcagcccctactgggaggtatctcccagttaggctacacaggggtcagggacctacttgaggaggcggtctgtccattctcagtgctcaaacaccatactggcagaaccactgctctcttcagagctgtcagacagggatgtttaagtctgcagaagtttctgctgtcttttgttcagctatgcactacccacagagatggagtcctagagtcagtaggccttgctgagctgtggtgggctccacccagtttgagcttcctggccactttgtttacctactcaagcctcagcaatggcagacgcctctccccgccacaaggcagcagcctcgtgggtcaatctcagactgctgcactagctgtgagcaaggctctgtgggtgtgggacccaccaggcatgggagagaatctcctggtctgctggttgctaagaccatgtgaaaagcgcagtatttgggcagagtgtcctgtttttccaggtacagtctgtcacagcttcccttggctaggaaagggaaatcccctgaccccttgtgcttcccaggtgaggcaatgccctgccctgctttggctcgccctctgtgggctgcatccactgtccaaccagtcccagtgagatgaaccaggtgcctcacttggaaatgcagaaatcacccatcttctgcatcgatcacgctgggagctgcagaccagagctcttccttttgggccatcttggaacggaaccctccctccttcattttattgtcttaagaatgacattctcttacagaaccacagtagaattaccaactttactatatctttactatatctaaaattgttacaatgctttcatctaatctattatcaatattctaattttatcaatcagtatgtgctttataacatattttcttcctgagcaagacccagtctaggaccacaaaatttacttagttttcatttctctttaatctggaacgtttgtctagcctttctttgccatttatagcattaacagttttgaaaatacattttcaaaatttctggataatttctgcaaatacatatatataattttttttttttttgagatggagtctctctctgtcacccaggctggagtgcagtggtgcgatctcagctcactgcaagctccgcctcccgggtgcacaccattctcctgcttcagcctcccaagtagctgggactacagttgcccaccaccacgcctggctaattctttgtatttttagtagagacgggttttcaccgtggtcccaatctcctgacctcgtgatccacctgccttggcctcccaaagtgctgggattacaggcgtgagccaccgcgcctggccaaattttttaataatttaaaatgtgctttaagatacatttttaaataaatattctttctcttgtctttgtctgacgtttcctcctgattccattcatgctgtgcctcccaagtcggaataccacttagttgatgacatatccttctagtgcaccctttctggacacatgcaatgtccatctgcccttcattgatgttaattttcatcacccaatcaagatgttgttcagtttccccactgtgtaattactatcttccccttgcatttagtaagtcctccgacttcttttttagaccagcacgtttagatttttctcagtgtccctggaaaagagaggaactgctcttctgcttgcaacacagtaattgctaacccctgtgaagagagcatttataatggcattaatgcctgaagacctttttaatgtgaatttaaggattttccctaatgcatggatgattagaattagagaaagctgctaccaattggatgacagttttcttatccgctataatctagtacaaaaataactcctttctgctgtcttattaatatctctagtcaaaaaaacttctctgatttgattcctgccatgcttgttcatgaataaatggatggagctgtgttcctgcaggaatttttaagagtttatttttttctgtttcatctaatgaagataaatgaacatcttgaaagaaaagaagtggctcggactttactggaaagagtaatacttggaaaaaatatttctaatagcttgggaaaataaaaaggatgatgacaactctaaagtgtatgccatctctcatcagtatctctcatccagttaataggagaggatggcagctttgttattaaatcatgtagatgctaattgaaggcacaaccaaatagaaggatcagttgccttcaaaagcgcttttagattattagctgtgatttcaatgatggaacgcaatttccagatcaactccaattcttagactgataattttcctaggaacatgcatgctttgggaaagaatggttgtatagctggtcctcattaagaaccctcattctccaagtcacttttgcctctaaagtctaagtattcccattatacattacagccaaggtcacctgagagctgtaatgtgcacactaaagccatttctccacctagtccctcagatgtctatgattgtttgggatctgctggtgctttgtagcatggaatccatcctggtaattggtggatggatagctttgcccaaaagtctatgggacaagaacagacagcatgagtttagattttgaaatggcctagtccttagaaatagctcattccaacaccaaaagcttattactattgatatagctctctgaaagaaataacagtgacaacgacaacctggatttgcatagctctttgccctttcaagacactcttggtaacatcttttttcaggcaatatagccaaaatgccttagtttaaaacttggcatcaccatccactgactgtataatctcaaacaaagttacttaatcttgttttgtctcggttttcctgtttgtaatatggagacaatagtggatccctattaataggttgttgtaagaactaaagataacatcgatcaagtgcttagagcaatgcatacaggaagtgcttaatagaggttaagtattgttgtccttatcctattattctactgaagaaagtaaaggcatggattaatatcctgtttttatggttgaagaagtaaccagtggttcagtaacttgcctaagatcacatagcaattgataggtgacccgcaataaagagaagccgctcagagcttttgagtcctgctttataggtccctggggagggtccctcctccctccaatcttttgtgcattttgttaccttaaatgactttgaaacacagaaagccctgaggaccacacctgggtctgtggaaggaggcctggaccagcctgtgtccccacagaaatgcttggcccctcaccccagcccccacacccatgagagcttgggtctgtggtatcagccaaacacagattccataaagagccagacaagatggggacactaacaacacaatctccagtgcttctgcctcttccaggctcacagctaccccagcaggaagtcttgctgatgtgctggtttcaccaaacccaacagccacagtggctgtagcaaaagtagttaagtctgtctcagaaataaagaccaacgaagtagccgagagatggattttgtaactttagatctttggggaatgaaaactaaatttaacccaactttggcaatggacaacccctacaaatacttgtttgcaaaatcactttattttatattatagattaacattaaatgagtaaggaatacataattgagtgaacattggtgttatacattgatattgagacataaaaagcatgtatacatactctgcagctttagctagcacatgtcctcaaaatagacctccgcactactaagaaccagagacgacttaaagccctgcagcctttcttgtaacacacacaaatgataaaataaaaagagagactaataaaaagacaaacatttcttctggtaatcagctggtctggagtcactgtttcattaggtattccattcatcacacaaaataaggcgaataaatagaaacacacatatggggaagagggagataaataaacatgaaataaaacaaatgaaatacgtaccccacattcttgcaaaaaatcattaggttgagtgattccctttaagtggtgagactatgggcactcagtttgtttcccttctttgtatagatatcctccatattatatgaacatattttgcaatggaaactgaaaaaagtacatttttaaaatacctttaaaagaaagttggtacccattgggtaccagttgtaagggtatacactgaagaggctatatctttagcatcatcacttagagagctgtgtggtcattaggtttatcccagtgaaagtgtgctgtactatcacttgaacatcattatgcctagtgcttgtcgaaaaaggtctgaaccttagatactgaagagcttcccattataaggcagggagaggagaaagatttaaaaacacatataaacatcttttctttgtggataaagaagtgtggtcaaactctataccttacctgtaactctggaatgttttgagaatgagccaaaatgtcagattcttccccctatccaaacagcctagctggcaaggtccccagggacccaaatcagacccaaggtgagcatgctggtcctcagtttgtagtgggcaagacctcagggtgagctgaagaacagggccttgggtgatgcaaaattgaaaggccagacagaccgtctaagtgagttgacatagacagagcaggaaaatctgaataccaagccagaagatagagcccagggaagtcaaactgtgggtgggagaaaattccctctgtaagtaaaagggatctgcagcaacctcttttagcataaaagaacgctactgaaaattccagtgtggccaggatgggaaggtttgtagatacctttgtgcttgtcaaagtaaggatttattcaaatgtgaactacagctgttattgtgagtgattgaaaagcattccaagttcctggactgacaaacattctctgtgtatccacagccctaatattacccatctaattcaatgatacggacgttgaaagggatttgtatccccaaggaatatatgcattgctgttactgtattactatgatggcctttaaaaaaaactgtgtatactattctcttgatacaagatacttgacaggctctcagcaaaatgctgagcttttaccacctttactaagtcagcaatgacactatctcacagggtgaaaaagggaaatttttgccaactcctgaagatcttggcatgtatcaataatatgatttttataagaaatgagattctaaaaattgtgggtaatagatttacacatttcccagatggcttacagaataacagactggaaacagaacttaaattataggcaggaacataaacaccagacctaattttgaaaataagcagaatagaaatgtgatgagcattaacaatagtaattgcttgcaacctttaatgtcatcttggctagagatgttatatggtgtgaatgccccaaataataagaaccaaaagggtctattttcaatataactccatccagcagatactaattgagtactttctatatgccagacaccattctaggagttggggacatagcagcaaacaaaaccgaacaaatccttcccctcgtggtactgatattctagaggggaaagactagtgaacaggaataaagaagtaaaatgtatagtatgttagatagggatacatgcaatgaaaaaaatgtaaagccagaaaggagaatatatgtgttgaaggatggtgcttcagttggaaaggagaaaaattcagccagtagtctaattttggaatagaaatgggttccaaagtgggaggcaagaggccagtcatttcactctctggatttccctgtctatcaagtgaagcagactgtgggatctttgtcacaaacaagctcttacagttcagattgctggtggtgctttgctgtgtgacacaagggaaattaagaaacacattggatttcaaactttaaaagtgacacaccaagtagtgttcttttgtgccagtaaaacaaagctacagattgcccagagggagacttctgccttggagtgaacgcccctggaagacactacactggtactttcactccagtgacagcataggggaggaaaaatggggatagtaactggtttacatctcaaggatattatagtctcatagttgcttctttttaacattttttccttagaattaccatctgttaggcactgtcatttttcaaacccattttatagattaggtaattggaaaatgaaaagtatcttgctgaaattcatatagctagttgcagtccaagaatttaaaaccagatctctctgattccagaatctatgaactttgcatgacacccagccatgttctcataagtacctcattttttactctaaaaatctctcccagatgagggtgcactcaacaaaatctgaagtgggacagtatacaggacaaatgacctgtctttctcagcaaataaatcataagaaaaaagagaaagggaaaataacatatagattaaaaattacttaagagggggagttctgggaagatggtgaataggagacaggactgacatgcagctcccatttggatggacagaatagcatgtggagactcacaccatggaattttgttccaggaaccactgcaggagcataacaggaaaaccaaaataatttctagatcctttgaaagaagcagcaaattctgcgagataggcaaaaaaaaaaactcaggggaagtgtatagcctggggctaggtctgagtcctgtggacaggctgcctggagataaactcagcgctgtttgcaggccacagtgggagagagattggcctcaccaaatgcatgggagctgggtgaggcccatcacaactggctttcccccacttccctggtgacagaggcaaccctaatcccctctggaacataaccccgttggcccaagaaccacccctttatcccccatggtagctacggcaagcccttgcccaagaagagtctgagctgggtcctgcctaacactgcccccgcctgatgatttttctctacctgtcccggtagccaatcacgaaagacataaactcttgggagctttatgaccctgaccattgcctcagaaacctgaatacttatcctggccaacttagggcaagcttatatcccacttctgttgcagctggtgctttcttgaaagcacgacctcctggctgtaggccaaccaactcaggacattacggaaactcatgacagaacaaccctgctgcaaggaaggagaaaacatctaattccattgcatgcaacattctggctgaccagtggtcctgagtctgtccacatgacaacttcactgctaacataactagcattcaagaaagctagtacactaaacatatctaaaaccaaggactctcacagagtctacttcactcccctgccacctccaccagagcaggtgccggtatccatgtttgggagacctgaagatggattgcatcacaggactctttgcagacattccctagcgccaacccagagcctggtagccccactgggttgctagacccagaagaacaacaatcactgcagtctagttcacaggaagccccatccctaggggaaggggacccttcatgggaccttcatgagtccttcatgagaccacctcatgggacaaaagaatctgaagagcagcccttaagttccagatttttccactgaaatagtctacccagatgagaaggaatcagaaaagtaattcagacaatatgacaaaacaaggttctggctgggcgcagtggctcatgcctgtaatcccagcattttgggaggctgaggtgggaagatcacttgagcccaggagttcaagaccagcctgggcaacatagactccatctccacatttaaataaaacaaggttctataacactccaaaaagaccatactagctccccagcagtggattcaaaccaagaagaaatatctgaattgccagataaagagttcagaaggttgattattaagtgactcaaggaaataccagagaaaggtgaaaaccaacttaaagaaattaaaaaatatatacaggatatggataaaaaatgctccaaagaaatagctatcataaagaaaaaaaaaacaatcacaacttctggaaatgaaagacacacttagagaaatacaaaatatactagaaagtttcaacagtagaatcaaacaagtagaagaaagaacttcagatcttgaagacaagtttttcaagttacccaatgagaaaaagacaaaacaaaatgaacaaagcctccaagaaattttggattatgttacatacacaaatgtaagaataattggtgttcctgaggaagaagagaaatctagaagttttgaaaacatatttgggggaataatcaaggaaaactttcctggccttgctagaaatctagacatccaaatacaagaagctcgaaggaaacctgggaaatgcaacacaaaaaggtcatcacccaggtgcgtaatcatcaggttatccaaagtcaagacagggaaaaaatcttaagagctgtgaggcaaagtcatcaggtaacctataaaggaaaacctattagattaacggcacatttctcagcagaaacccgacaagccagaagggatgggagttctatcattaacctcctcaaacaaaataattgctagccaagaattttgtattgagcaaaaactaagcttcataaatgaaggagagataaagtctttttcagactaacaaatgctgagagcatttgccactctcaagccagcactacaagaaattctaaaaagagatctaaatcttgacacaaaaccttaaaatacaccaaaatagaatcttcttaaagcataaatctcacagggcccataaaacaataacacaaaaaaacaaggcattcagacaacaactagtacaatgaataaaacagtatgtcacatctcaataacattgaatgtaaaatggattaaatgttccacttaaaagatagagaatggcagaatagataaaaatccaccaaccaagtatgtgctgtcttcaagagactcacctaacacataaggactcacagaaacttaaggtaaagtggtggggaaagatattccatgcaaatggtcaccaaaagtgagcaagagtagcgattcttatatcagacaaaacaaactttgaagcaacaacagtttaaaaagacaaagaaggacattatataatgataaaaggatcaatccaactggaaaatatcacaatcctaaatatatatgcacctaacattggagcttccaaatttataaaacaattattactagacataagaaatgagatagacagcaacaaaaaaatactccactgacagcaccagacttcagtactccactgacagcaccagacaggttatcaagacacaaagtcaacaaagaaacaatgaacttaaactatgccctagaacaaatggacttaacagatatttacagaacattctacccaataactgcagaatatacattcttttcatcatcacatggaacattctccaagacagaccatatgataggccacaaaacaaatctcaatgaattgaagaaagccaaaattataccaagtgccctctcagaccacagtggaaaaaaactggaaattaattccaaatggaaccctcaaaactatagaaatacatgaaaattaaataatctgctcctgaattatctttgggtcaacagtgaaatcaagatggaaattaaaaatcctttgaactgaatgataattttgacacagcttatcaaaacttctgggtcacaggaaaagtggtgctaagaggaaagttcatagcattaaatgcctacatcaaaaagtctgaaagagcacaaagagacagtctaaggttacacctcaaggtactagagaaacaacaacaatccaaacccaaacccggcagaagaaaagcaataacaaagatcagagcagaattaaataaaattgaaacaaaaaaaatacaaaagataaatgaaacaagctggttctttgaaaagataaataaaattgatagaccattagcaagattaaccaagaaaacagagagaaaattgaaataagctcaattagaaatgaaacgagagatactacaactgacaccacagaaatacaaaagatcattcaacactactatgaacacctttacatgcacaaactagaaaacctagaggaggtggataaattcctggaaatacacaaccctcttagattaaatcaggcagaagcagaaagtctgaacggaccaataacaaatagtgaaattgaaaaagtaataaaaaaattaacagcaaaaaaatccaggaccagacggattcacagctgaattccatcaggcattcaaaggattgataacaatcttactgaaactattccaaaagatagagaaacagggaaacctccctaaatcattctgtgaagtcagtatcaccctaattccaaaaccaggaaaggacataacaaaaaagaaaactacagaccaatatccctggtgaatatagatgcaaaaaacatcaacaaaatactagctaaccaaatcaaacaacgtatcaaaaagataataaaccatgatcaagtgggttttacaccaaggatgcagggatggtttaacatatacaaatcgataaatgtgatacatcacataaacagaattaaaaatcatatgaccatctcaatagacacagaaaagcgtttgacaaaatccagcatcctttatgattaaaaccctcagtgaagtcagcatagatggggcatacttcaaggtaataaaagccatctatgacaaacccacagccaacattatactgaacagtgaaaagttgaaagcattccccctgagaactggagcaagacaatgatgcccactttctccacttctattcaacatagtactaaaagtaccagccagagcaatcagacaagagaaagaaatgaagggcatccaaatcggtaaagagtaagtcaaactgttactgttccccaatgatatgattatatcattcatccaaaaagattcatccaaaaaccctgaagattcatccaaaaagctcctagatctgataaatgaattcagtaaagtttcagaatacaaaatcaatgtacacaaatcagtagcactgctatacaccaaagtgaccaagctgagaatcaaatcaagaactcaccccttttacaacagctgcaaaaaaataaaatacttaggaatatacctaaccagggaggtgaaagatctctacaaggaaaactacagaacagtactgaaagaaattatagatgacaccaacaaatgaaaacacacctcatgctcatggatgggtacaatcaatattgtgaaaatgaccataatgccaaaagcaatctacagattcagtgcaactcccatcaaaataccatcatcattcttcacaaaactagaaaaaataatcctaaaattcatatggaaccataaaagaccccacatagccaaagcaatactaagcaaaaagaacagatctgttggcatcacattacctgacttcaaactatactaccaggccatagttaccaaaacagcatggtactggtataaaaatagccacttaaaccaatgaaacagaatagagaacccagaaataaagccaaatatttatagccaactgatcttcaacacagcaaacaaaaacataaagtcaggaagggacaccctgttcaacaagtggtgctgggatcattggcaagccacatgtagaagaatgaagctggattctcctctctcaccttatacaaaaatcaactcaagatagatcaaagacttaaatctgagacctgaaaccataaaaattatagaagataacatcagaaaaactcttccatacattggcttaggcaaagagttcatgaccaagaatccaacagcaaattgaacaaaaagataaatagatgagacctaattaaactaaaaaccttctgtacagcaaaagaaataatcagcagagtaaacagacaacccagagagtgggagaaaattttcgcaaactatgcatctgacaaaggactactatccagaatctacaaggaactcaaacaagtcagcaagaaaaaaacaatcccatcaaaaagtgggcaaaggacatgaatagacaattttcaaaagaagatatacagatggccaacaaatatatgaaaaaatattcaacatcactaattattagggaaatgcaagtcattaccacaatgagataccaccttattcctgcaggaatggctataatttaaaaaatcaataaataacatgttggcatggatgtggtgaaaagggaacacttttacactgttggtggaaatgtaaactagtacaaccactatggaaaacagtatggagattcctcaaagaactaaaagtagagctaccatttgatccagcaatctcactactgggtatccacccaaagaataagaagtcagtggctgaacgcagtggctcacacctgtaatcccagcactttgggaggccaaggtggatggatcatgaggtcaggagttcaagaccagcctggccaaaatggtaaaaccctgtgtctactaaaaatacaaaaattagctgggcatggtggcgggcacctgcgatcccagctattcaagagtctgaagcaggagaattgcttcaacctgggagacggaggttacagtgagctgagatcgcaccactacactccagcttgggcaacagagcaagactccatctcagaaaaaagaagaagaagaagaagtcattatatgaaaaagacacaaacacatgcatgtttatagcatcacaattcacaattgcaaaggtatggaaccagcgtaaatgcccatcaaccaacaagtggttggttgatgaaatatggtatatgtacaccatggagagctactcagccataaaaaaggaatgaaataatggcattcaaagcaagctggatggagtttgaagaccattattctaagtgaagtaactcaggaatgggaaagtagacatcatatgttttcacaagcgggagctaagctatgagggtgtaaaggcataagaatgatataatggattttggggattcaagaaaaagggcagtaggtgggtgagggataaaactatgcattggctacactgcttaggtgatgagtgcaccaaaatctcagaaatcatcactaaagaacttttccatgcaaccaaacaccatctgttctgccaaaactcatgaaatttttaaaaagtcaaaataaaaattacttaagagacaacaaatatcaatatttgcaccttattcagatcctgactcaaacaaactgtttaaaatcaatacatgttagccagatgtagtggcatgtgccagcagtcctagctacttgggaggctgagacaggaagatcactggagcccaggagttcaaggttgcagtgaacctgggcaacagagagattatctctaaaaaaaatttttaaataaaaataatatatataaaaaataataaaataaaaataaaaaatatataatttttaagtgtgtatatgtgtgtatatatatgtaaaatcaatatatggaatatggctgggaatttgaatactaataacatttgataatattgaagaattgggttttttaaggtgctataacattatgtttacattttaaaagagagtcattttagaggtacatgctaacatatttccagaagaaatatgatgtctgggattaactttagaataatgcattgaagggagtataaataaataagattgaccacatgttgatcactgatgtagctgggtgatgggttcatgagggtggttatacttttattcccaattttatagatgaataagaatttccacaacaaaaagtaaaacaaaaaaacacaaaattttcaccatggtgaatgtggaatttactgaccacctgccacttccgtaagtgctgtctcttccattagattgggggcaagcctgggcacacaccccagtctaatggtcaaaacacatgtactagtgccccttcctgccctggtttatagagctgacctagacattggacttcctgctcactgtagactctcctattctgggtctttggcttttatgcaaccagccccaaggacgtgtcacccaaggatcccaggaggcaatttgatataatgaaataagttagtcctttggaattataacaaccttcaccgggagtctcaccttccctttagtagctatgtaatattgagtaaagcccttcaccttactgggcctttatgagttgttgtgatgatcaaatggaatagtataaacaaggattcttcccgagaatctgggctcctaaatgtactggtcttctaagacccaacaatgaatcgatgaagaggtggtgtctatagtgggagtgactgacattttcctagatcacatctgtcttccccactggactacatctcctaaaggaaggaaccgtactttgtgcttttggtgttcccaaaatggttagatgggaaaaacatggccttggtgtcagaaagtcctgggttcaaattctgtcttcatcgattactaactgtggagcctttgacatgttttagcctccttatctgtgaaataatatgtccacttagaggatttaatgaaagaagacattcaagtgcccacagtatagttggggcatgagaagtattattttcccacctccgttaggtgctctcttgatacttgcagaatgaatgagtttaacagatgcttctttgaaacatgaatgcctcagaagcctttcaggtacagcttttcaggtttttcactgaacataggaacctaggtggactccccaggctgtgagtgtgtgtgactgtttgccacaagaagggtgcctttgtgtactttgtgaaggatgctgagtggacaaacatgtccctgctcagaagaaaaatgccagtcacccagagaaaggaatttataaagaatgattgagactagtgccaaggtcaagaggaaaaataattctaattgatattgtcagagcactgggctttctttgaagaaagccacattttttgaccatattaaagtttctttgtggttaattcaggtccctggcctgggcctcatggtgttagggttattatgaagacagaagtatgtaaataccagttatccaactaggcctgactgcatgttggaattgacttttccccaggctgccctcaggtcccagtcagctctgctcagccagagcagcatcaggtcgtactaatgccaggcaaatcctgaatagtgataggagccccccagaaaatgtccattggcaggagggcctgagggctgttgcttctgttgaagtgtttgaagaggtgctgccacctcagactggtgtcaaggtcagaatggatgtgcagttaacatcttcttttgcccttgtcagtcttgctacttcattgcaaaagttcaaggctacagaggctcaggggcagggatcccacctttctgaatggaaagagcagaggtaaggctcatttctgtggatgggcggcagggtcaaaggattctagagtctgtcaggacaagcaaagacaaaagaagagtcaagaaagttgtgaaaagcagcggtgaaattcagtgaaggaaaaagtgcaggcaggagggaggtagctgtaacaagggtatggagtgaaatacgtatctcagtatttttccccacatgcttaactgatagccccaattccgtttgttggacaattattcttctccttgttttctaataccacctttgttgtggactaatttttcatcttttgggggcttgctgtttagttccattcatctgtctctgatctcatgtcagtgtgttgtgttggagtctaagagtgcaagtccagggaaattcagacctacattcagaactacagttagatgtgtgctttcccaaataggagactcttctgttcatcattttaaatgttgtatcctaatgtcatgaggtcagaaggaactgtttaggacaacggtgtgtgcctaatagggaattaattatttgtgcctgagtgtaagaccatgtcatgaccttccgatcacaagaaaatgaggtatcgttggaaaaaaactctaagcctgtcacctggatgtaaaagtcgggttggtgagatcaggcacattcagggtggtacggtggtagactaaaagcctactaaagataaatgaaagtcccagtaatttgattagttttttctgtttctgcaagtcaccaaagtacatgagcactcagtggcctttatactgtatggtggccccagcctggttcagcagggtgtcttccctctctatcactctgtgagaagcagagggactctgattgtttctactcaagcagggtgagaacaatgttatcaggcatttccaggcagatagcagaggtggattttcctaacctcatcccaccctctctcatctcatgctgtcagactgtcatgcagctgcagacagaatccatccccagagaacagtggatggtggaaccacatgtttattttacttttagtttccaagtttgcagtaggttagatgtaacataggaatgaaccctgaacaatgctttctgaaccttctatgccacaggttcccccaaataattgggagtggttggaaggaatcaaggaggaagatggttagaggtaattattcactgctctcttttcagtctcatcgtgctaaatccatgcctctgttttaaaccttattacatcatggtggtatttatttatctgtatgtcttcacacccacccccaacccctgcaggctgcctaagagtgtctggactgttttaaccattttcggaatctagtgtgatgtctggaatatagtaaataagtgtttgagaaattgtgacatgcacatgtctaggaatgtatgtggcaacactagtactttgtgaaaaccccatttctattcagttcaggcttatggtttgtgtggtagttgtagttgggaaggggagtgtctgctttaaaaaaacattaacaccccaaattgcctaatgcctgggactattttccaagtcgccttcactagaatcagagatggaatctggggaaagaggttggggctctttgctgagaaaggtaaatatttttccctatgcaggtgacacattactgcttcagttcattgatgcctagatcctatgacagcctggcaggtgactggcagaattttgctgtgtcttgtcccggcagtcaggatttcaggcctcaaagaaaagctccagtgaaaaggaagggggaaatcctgggagtggaagaaacccaacctccagcggctccttttccctgcaggttcatctttgagcagctttgctaatcagacaagaaggtcttttgggagagattttacttatcctttcctttcctcagaaagcctccttttttttatttatttttttaaggcaaagaaaaagtttcaacaattcttatcatagcctgcaggcacacaagagcaggagaaaaagcaaattgcaaagtgaagacccagcaccctgtgtttagccttcacccaaaattgcactgcacggtgaacacttaattgctgagtaaacatgtttctaggctgtgatctagattccctaagagaagggttataggatagtgtgtggttatattccctctacctagagaggattaagtctaaaatctcctgcatcaagaatcttggtgctgggaaagatgcaatacaggttctccaaggaatgagtttccacctgtctttttatgctttgcatctggcagtttcctgcttttggagaaaaaaaaatctgtgacagcatacaggaggaaaaggaacattaaaaatgccataaatacttctagctatttacctaccctgaaatgtgctagatcagttcccttgatgaagacaactttttaaaaaataagtttcctttcaatagataagaagccttctctctgctggccatgcttcccctgcggaagcctgtggtgcagtagctgctgctgagactcctctgccagttgctatggagagcagctgcaggggaggggattcctggagaggcaaagaggtggagaggaagctctcctgtctaaatccagattctccatctgaaaaggttaagcaggagggaaacaatattcaaagatgggtgtgggtttggaggtggggtgtgtatatatgtgtgtgtaagagagagaatatgagaatatgtattattttgatatgtgggttatagctagttttcttggaaaaatccttttctagaatgacataggagaaagtcttgggtagtaaaaccatctggttttacaagaaagtgattacacagattatatcttgtgtttatctttttgttggtggtggtggtaatagtgtatttgctttgttctgttgtttagcaaaaataaagtgcttgtgtcttccaattatatttagctttttctagacaatggagccagctttgttggcctcatgaattctgactcatattttgatgctgaccaaattgcatctgtttttttaatgtgttcaattctatggaaactagttaaacaaataactttataacagagtatatcaggctaagaggaagaaagggattccttaaaagtatgatgtttgggatttacctcaaaacaaagcattagaagttaaaagtagacaacataacatagcagagaaagaggatcaaataaatatataaaatagttataattatctgatggaatttaccttaaaacaacataggagaggagggacggggatggggatttagatgaaactagactgactgggggctgataatgtttggtgcatgggaggcttatgatactacatagaggtttacttaaacctctaataaaaaatcaaaaagtcataaagtaaaaagaagcagttgtacatgtgtctgtcagctcttaaatatggaagaaatcatggtaggcctcaacaaaatgaggctgcaggctagaaaaacattttactaaagggaatatactgacgtttggtgtgggtggttgattggtttggagacgctcactgtcatcagatgtcttatttgtaatgaaaaaatgctggttacacaggagggaaatgatattcaagggtgagtatatggatttgatctagggttaacaggtctctcccattgttgattattttatggcccaagcattagcatcctaatggaacattcctctgatggaacattaatagaggcagagaaactagacaaatgactgtatttcctaaaaccaatgacaaactatccagtgtgggctacagtatatgggttgaacagccaaaatattgcctttcttagcctatcagaaccctctgaagagcacaaggcatatagaaactgccctgagcaactatgtcagtgccatttatagactacaagctatgtatctactgggactcccaaggacccgtactgattatcatttctcatctgattttcccaggcatggccctctgtgttcaatgatacacatattcaagaactcagaagaagcaatcttattagtacttgtcaggggaattctagtgatggaggatggggaggcctcaagacccaagaggccagaccagaagtcagcttatgtcaaaaatatgtactgaaactttgagttcaattttctggctacagggtttggatcgtgatctggtcttatagtcagacctgatatagccaggtctgaacgtatagaccatagtcacacttaggggactgcaaccttgagtttctacagcacattcttgtgctttttatggagttacatgttggttggaagaaaacttgtgcacatgtgtgcttgtgcgcgtgcgtgcgcacgtgcacacacacacacacacacacacacacacacacttacctagacactctctaagtttagcttaaggacctcaccccatttagttagccaagaggacaaaaatatcatctgaagtcttataggggaggggtgcacaaggagcagaagatgataaatggtacagtgaatctccagatggctccctgtagctcccagggtccctcagttgacttatccaggcagatcatgatccaaagtggctgaggtgtccaatttgccactggaacagccactcctcatattaggaaggacagtgtatgagggaggaaaatggtttcatctatttctaccttaaagtctcgctctgaaagctagttaatgcccactaaacagggaaagctgggagagttgtaatatgtggcaggagataccaacagtgacacacagggaccagagagatccatctcagtgtggaccctggcttttaggcaggtaggtaaaatagtgttagaacaagattcttctgatgctgtggtaattagccttattaggaaatgcttatagccccaaacttaaatcttgggtgctggtatatttcaagacgtttctcaaaatgggagatagagggttataccttgtagccattctattttagtcattttcaatcagctcgattcagtcttcttcctatcctttaagttgatcattcacactgcatagcatgttcctttaaccaagaaaccattaggaaagtgaatgaccatttgtgttactttcacaaactatttcaggaagataaattgacatacagaaagagagtttatcccttgtagtgctccaagtatcagatccctgagggtttgtcaaagaattagaccatctcctcagtccctaacatgaatccaccatgaccccatctgcggccagagtggaatggctgcatatgccatggtgacaaggccctagcaagctctatgtgggtgcagcacctctccttccttgtagggtgaaggtctctttgtgggagcttgtggcttttttgagggaagccatgcctctagttctatgatgaaagttctagacctgcactgtccagtatagtagccatacactggctattaaatttaaattttcattaaaacaacacacccttggatgttctttctctccctcaccttttcattctttccagtcccccatacctgttttctgaaattactctccaaaataaactctctacattttaaccatgtatcagactacttttttcaccttctttactctgcttatccattccctggcccctctttcaaaaaaaaaaaatcaaataaacttagagccagaaagacctttagaaaacatttatttccataccttttggctatagataaggacacagaggcccaaagaaagtaatatgcccctgctataaattgtctttcttgtagaaaagatgtgtgaatcaaaagtagagaatcaaaaaataaataaacaataaaggaccccttagcttggcatacagttccaaagtcaagaataagactttattaacagagagaaaagagagctaacctttgacgtggcataaaaggcttaagagttgaaatagagaagtaactgtacaattttgttcaaaaaagaaagttttaaacataaaagatattcagagttttgggtcaactgcatctttctggagagtttagtttcttgttaagtcaatttgtgtattttcattgagcatacatccttaacaaggtttcatacatgctggcactttgagggacagtcaagggacattctgaaagaactcccaatagactggggatcaggagattgaatttcaaattacatttcgtccattaattgactctgtaaacttgaaaaagtcatttcctttctctgggctatgtggaagttcctttttttataaatgacaaatagccttatcatggaatcatagaatattaactttagaggtggtttagagcccatcctcattttgcaggtccaaagaaatgaagtgagtttcgtcagttaatacgatagctcctcctggggaaaaaaaaagaaaaaagaagtgagtttctgcaagttgttgagttagaatcagaccacatactacctgatcctcaatctaggattaatttgacgaatattcctagccatgaaatcttgtgactccatgatcacaagataagacagtatttctgccgtgaaggatcatagccaaattgaggagacacttgatacccataaatagttattatttaagacaaaaaacgagacccagtaagactgacaaccctcacttaaattaaggccattgagagaagcagattgtcaggaaaatccgtgaggttcgagctgagcttttaaaaaattgagtagatggaaaatgtcattatgggtgtatgaaagtagccagagcaagacatggacatgggatcagccaggaggacaatgactgtgtccatctggcaggaggaggtgagatggggttcgcaggttatggtccttggagagaagttcttggtgttgcccttcctcactccttggggcaggtctgaagatatagtgaagggatctgacacacgctttcaagtctgtaacagagaaggaagtagaatgtggaaactatgaccaggagcccttaaagtaattaaatagttaaatagttaaagatgctaatttctgatttgtcctcaagcaattttatttttaaatgacattttaggcataactgatacatggtgttcctggcatcaggatagttagaaaattcaattagtagactaatgaagaacagttcacatttttgctggtagttgtttggaacagattgtttaaataagcataattgtttgtttagaaacaggaatgggtaagccctttatcaagcccaccagcttgataaatttcttattttacataggattggtaaggaagagattcagagtttcatatttgtaattagagaaatgtaattatggtaggaaaatagcagtacatatactttaaagatgaagaaataaggaagcatcaaaataaaagcaatacaagcagtaaaatagaaattgtaaagcaagatgagagaaataagacctaccaacatttatgtcaataaatgtaaatgaattaaagtcctccgctggatgacaaagactttcatttaaaacaaagcatagccatgtgctccattcacctaactcaaatgacacaaaagatttacaaataaagatagagaaaaatcagacaaaaataaaacaaatatatttttaaatcaaaaaaagcaaaagtcagaacaaggtagtagtggcactattaatattggttaaaataaaactccagaggaaaatgctttggatagaggattgttttataaaagttgcaatccacaatgaatgtgtaatgtactataacatagcacagaaatacaaaagcaaaagctatttgaagacaaaaaagtgggataaaatataattgttgtgaaaaacttagcatatcacatttagtctttagtaaattatggaatcaaaattaaataagatttgataaagaaaatgtggtatatagaatgagcagagcaaaatgatcaaatagaaggctctatcaattgttcccccatgcgggaacaccaaatttaataactatctacaccaaaaaacaccttcaaaagaaccaaaaataagatgagcactcacagtacctggttttaccttcatatcgctgaaagagtcattgaagaggataggaaacacagtgctgaatcaccgatggtacccttccctcatcctctgccgggagctgcacggcacggagaaagaatctgttcacttcagtgtgagagtgcaacaattgtgggacagtgtgttgaactcagtgctgccctgtcacaacagaaagcaaaactgggctgaacttagccgacacccacccatcaagggagtatttaaaccagccctagccagagaggaattgcccatcccagtagttggaacttgagttctggcaagctgcaccactgagggctaaaggcctttgggccctaaataaacttgaaaggcagtctaggtcacaaagactccaattcctaggtaagttctggtgctgaactgagctcagaaccagtggactttaaggcgcatgacctactgagacaccagctgggagtgcttatgccacctttcccccaacctaagggttggagatttgcttatcccacccttccccaaaccccagttgcacagctcatggctccaaaaatgaccccttccttccacttgagaataggagagggaagagttaagagaactttgttttgcctcttggataccagctcatcagagtgggatagggcaacagtcagagtatgaggccctctttccagtccctagctcccagttggcattgctagacaccctgggcctgaagggaactcactgcctactaaagagtccttgggctctaaataaccagcagcaatacccaggtactttgccatgggtcttgggtgggactctgagactcactggcttcaagtgagactcagcacattctcaggtgtggtagctatggggagagactacttctgcttgagaaaagtggagggaaaagtaaaagggactttgtctttcatcttgtgtaccagctcagccacagaggggcagagcagcaagggggctcttagggtctctgattccaggccatggctcttggatagcatggctggacctgccttgggccagaggggagcccactgccctgaagggtgagtccccaggccaggcagcattcacaacaagccaactgaagagctcttgggcttaaagtaaatgttggcagtagactggcagtactcccctgtggcctatggtagtagcggctgtgaggtgaggcttctctccctgtggaaaggggaggaaagagtgagaaggactgtgtctcatggtttgagtgccagctcagccacagtacagtagaacaccaggtaggtagacttctgaggtttttgactccagcccctggctcctgggtggcacctctggacccacctggggcctggagaaacttgctgcccagaaggaaaggaaacaaacctggctgacttctccacctgctgatcaaagaaccccaggacctttagcaaatggtagccaggtagtagttatagcaggccttgggtgagatccagtgctgtgcaggctgcaggtcttacccagcacactcccattgatggtagctacaggggcgcttgtgtcatcccactcccagctccaggtggctcaaaacacagtgtgagactccatttatttgggagaagttaagggaacagaacaagagtttctgcctggtaattcagagaattctttcagatcttatccaagaccattaatgcagtacctctatgagtctgtaagaaccacagcgttactgggcttcaggtgtcccctaacgcagatatggcttagatcacaatacctaactccttttgaatatctgaaaagccttcttaagaaggatggttacaaacaagcccacactgtgaagactacaataaatacctaattctttaatgcccagacgtcgaagaacatcaacaagaatcaagatcatataggaaaacatgacctcaccaaatgaacttaaataaggtagaaaggaccaatcctggagaaaaagaaatgtgtgacatttcagacagagaattcaaaatagctgttttgaggaaattcaaagaaattcaagataacacagaggagggattcagaattgtatcagataaattcaacaaacagattgaaataattaaaaacaatcaagcagaaatactggagttgaaaaatgcaattgacatgctgaagaatgtatcagggtcttttaatagcagacttgagcagaagaaagaattggtgagcttgaagacaggctatttaaaaatacacgtcggaggaggcaaaagaaaaaagaacaaaaaacaatgaagcacacttataaggatctagaaaataccctcaaatgggcaaatctaagagttattggccttaaagaggagatggagaaagagatggggtagaaagtttattgaaagggataataacagagaacttcccaaacctagagaaagatatcaatatccaagtacaagaaggttatagaacaccaagcagatataacccaaagaaagctacctcaaggcatttaataattaaactcccaaacgtcaaggataaagaaaggatgctaaaagcagcaagagaaaagaacaacataaaatgaaggtacagtacatctggcagcagacttcttagtggaaaccttacaggccaagagagagtggcatgacatatttaaagtactgaaggaaaaaacttttatcctagaatagtgtatccagtgaaaatatactccaaacctgaagcagaaatagactttcccagacaaacaaaagttaagggatttcatcaacattagatctgtcctacaagaaatgctaaatacagttcttcaatcagaaagaaaatgacattaatgaacaataagacatcatctgaaggtacaaaactcactagtattagtaagtacacagaaaaacagaatactgtaacactataactgtggtgtgtaaactgctcatatcttaaattgaaagactaaaagatgaaccaatcaaaaataataaccacaacaacttttgaagacattgacagcacgataagatataaatagaaacaacaaaaagcttaaaatcaggaggatgaaattaaggcatacaatttttaatagtcttatttttgcttggttatttatgcaaagagtgttgttatcagcttaaaataatgggttataagatagcatttgcaagcctcatggtagcctcaaatcaaaaagctaatggatacacaaaaaatcaaaagcaagaaattaaataataacaccaaagaaaataataacaccaaagaacagaacacaggaaggaagaaaagaaggaagagaagaccacaaaacaaccagggggcaaataacaaaatgacatgagtaacccttacttatcaataataacattgaatgtaaatggactaaactctccaatcaaggacatagagtggctgagtggattaaaaaaaaaaccaagacctaattatcagttgcctataagaaacacacttcacctataaagacaaaaataaactgaaaataaagggatggaaaaagatcttccatgccaatggaaaccaaaaaagtgcagtagctatacttatacaaaatagatttcaagacaaaagctttaagaagagacaaagaaggtcactatataatgataaggagtcaattcagcaagaggatagaataattttaaatatatatacacccaacactggagcacccagatatttaaatcaaagattattaaaactaaagaaagtgaccccaatacaataatagctgggaacttcaacactccactttcagcattggacaaatcttccagacagaaaatcaacaaagagacatcagacttaatatgcactataaaccaaatgaacttaatagatatttacagaatatttcatccagtggctgcagaatacatattcctttcctcaacatatggatcattctaaagaatagaccatgtgtcaggtcacaaaacaagtcttaaaacatccaaaaaattgaaataataccaagtatattctctgaccacaatggaataaagctagaaatcaataacaagaggaatttaggaaactatacaaatgcatagaaataaacattatgcctcctgaatgaccagtgggtcaatgaagaaatcagaaggaaattgaaaattttcttgaaacaaatgataatgaaaacacaatataccaaacctgtatgatacagtgaaagcagtactaagaagaaaatttatagctataagtgcctatatcaaaaaagaagaaaaatgtcaaataaacgacctaatattacatcttaaagaactagaagagcaagaggaaaacaaatccaaaatcagtagaagaaaataagaaagctcagaacagaaataaatgaaatgaaatgaaggaaacaatacaaaagattaatgaaacaaaaagttgtttttttttgaaaaaataaaattgacaaacctttagccagactagctaagaaaaaaagaagacccaaataaaatcagagatgaaaaaggagattacagctgatactgcagaaattcaaaggatcattagtggctatcgtgagcaactatatgtcaataaattggaaaatctagaagaaatagacaaattcctagacacatacagcctaacaagattgaaccatgaagaaatccaaaacttgaacggactaataacaaataacaagagcaaacctttagtaacagttctcctagcaaagaaaagcccagtctctgatgaccaaacatttaaagaacaactaataccaattctactcaaactatttcaaaaaatagaggagagaatacttccgaactcattctataagaccagtatcaccctgataccaaaaccagacagagacacatcaaaaaaaaacaaacaaaaaaactataggccagtatcactaataaatattgatgcaaaaattctcaatagaatattagcaaactgaattcaacaatatattcagaagatcattcatcatgaccaaatgggatttatcccagggatgcaaggataatgcacaaatcaattaatgtaaaacataatattaacagaatgaaggacaaaaaccatatgatcatttcaaatgatgctaaaaaagcattcaacaaaatttaacattcatgataaaaaccctcaaaaaagtgggtatagaaggaacatacctccacataataaaagccatatactacagaccaatcactagtatcatactgaatggggaaaaactaaaagactttcctctaagatctagaacacggcaaggatgcccacttccacattgttattcaacatagcagtggaagtcctatctagagcaatcagacaatagaaataaaggagatccaaattggaaaggaagaagtcaaattatccttgtttgcagatgatatcctatatttggaaaaccctaaagactccatacacaccaaaaaaactattagaactgataaattcaataagttgcaggatacaaaatcaacatacaaaaatcagtagcatttctgtatgccagcagtgaataatctgaaaaggaaatcaagaaagtaatcccatttacattagctacaaataaaataaaatacctaggaattaaccaaagatctctacaatgaaaactataaaacattaatgcaagaaattgaagagaacaccaaaaaatggaaagatataccgtgtctatggattgaaataatattgttaaaatgcccttactacccaatgcaatctacagatttaatgcaatccctatcaaaataccaatgacattcttcacagaaatagtagaaatagtcctaaaacatatgtggaactgcaaagatctagaatagccaaagctatcctaagcaaaaagaacaaaactggaagaatcatattacttgactttaagttatactatggagctataataacctaaactacatgctactgacatagacacataaatcagtggaacagaatagagaacctggagaaaaatccatgcatctacaatgaactcatttttgacaaaggggccaggaacatacattggagaaaagacaatctcttcaataaatggtgctggaaaactggatatccatatgcagaagaatgaaactagacccccatctttcaccatattacaaaaatcaaatcaaaatggatttaaaacctaaatctaagacctcaaactatgaaactactaaaagaaaacattggggaaaccctccaggacattgaactgggcaaaaatttcttgagtaacaccccacaagcacaggcaaccaaagcaaaaagaacaaatgggatcacttcaagttaaaaagcatctgcacagcaaaagaaataattaataaagtgaagagacaacccacagaatgggagaaaatatttgcagactatctatctgacaagggattaataatcaggaaatataaatttcaaacaactccataggaaaaaaatctaataccccaatttaaaaaatgggcaaaatatctgaatgggtatttctcaaaagaagacatacacatgtcaaacaggtatatgaataagacccagtatttgctagtacaaccgggtgactctagtcaaaaataatttaattatacattttaaaaataactaaaagagtataactggattgtttgtaacacaaaggataaatgcttgaggcaggatggatacctcatttaccctgatgtgattattatgcattgcatgtctgtatcaaaatatctcatgtaatccaaaatatatacacccactatataaccacaaaaattaaaaattaaaaaagttaaaaaagaaaatgtggtatatatatatacacacacacacacaatggagtactctgcagccataaaaaatgaaaattcatggcaacacaaataagcctagaggacattatgtaaagtgaagtaagtaaggcacagaaaaataaatactgcatcttcttagtcatgtgggagctaaagttgttggtctcatataagtagagagcagaattgtgattactggagcctgagaagggtggaagtagggagaagagaatagggagaggttggttaagggatacaaaattacactagataggagaaataagatctagtgttattagcactgcagagtgactatagttaacaataatttattgtatattttcaaatagttagaagagaattttgaacgttcccaacacaaagaaatgatagatgtttgagatgatggatatggcaataccctgatttggttattacacattgtatacatgtattgaaatatcattctatagcccataaatatgtgcaattattacatgtcaagaaaaaatgtgcaaaagatacaaagcagcatttcaaaaagatatatgggtggcatgcatataaaaaaagtgcccaagactatttgtccttagagaagaggaaactaaatccaaaatgaaatactgcagcacaactgttagaatggctaaaacattgacagcaacaaatgctggtgagaatgtggagcaacaggaactctaattaattgaggatgggaagaaatgatgatacaatcactttagagacactgtagacgtttcttataaagctgagtatatagatattattcaacctagcaatctcactgtttggtgtttatccaagtaaattgaaaatatatgttctacaaaaacttgcatgtgaatgtttaatagcttacagtagctttattcttaatatctccaaactgttaagaaccaagatgtccttcagcaggtgaatgagtaaacaaactgtggtacaatcatgcagtggaacactattaagcaataaaagagaacaaggttgctgatttgtgcaaagacatgaataaatcttaagtagattttgttaactgaaagaagccagagccaaaaagaaaaggaaactatatggacagaaaatagatcagtgcttgtcagtgattgggggaggagggtcagggtgactaaaaatgggctgtacagtgaaatgttagggtgtataaactcttactagggttgtggatatctgatggtatgcatttaccaaacccttataagatgtttatcacaaacagtgagatttaatatatgcaaaatgaaaaaaaatcaactagatttgagagtccagggttggactgcagactggggaaagtgaatatccagttgacccttgaacaacatacgtttaaactgcataggtctacttatacacaacctttttccaaccaaaccatatcaaaaatatagtagtcacagagtgccatccccctgcactctccatccacagaaaaattgtcttccatgaaaccagtccctggtgccaaaaggttgggaaccactgttacagatgatataatcttcttttcaaatatccatggatcattcattaaaaattattctatactggaccaaaaaattaaaaacccttaaattcaaaaaagtaaaacctctccttagtgcaataaaaactaggattagaaatttaaaaaataaaaaatttaaacaaaaatctcacagctattttggcattaaagcaaacttaccctaaataaatattagatattagaaaaagttaaaaattcaaatatcgattgcacagaaaataacatcagtccaaaaactacatgtcaaaacttatggttgaaaagtgatcacaatatactattttatagaaatacttaaggcataagtaacagaaggaaagaagatgcattagtaataaattctgaatgcaaagcaaaaagatatatatccttccagacaaagctttcatcttttaataaggaagaatgaagataaattacctattaattcagcccaaaaaaaaatcaaaagataacaaaatgaatttaaagaagatatgaagagaaaatggaatataattagaaattagaaaaacaatcacacttatgaattatccagtagttgattgggaacaaaataataaaatgtgcacctttcagtctagtaagggaaaatgtgaatttagtaaggcaaaacaaaaaaatttggtatgagaaaagtatattacagatgaggaaactttaaagcaattgctacactttgtactatactttgtattacatatttagtgtaaaattttcaacaaaattcaaaatctcctaggaaaaaaatcaaccaaaattatataggaagtcagaattataagcatggatggtatttttaagtttttaggttgtcaaagaattattcccaaaaagaagttttttactatttacaagtaggcttttaaaaagaaaagtttaatgaacaagcatttcagatgatatataaagaggcctatgtcactgaaaatatttaaagcttcttggtttgtattatacagctcatgtaaccgagtttccaaagccaaacttgaaaccttaaacacacacacatgcacacccaacaaacttacaaaccagtcttaatcataaataaagatacagcaatctgaaacagttttgtcaaattatatacatcaagatcaaatgaagtttattctaagaatgcaaagatggattgctattaatccatagattgccattaatatagatcatgaggtctaaggagacccagagctagatgaccatgtcaaaatattacagaaaaattatttgataatttttaatatttattcctttaggggaataaaagctctcaattaaatgtagaaagatatgttcttatcctaacaccaatagctcttattatgtgtagtcattatcattaaaaccaggattaaaacaagcatgccttccaccatgattactagataaccgtcaaacaattccagacactcaaataaatgcaatatgatgaaagacaaaaataagagttacaaacttatgaaagtaataccagattattattcaaaggaacattattgttttcctgaaagatcctaacccatgagaactgagacattagcaaaatatatggttacagagttaacatacaaaaaaattaatagctaatgattctattcaaattaagttctgctctgaaaggcaatattgcttgaaaaggaatataaagtttccagtgacaggtgatggagatgttctgcatcttgattagaatgctgattaacagatatataatccacatttaagatatatgaattttgctgtatgcaaattggagtaatacagtatgtagccttttcagactggcttctttcactcagcaatatgtttaaggatcttccacgtctttttgtgctttgataactcatttctttttattgctgaataatatttcatcatacggatgtaccacagtttctgtgttcgttcacctattcaaagacatcttggttgcttctagttgttgacaattatgaataaagtagctataagcattcatgtgtaggattctgtgtgaacttaaattttcaattcatttaggtaaatacctaggagcacaattactagatcatacagtaagactatgattaactttgtaagaaactgccaaactttcttccttggtggctgtaccattttgcattcctgtcagcactgaatgagagttcctgttacttcacttcctcaccagcatttggtattatcagttttgttttgtttttgtttttgtttttgttttggattttagccattctaataggtgtgtagtggtatcccattgttgttttaattgacagttctctaatgacatatgacattgaacatcttttcatatgcttattggctatctgtattatcttcattggtgaggtatctgttcagatctcttgcccaatttttaattgaattttcttatattaaattttaagagagatttgtatattttggattcaagtcctttattgaatgtatgcaattattttcttccagtcgatggcttgtcttttattctttgaatttatcacagcagaagttttaaatttaataaagtccagcttatcatttttttctttcataggctttgctttttgtgttgtatctaaaaactcatgaaacccaaagtcacctaaattttctcctatgttatcttctacaagttctatagttttgcattttacatttaggtctatgacccatgttgagttaatttttgtgaaagatgttagctctttgtctagattcatgttttgcatgtggatgtccagttgtcctggcaccgtttattgaacaaacagtcctttctccattgaattgccttagctcctttgtcaaagatcagttgactttatttgcgtgagtctgtctctggaccctattctgttctgttgatcagtttctctgttctttcatcagtattacactgccttcattactgaacctttatcgtaagtcttgaagttggatagtgtcagtctttcaattttgttctccttcagtattgcattggctattggtcttttgcctttccatataaactttataatcagtttgtcaatatccataaaataacttgctttgggatttttattgagattttgttgaatctgtagatcaagttgggaagaactgacatcttcacaatattgagtcttctcatctgtgaacatagaatatctctccatttctttagaccttctttgatttctttcatcagagttttgccattgtccacatacagatcttgtacatattttgttaaatttatacctaagtgttttctttccttccttttttctttttggtgttagtgtacatagtgttgtgtttttcattttaaattccaattgttcattgatggtatatagaaaaccaactgacttttgtatattaatattgcttattagttccagtattttttgttgttgttgttttttgtcagttctctgagattttctacgttggcaatcatgtcatctgcaaacaaagttttatttattctcaatctgtatacttgtagttccttttcttgctttattgcattagctagggcttccagtgtgacatggaataggagtggtgacaggtaacattcttgtcttgttctttatctatatgtaaattatacctcactaaaataagttaataaaaacgtaatacttcccctatatagcaggagtgactatgtagaatatataaagaaatttttttcataattgcaacagaaaaacttaatatttaaccaacacagaaagaaaactataaagcctcactgcaagaaggagcataaaagaagatttgaattaatgaagagagagatcacattctatctcaaagggagatttaatattgccaggattgcccaaattagttataataaatagccttattgaaatccaaatcaaaattctaataatggaattcttaattaacctatggaaaatgagtccaaagtttatctaaaagtataaacagaaacaagtagtaaagatatttttgaaaaacaagagtaatgaggggggggccagatttgctttaccaaaaatcaaaacatgtcattaagtaatattaatcaaaatattgtattacaaatataagagaacagattagggtaactagatagccctgaaacagtttgtttataacagttttattatatttttaaaatttaaatataataaaggtagcagttcaaaatctgggcaaaggataagtcagtaaatggtattaggagaattaattacttggaaaaaataagttagagcttcatcacacacagtatatcaaggtaaattacaaatggattgaactttttgtctttggtttctcaggaaaccttggggagaagtcttagtatagggcatttagtgttgagtgcactgggagatagagtgaagcggagtggaggcgggcagtccctctaatacatgctaatatgaagagctcagctgactccacaggtagctggggagctgggctagcccatcacagctgtcccaaattgagacaagggcctgtgttccctgacatcaaccaggtgttgaatgtgggatttaccctggaggggcatggtgtagggtgaggcaactccctttggctcagtgagatttctgggagagagattgaacaatgagccatcagcatccaacagtccaagaaattcgggaatgagagcctaagtcttcaagaggggacctgagtggcacacaacatccactacatagtgtagaagatgaaattataaaacaaatagaggaaaatattggtaaatatttccaaaaacaggattgggaaggacttttctttggtcaaaaacaaaacaaaactccatagacaaaacaaaatcaaaggcagacaaactattgggggaaaatattttcagtaaacatgattgttaccaagtttctagccttgacatattaaaaaatactcacaatagatttttaaagactaatattacaggaaaaaagcagacagtgctcttgagcaaaagaaaatatacaggtgagcaataaacttctggaaaagtgttcaatttcattaatagccaaaggaatacaaatataatactatttttcccctttaagttgaccaaaactgaggcctatagagtttaagtaacttcttcaaagtcccatcacaggaacataacagaggaggcattcaaatctagggttgaatgctggtttaatgtggcacaatataaacacatgtaatcaaagcctcattaaatagtaaagggattatttaaaatagtagaccagaagaacaaagaaaacaggagagcaaacacagcaatataatttaagaagttaaaagcacaggcaacaaaagcaaaaatagacaaataggattacatgaaactaataaacatttgcacagcaaaggaaatagcagagtgaagagatggcctaaagaatgggagaaaatatttgcaaattatacatctgacaaggggttaatatccagactatataaggaacttaatagcaaaaaaaaaactaacctgatttttaaatgagcaaaagaccttcacagacatttctcaagataaacaaatggccaacagatacatgaaaaaatgctcattactaaccatgagggaaatacaaatcaaaaccacaatgagataccatctcatccagttaaagtgactattattttaaaagagacaaaagaaaacaagtgccggtgaggatgtggagaaaagaaaacacttgcacactgttggtaggattgtaaactagtacagccattatggaaaacagtatggaagttcctcaaaaaattaaaaatagagctaccacatgatccaccaatcccattactgtatatatatccaaaggaaatcagtatatcaaaagatatctgcactcttagggttattgcagcattattcaaaatagtgaagatatggaatcaacctaagtatccaacaatggatgaataaagacaatgtggtatatgtacacaatggaatactattcagccataaaaatgaaggaaatcctgtcctttgcaacaacatggatcagcttggaggacattatgttaagtgaaataaggcagccacagaaagacaaatactacatgatctcaccactcatatgtggtatctaaaaaaagaaaaagaggtgatatagaagcaaagagtagaacagtgattactagagactgggaggggaggaaggagagaatggggagaggatggttaataggtaaaaggttacaaccaggagaaataggttctagtgttctattgaacagtagggtgactatggttaatagtaaaacattgtgtattactaaatactagaagagaggcttgtgaaggtggttctcaccacaaaaaaaaagatgataaatgcatgaggtaatagatatgctaaataccctgatttgatcattatacaatgtagatattaaccaaaacatcaaattgttctctataaatatgtacaattccaatttgtcaattaaaaaataaaaaccaaaatctagaaaacaaatggagaaagggtaacttccttggaaacctgatgaagttgaatcctaaactaggagtcaggaagacctagaaccaactatagaacctcccaaaaccttaagattcggcagtaattccaggaacccctgggaatgggggtggaggtggaactacaggtcagagaattggttgaatgactatggaaacaccaagcattgtatacaaaaatagggtgtaaaggcagttttacatactgaatgctgagaccctggccctcttcctagcttgctggcaaagtatcagtaaccagagccacaccctccaggcaggagactgaaaggaaagatatgacattgacatccaggattccctaagttatattacaaagcctgtttctttcccaccacaccaggttgtgatattctccaaatcagatttaaagagttgtaaaacaacaatcttgacaattggttttattgaggttgggggtataggtgggagaagaaaacagtacaaaaaggcaccacactgtggtcctagtgtgaccttgcttgcctatgaggactggcctttcgttccagcactgcttttctcaaaccctaaaaaacaggctatgccttggttttcaggttttcagcctgagctgtttgctcctgtgagacctcaaatttatttcacctgtgtgtctggtgggaaggtgctgatcttcaatcacccttacggccctgcttacttcaaactcagcatgtggtaaagagagcatggcctccagggaatattctcccaccggctccttcctctccctgcaacttgcacatcctgggtggcctctccccacttttgtttgccggttttaaaaagttgaggccatagagactgtggaacatgaagcacaggctttttctggaggccctgtcttggtgtcccaggttctcacttgctacattgctctgagcccttgggaaggctgagggaggatgagatgatgatactctaggaaggaggaagacaccctcaggattaataataatcgatcatagcagccatgatggctgtaccagacactgtgagatgcactttcctatattatcacagaagtcttcataagcctctatttcatggatgaggaaagtgaggcacaaagtgatcaagatcacacagctgaaagcactctcctgagccacctggatgtgaactaagtctgtctcattccaaggacatcactctccctaccacctccagttcctctcaggctatgcagctcatcagcagaggacttagtgtgcagctgttattagatcagtgactttcagtcttggcttcacattatatccacttggggagtttttaaaaaccccgttgactccattgagaagcaaggttgagaactacttatcatatacacacacataaccctagaatacaaagttggtatcatcttaaaagctaatgttaacctcattcttaaactttaagattacaccttgggtaatctcatgaccactttgagcatcttatttacaaatttattttcatgtcaagctaacaggcatggtaactaaacaaaaacacagaacatagcttcattgggcttgggaattctagttgctgccatacatgcccatgtgtgatagggagtcataattctgaagagttagaaaacgcaggttcaagtttcaacccttttactagataggaaaaaccaaactgcttttctttgtgctcatactcaacacacaactcttctgacatcaaatgttgggggcagtgggttcccacactagccaattctccaacttccagacaccaactgggtgttctacaatttaactcaatttttatactgtctacctggcaatagcatgagatcccataagttaagagctcagccccacaagactgctcccactttagatgccagtcacaagtccaggttgccacctatgcttttgactgagtggcagtaaatcagaggttcccacaaccccttcctcgggtttaataatttgcttgaacagcttacagaattcaggaaaaccatatgcttagtagcttactgctttattagaaaagaatacaactcaggaacagccagaaagaagacgtgcctagggcaaggtatatgggaggggcacagagcttccatgccctttctgggcatcccaccctcctagcactgttatgtgttcagcaatccagaggctctctgaaccctatcattctgggttttgatggaggcttcattacataggcatgcttggttaaatcactggccattagcaatgaactcaacttctaacccctctcctcctctccccagaggtcaggggttccggctgaaagttccagccctctaatcacttggttggttcccctggcaaccagcccccatctggaggctttccaggagcccccagccaccatcatctcattagcatacaaaaagaagctgtgtgccaagaaaccaggcagagaccaaatatatatttcttattatgtcacaaccacttaaccacctttgtgatcttgaccttgaaatgtctcgtgaaacaaagaagccagcgtgatttttgaacagaagaatgacatgctgggggtggaggagatcctttcccaaatactggaaagctagagacaaagatgttttcagggaagtcagggtattaataatgccacccttatccacacattccaacctccatgaagttgaagctatggagtacaatctaatgctgattctgtcttaagcatcaggagagccttctttgtaagaattccttaaatagaagcatatgcagtatactactggtcttccaaaatggagatttaagttcaagcctgcaagagcagtggcagagcaagaatccagtgtgacttcatattaccataaacgtcttatccatcagggaaatgaatgccaggaggggccccatgacaaggactgctgtatctgcctttgcctgtgtggtcacacgtctctgacccaataaattaggatcttactctaacttgaagtgggtgtatggtctgtctcaactctatatcacctgtatgcttgtagactggcaaagaaagtcctggatttgagattttagttgggggaaagaaaggtggtacaagtgggaggaagtaatcacttcttaaacttacacacatagaggtggtttaggagcctgccaagaacctttttatcttccccaatctttgttcaggctctccctttcagaaaacgaacagtgtgtcttgccgacgattcaatttaatcatacagcctatttgcccaagctttgctttataagcaccaggcaggcacatggtctcttccaaactttgtttcttgacattctggagaagcattagtttgcttgtgtccattgatttgcttgtgtcctttaagcttgcttagcaataaggctgcaggaggcagggtgagcagcatggactttcacaggtggctcttgcttctccctgctgtgtttattccacctctgcttcagctcattttagactcctatttctctattaagccttgacgtcagtttttatgttataaaacttatgtctgtgcctgttctgttataaaccaccttgaagcctttttgaaaaaatgaaagacatacatcacagaccaacattgtcatctcagacctccatgtctgtggtgagagcacgatatacaccacatcaggggtctgctggtaaagctctcagctggggatgttgcctggctggggcacatctggagattcagatcatgtggagccacccaagagacctggccaggcatctgagactctagccacattacaggggcacagaatggtgagctgacatctagaacattgaatcgctcagccccatctccacgggagctttgcagggaagcttgtttgctacagtgagttgtacagaacagaagtattggcatttttatattggattcttgcagcacctctgtgaattagcataagatagaaagaacagaggtttggagtaagacagaccttatccttgagcaggagaaggacacaaggtctgtgacagaagaggttggccatatagcagggtacttttcctgccaccccatcatgcaccccctcccccattaaacagaacccagcaagcccagctcagagaggggcataaggagccaggcagactttttcactggtagcagaagcttgtcacattctactttaaatgtcatataaccatttttttttcaaatggatataaattcctaatttggctttttcctttacacattcctttggcatatgtactaagcacatgtttaaaaaaaaaaaactagctgtagttcacttctgattttcttactttaaaatgatcgtcacttcatactcatgcatatttcattatgtaaaccgtaagatcctttttgaactcatgggaggaagggtaggcaagtgtaaagatacagttttgtgggtcataccaagttcgcacctacaagaattccatagtgagacctatttccacccacgtgacttccagtgcacagatattcagctgggtgtatctaaatgtcactgcacagcatttgtgaatggttataaagaagaaaaatgatacaacatgctgctttgaggccattggttttttcctttttttcttttttgtttttacctcctaaagttcaaaattagaactttgtttaattaaatacacatcttcatctaggcttatgttgttagagaaactcctgtttatcttaatatctctgaaaccaggatgtgtcttatggtctctgtgagccagactcatgacgtagttaccattgcctgtgatgggtgaatattggttgtagttgttcacctcatcatctctccatttgaggcaaatgcatcattggtgctatgtgtatttaactgctgttttaaaagccttcacaaagatttactgtgatttagcattgaaacaaaaagttgttgtgtgtgcagaagggcaagcagaccagcaggccaggaatttgatattcatggaacaaatgtcatcattgtgagaatggtctccattccatattccaaagcaacaaccaagttctacaacggaacaaaggaaagaagacactcacggagcagttgaaactaggtattttgttgctgagatgcttgcaaaaagattggcagttacacactacttactataactgaaggcagcagggatgtatgataaactggttagataagtctaaaggagttctttcaataaggatagaataaagattgtaaatggaagaaaccattgtgacatagtttaattgctagcttttttctttctaactggcacaaaaaaatagtgtatttcttcttacatttgatgaaatatgggacctaaaaaagaagaactaggaagtcctacccacagcaatcagtcaagagaaagaaatatagggcatccaaattggaaaacaggaaatcaaactgtcagtgttctccaatgatatgatcatatatatagaacaccctaaagacttatccaaaaggctcctagatctgtaaacaaattcagcagagtctcaagttacaaaatcaatgtacacaaatcagtagtactgctatacaccaaaaacaaccaagctgagaatcaaatcaagaactcgatcacttttacaacagctgaaaaaaaaagaaaaccctaggaatatacttaaccaaggaggtgaaagatctctacaaggaaaactacaaaacactgctgaaagaaatgacacataacacaaacaaatggattcacatcccatgctcatagatgggaagaatcaatattgtgaaaatgaccagactgccaaaagcaatctacagatacaatgcaattcctgtcaaaataccattataatttttcacagaactagaaaaaacaattctaaaattcatatggaaccaaaaaagagcccacataatcaaagcaatactaagcaaaaagaacagatctggagacatcacattaccaatcttcaaattatactacaaagctacagttaccaaaacagcatggtacttatataaaaacaggcacttagaccaatgggacggaatagagaacccagaaataaaaccaaatacctacagccaactgatctacaaaccatgcaaaaacataaactggggaaaagacaccctatttaataaatggtgctgggaaaactggcaagtcatatgtagaagaatgaaactgaatccctatccctcgccttatacaaaaatcaactcaagatggatcagacttaaatctaagacatgaaactataaaaattctagaagataacgttggaaaatctcttctggacattggcctaggcaaagaatttatgaccaagaacccaaaagcaaatgcaacaaaaacataaataaataggacctaattaaactaaaaagcttctacacagtaaaataggcagtgtaaacagacagtatttgcaaactgtgcatccaacacaggactagtatccagaatctacaaggaacttaaatcagcaagacaaaaccaatcccatcaaaaagtgggcaatggacataaaaagacatttctcaaaagaagatatacaaatggccattaaaaatgaaaaaaatgttcaacattactaatcatcagggaaatgctaattaaaaccgcagtgagatgccaccttactcctgtaagaatggccataatttaaaagtcaaaaatcaatagtcgttggcgtggatgtggtgaaagaacactgttacactgttggtggaaatgtaaattagtaaaaccactatggaaaacagtatggagattccttaaagaactaaaagtagatctatcattctatccagcaatccctctactgggtatctaccaaagaataagaagtcattatatgaaaaagatacgagcacatgcatgtttatagcagcacaattcacaattacagagatatgaaaccaacctaagtgcccaccaaccaacgaatggataaagaaaatgtggtatacatacactatggaacactactcagccataaaaagaaacaaaataatgtgatttgcagcaacttggatggagctggagtccattattccaagtgaagtaacttaggaatgcaaaaccaaatactgtatggtatcacttataagtggcagctaagctatgatgatgcagagacatacagagtgatataatggactttggggactcagagtgtagggggacgttgggaggcgggtgagggataaaagactacatactgggtacagcatacactgctcgggtggcagatgcactaaaatctcagaattcaccactgtagaactcatccatgtaaccaaaaaccacctgtaccccaaaaatactgattaaaaaatatagcttaataatagaaaatgaaaaacaaagacaagctatagtttcttcagataactattgtacctgttgcccagttgttacatgaaaaactcataaaatttactcccagaatcacatatgtctaccacttacctggccacaagctcacttgtcctcagatggttttgacttgggcaacaaaaatttcatggcatctttgaagaaggaagctattaaggagtctatggtcttttttttttttttccttttgagatgaagtcttgctctgtcacccaggctggagtgcagtggtacagtctcaactcactgcaacctctgcctcccaggttcaagcaatcctcctgccttagcctcccaagtagctgggattacaagcgcgaaccactacgcctggctaattttcgtatttttagtagagacggggtttcaccatgttggccagattggtctcgaactcctgacctcatgatccacccaccttagcctcccaaagtcctgggattacaggtgtgagtcaccgtgcctggccaagtctatagtcttacagatggagatgctgaagcccaagcccaaaagcctccattatgtatttattcacatagagcatgagaatgtgctgcacggatgccttcgtccagtgctccaggtggactctctgggcataaaggggaatagaggggaaggagaggaaaagagggtagggaagtggtttctctttgagcagttattcattctgctcttggaagtttttattttctccagcctctgctccaggacaccttccctccaattcactctctcctgtcccttctcccctaacccacagctacttcttttgcttctgttcacttctctcctcccttcccatccctcttctaaactttgtggtggcagattagttggggtggagaaggatatgggagcatgtagggagaaagcaacacaaacaggccttggggaaacactttgaaaacttattgggaaccttccccacctcaacccctgccatctctagatcaggagttggcaaactacagcctgccatctcttcttataaataatgttatattgaaacagccacacccgttcatttacatcagatctgtggtttcaccctacagtggcaaaattgagtactgtaattttggtcaggaccatatccatcaagcctataatgtttactatctgatcatttacagaaagtaaagttgttgactcccataagtgcctccctgagagtattctacagaattctcattctgcaaaatgttaaataggtattgctggcaagaaaattctatagtcaaatcattttggaaaccctgctttttaattccaggacttcttagagtttttaataagttaatgtgcattatgaatttctaagaggttgccatagtttgcagcattttcccaagtttatttgggaacccttttcttacaagtacagagtgatgggtagagctcctgagaacacactttgggaaatggctctttaacaatagccaagatacattgttaagtgagaaaaacaaggtgtgtccaggacacactcatctgtgtgaaaagtaggagagggaaaatgtagctaagtgtttgcttgtgacgttttaattgtgtctggaaaggtccatgaggaactggtaatgctactcaccttcaggcgggttaaagctgggagagagacatcacacagtagttattttctgcatcttgactcttgcattatgccaatatactttattacctaaacaatcaattaatccatctgtcagtcaacataattaaatttttaaaccaaaaggtaaaatagtaaagcacttggaaaacagtttggcagtttttaatcaagttcaatagacacttaccatgtgtcccagagttccatctctaggtattttcccaagataaatgaaaacatgtgtcctcacaaagaacttgtaaacaagtgttcatagcagctttattcataatagccctaaactggaaacaattcagctgtttatcatcagatgaatgaatatacgaattggtcatatccctgtaatggaatactactcaacagttaaaaaaaaaaaaaaaaaaaagcaaaccactgatacctgcagcaaatggataaatttcgcagatgttaggcttggtgaaagccagacacaaaagattctatttaatttcatttttgtaaaaatctagaacacacaaaagaaacctacagtgatagaaagcagatcatttgcttggagtgagggttggggaggagatttaactgtaaagggacacaagggaactttatggagagacagaagtgttctgtgtcttgattatagtagtggctacacaagcgtatacttttgccaaaactcgccaatctgtgcacttaaaatggtgaattttattgtatgtaaatcatacctcaataaagttaattttaaaaagaaaagaaatgtctcttaaaagggaacaatgaaggagtaagggatattcaataattttaaaatggggtcaagcagccctacagttgattgcagaaggttactgtcaccctctaggcatccattctctggaactcccagagaaatacaaatgagcagcccgtaactgcatttgttctttgtccaagccagctgagggatctggtctgaaaactagttctgcagaagcaaagctgcttcacctgattgaaggttcccactcaccatgagtgaggctggtgacctttctcccactttttgtgcgctgtctctgatgatagtccctctgttttctggaaccttgccaattccaagtgtagccccaaagtcattttgggtgtaccacctggtgaaaatgtaagcagcacatcagacctcactgcagccttgaaagattatccccagtgggctatctccagtttacaaaccaactggacttcaaggtaagagacagtgaagaagctatttgactcttagaacacatttcctgattaaaatactattatgaatggtaaaaacaaacaaaaaaatataggctgatctctaaaaggccactagagttctaggacatcacagccctcatgtaacctcaagaccacctggatcctttgttcctattcccacttcaagatcgtgtctcttcatactggacataggaatcaaccttacttgcagacctttaaggataagttgtctttcctatgacacatttttaaaccttgcaatcatttctgcttatagctgtctatctagagtcatatgtaatctagcagacatttctaggcattgcgacagacccactagggattgtagcacatgcattagagtgtggccaagccaggtaaggtgtgactcaaagagcctgcactaagagcaagacagtcctggactgtggctcagctctgctacattccagctgtgaagttttaggcaaattacttaatccatttgtatgtttcctcatctgtaagataactatgatcataatacctagtttaaaaggttatcatgtgggtttaatgaggtagcggaggagttccatttactaatgctgagcaataaaaccaccccaaaaattagcatcttaaaataatgacaccattcattttgtttgaaagtgtgcaatctggaaaatacttagtggggacagcttgtctcggcttccgttggcatcagctgggctgaaatcacctgaagatttgcccactcacatgtctggcagttgctgctgggaagattcacatagctggaggcttggacagctgggactcctaagcatctctctccatctcgtgtggtctctcaagcatggcagcttcagggtagccagatttattacaagttatctttcatgacctgggcttggaactcatggaataacttctgcatagtctcaaaaacctggccatatgaaagaggagggaatgcagacaccacttctcagtaaatagcaacatcacattgtaagaacctatgggatgagatattttggtacagtcatgtttggaaaatataacctggcatagtagaaaactgcttaacacctggaaaaagtaggaccaaataaatgatatgtatttgaccattcctatcaccacccccccacctcactatcacttctataattagcattattagtgctattgccagtaaacctgatgcacctttcaatactgatgatgtgatgcttgcccttcctgctgtggggagatgagggtcacagacccaaggatacttccaggaaatgctgtaacagaaactttgctgcaggcccaaaagttccgcaacataattcgctgtgcatgaagatgatatcattgttatgagcaaagatgcctgcaaatacacaagctgaaaataaaaaggaaactggttgtgggtggggtgaaaaaggcttttgtagaaagatgagtttgttctgaacctgcagcctcctccacagtgatgatgtcccatggagccccttctttccagccctccactcctactcccccagggaaacaaatgtggccagagctaccaaatcctttaattcacaatgtgtcatacccacaccatggtgcaggggcttctttggactcatgtccctctctatgaccctactgaagaccaagggcaaattttgggctttatcagctgtaacgcattcatttggtaggagcccaaaataaaataaaggctataaatacgaagtgcaaaatcatggagttagtgtagaatcttttcctaataggaaaggagctctgcagccacctctaatcctcccctagcttatggtgctctcaggaagcagctctatttagaggctgatccgcttgtcacaagctggctcctgagctcttgctgcttctctcttgcactctctctgaacctgggttgtccatctgccccacatcctgctggtgctagcacaatacaggaaataataaacacaccttttgaggtcacgctttacaaatgcaaattattttcattgagggcacacagtttagatccaatttgttcttggctctctttagattaaaaaggtgcagagggcaggggacccagccgggccagagggtgttgtttccagaaaaagcagcatctaaaggagccaagcagaatgggatggagatgtgctgtaggccacctaactacttttatgtcaaacttactacatgcgtggaccatttctgtgtggccttccctgccctgccttttctccaatactattgtgatgaacaacttggtcttctcctctaactgaattggttagtgatccctctgtactcccttagggaagtacctcttacactttggtcagatccgaatcacctggacacatagcttgctgagcctttccccagtgtttctaattcagtccatctggaacagggacccaacagtctgtagttccaacaaattcccaggtgataccgatgctggttgttcactcttagaatagtttttctggcagtacatatacctttatgatggtatttcttatgttctgcttttcattatttttttttttttgagacaggatcttgctctgtcatccaagctgaagtgcagtagcgtgatcacagttcaccgcagcctcctgggctcaagcgatcctcccacctcagccacctgagtaactgggacgacaggtgcgcaccaccacacccagctaattttttgcatttttttagagacagggttttgctatgttgcccaagctggttttgaacttgtgggctcaagcaatctgcctaccttggcctcccaaagtgctggggttataagcataagcaactgctcccggcctgttattatttttatagcaaagacttaggtcagtactgtccaatagaaatatacaagccacatatataattttaatttgtatagcaaccacatgaattaaagtggaaaattaataattagcccaatatatcaaaaataattcaacatgtaatcaatacaaaaattaatggaatattctaccttgtttcatactaagtctttgaaactgcatatatattaatattttatacttaacggtacacaactacatttagagtgcttaatagccaaatgtggctagtgtctaccatattgggcaaggcagacttaaataatgcttactgtgtaccagacagtggtacagactccttacatgttaactcctttagtcttcacaataatccaatgaggtggctactgttataattctcattttacttgtgaggaaacaggcacaaagagcttaaataacttgtcccaggccactgagctagaaattgggagagagaagtttgaaccttggcagtctggcctcagggtcagccactttaccacaagcctttcctgctcaactacaactccctgaacagtaggaaggaaacattatttctttgtgtgtcccatagcataggcaatgcttagctcagacaggacagccagtaagtgtgtgctggatgaattaaatgagtgagaagaaggtgaagcactgacaagggatttgtcaaacatgttcttccaacaggattaagtgcctccaaccatcactgtatatgactgagaggaaatattttaaaattaaatttgaaatcgcctagtcataatgagcttccaggataatggaaggatgtgagaaaatacataatgacaagaataaaaggcttatataccatctattagagtggcagtcatgattagagtgaccagaacctggaaggagtacatgaaggaagcctacctgaaaggggtaaatccttaaagggatgttaaattggatgaaaggaatactgtggagaaagacatgggaaaggattgacaagaaggaagaattgtctccctcatcatgaacattaattgaaatatcatctgtggcagacctggttcccaggaagcagattaggacctggaaatctgcatacaggaggttttccagaagtactgccagaatcaacaccttcaggaaagtaagagaagccggatcaggcagggggggaagttgggctgcaacacagtcacgccaagtccttacccaaccctacggagaactccagagctgggatggctcttcatagtcttcccaaattgaagcaaggcagctcttttaaggcagctccattccttttacaggaaccagtcattggatactggtttcccaggaaaggcgtgtaaccttgagcaaggcagctttcttaatctgagggcaatagctgaagagaagttcagctgtgtgctattatctggcatccctcctagcagctccggaatgagaacctcattgttgtgggttggggaaggaatctgggtagtggactacagcatccactacatcaacccgatgcaaaatctaaaagaaccaaaaagaggacatcatgataaatggaaagagctagacagaatcccaaccctgccagcttatatgggaaatagatgcaaggccataaagctagtgagtagatttatacctagttttctgtaattctggcatttattttctctccataactcctcaggaaagagaaaagggagggcacaggaaatacacatagggtggtatttatatttatgcgtacctgggtttgttaagagctatggttggggtgagggaggatcagctaagcaaatctcagaggcaaggagccactttctcttactcccgctctctaggacataggggcagctacccttctgttactgaggaaggtgtttctacaagagacaacatccccaagttgggttgtggtgctctgtctccccacttccaagcttagcctggagataagagcctttcaggggatgcacttaagctttcatcttggtcttattttcttgggctcaactcagagtcagggtttgaactatatccccggctggaatgggggccagaccaaaatggaacagccctagagagcctgcctctccagggtcatctgtttgtcatctccaaggtctggtgaagctaggagccctttaatcaggtgatgagctcaccaggagcagaagtaatcaggaataactactaaagaagtttgcagctggcagagtctgcagctgagaatagaaagagggagacagagaagtgggggagtatgaaaaaaacagtaatagacttagttgtgcatcttggctccaccttgaatgtgtgaccttggataaatcttttaacctctctgaactttagttttagggaatgaaacacaccttacaaaagctgcttaagtatcaaatcagtttttgggagtaaagttatttgcagatgtggtaggtgcttaataaatgtgtgttcctcttctgagcataacacagggtaaagtgtttatgcctatggataaactttacaaaatttgccagaattttccctaccagtatgcatcttattgcccatggtggggaatgagatagtagcagctgagatccatggctaagatcaggatactagtttatctgggatacacaaagccacactcagccctcaataaatgtttgttgaatatgtacatgaggacatgaacaaatggtggagtggtgataagagaactcagctttcccttcttccaggaagccttcccaggttcctccagctttcttgggttccgtgacaagcttctacatgtgcaatatgctccacccaatgtgcttctgaattataggccatcttccattgttctctccttgttctttgtatgttgagcttgtctccttggcttgacatggacaaatggtgttattagtttttctaccagaaagccacagtgaatcattcaggtatgcagatccacagatttgtagcccaaaagagaataattaaaaggtggagggtgagtacccttataatcacataggacatgggttaagatttgtccttttctacctcatagggttttgtgaagattaagatgatacagggaaattgattagtacagtgttgtcatgctggacccttgttgacttcagtagtgatggtaccatgttcaacaggctgaaaaagagacctgcagccagcaaatgagacatcaggtttattgaggggactcacatacagaggagtccagtggtgatgagctggatagaactgcatctgctggtaaaaagcatgcagttgatatagcattttcacttagcgccctccccctaacaacctccacctgtcaactttcatttaacccaaaacaaagggcttcagtcccctgtacagcctgcattccatgaaatgggccagaggtttagatgtttcccataagtaaggaatgaatctccagatcggccacttccagatttcttagcttggaattccaagcacacattcttcttagaccatagtgtcattctcaggataggcttaaggtaagccattgctgtcaggtgcagccatacaagtgcctagcacatagtagacactcaataaatagaaatttaacattaatgatggtatcagtattgatattggggagggtggtagatagtggaggagggaaaaggagaagaaagctttttaattcccaagcacgcacagcctggagggctgagtttcagaattcagttgcaaaattcagcttatgcccaaaactcaaattacaccttggggtatggcatcctgccttgaaatgggaaattaggcagtctcacaaggatgcacagctgtgttgcctgagctgtttcgttccaggcaaactggagccggcagtgaacctttggcaactgaggagagcagggccagacagctttgcagccatccaacagaaccaagtgagaataccaagcagctttgcacagtgctccaggagaagccacagggtctcaggagcaggcaggctgtgtgccagagggagcagaccccctccttagacatcagcccttcctcaggtaggcctgcccatcccctcttcctggacacttggccactgtctctgctaaccactagccgctgcctcttctccttcctcctcaacaagttcttttgtgaggggagagaaagtgctgagagatgtcagcatgcctgggaggatgtcaggtcaaaagccccaatgttctttttaggtaagtgattctcaggcatgatcaggccaggacattgtgtctttttccttttctggctttggagaatttgaagctaagggtacacagatgctggtgtgctcaagtcaggtactttaggcaggtcccaggactctccaagaggttccctaggagtcccaaaggtcctgttatgctctctgacgagtgcactggaccagaccccaagccatgggctgcaagctctggggattcagtgcactgggtttataggagccaccactgcaggcctgtcccttgcatctctagggtgtgcctaggtccttcatgaggctgttctattagctgcccccctaacaaaaactcctatttgtcctatttcctgctgctgtcatcacagccttccaaaagcataaaccttgaaccagaaagcaaaagctgagacttgtctctgtaaaatccaaatcttggcagacactctcacaccatcctttagaactctggagagaaatgcaggccagtttgcctaggtaattaggaatggagcttaccatggcgggagcaattgtggaatgagagggtctctgcagcagatcaacaggagttaggttccagctcagctttctcctgcctcactctggcctgtgggatgtgtgtgcatttgatgcagttaatgttaatcacagaagcaagcaaagtaaaaagataaatacatgcactcacacacacacacacaccctgaattggcatgtcacaggactgatgttgtttactgcttgctttcattgacattgtctccaaagaaataaacatctatgattttgtggtaagcattcagctgcaaataactcaaatgtgtggaattattctttcattctcacatggtttcaaaagtattattgtgctcttatgatgtatcagatagtgaactaagctctgaggctccagatggctccgttcaagaactcacagccccatgggagggtataagtttagtttagaaactaaaataagagttatcacctatttaatgtgaggcactgtgtggggctttccaagcatcttaatcgcatattcctaccctaaaagcactctgcacataggcattattttccttctcatacagctgagaaaaacgaagcttaactaatttgcctgaagtctacaactagaaaattacaaagccaagattgaacgcaaatcccactgaccccaagcccatggccctcccactatgccctctaccgaaggtctctgcggggaagagtcacaataggaacaggaacagagtgtctgggagcactgggcagggagccaccatttctacctggggagttgagggaccttgaccttgccaagacaaagagacagtcaagttgggttttggagatgaatacatcatcaccgagcaggaagggagtatgggcagaaattgtgaacgagactggacgtatccgtgtccagcatcgtatgtggcttccacatttaagcaacagggtaatctagccccgtggtactgacaaataagctttgattttcattcagcctgcttggtcaagaaagtagtggctgtttatattacatgggtggtgtttaccctgactccgcagttggaatttgaacaggttaaaaactgtatgttcaggttgttgtctctctgaccatttcacctaactccatactttgaattagaatgtttaaaaagaatcaggaaatatagacagataaagcaagtcttagaattttccctcctctctctaagtggactccaaagcacatcagtaggtaaatttgattagaatctatcaactaggctaaaagagatccaaggatccagaagctggcattaaggcagggagcatctcagcaaccatacccttactttgccacctgcatgcccgcatctgtgggtacatgatctcacaccagggtgctgggaaagatgcctacaagcctcccttcagttatgtccccttctagagcccaccccacggggtagccttcacattgcattgtccctgctgtctgccatccatgcaccattttaaaaatatatttttaaaatttagaagttttaactatacagaaaagttgcaacagtagtgcagagttcctagatgccttgtttctactttcctctgtgattagcatcttatattactgtagtgcatttgtcacagttagtaatatggatacattattattaactgaagtagcactttgttcagactccctttttttttttttttttgcctaatgtcctttttctcttccaggatgtcatctgggataccacattacatttagtcttcatgtccccttacactccccttggctgtgacagctgctcagaccttctttgcttctgaccctttgcagttttgagtactggtcagctattttatagactatccctcaattgggatttgtctgatgtttttcttataactatactgggattataggtttgggaggggaaaactacagagataaagcacctctttcatatcaagggtacatattgtcatcatgacattatcactgtggatgctggccttgaccacctggctgaggtcgtgtctctctggttctctactgtaaagcagggaacagtttttatgagcttcttccttttagtttgggagggtacaaggcagtctggactgatgcatttgtgttctttcccatgatgtcagagagatgttccatgaatattaatgatctttttattttatcagaggctgagttgaccttttcatccatctaatttgactctcatttttgtttatgtgaggcaagtctttgagagaacacttttcgtatgtgagtttatgctcctgtcaccgcaaattgtatttccttctatactattagctccttaaaggaaatggctatgtcctcaatatgcagacaccatataacagcctccagctttattccgtctgtttccccagcccatagtgtgtgtgtgtgtgtgtgtgtgtgtgtgtgtgtgtgtgtgtgtgtgtgtgccaggaagcttcatggccctcctagtatgcatttgttccttatttccctgagggaacctgtggctgttgatcagagaaatcatgatgctgtagaaagagcctggcattgagatgtttcccttctctgagtctggtcaggaaaggaggacagtaaggaaacccaagttaaaatcagcccgttgagctccagcacttaaaagcccttgatgtctcaatccagagtggtcactgaaagagctttgatttcacttctacatggatggtattccagttactgctgctgcctaacaaaccactgcaaaacatagtggcttagatcaataacaatcattcattttgctcataagtctgtagctggggaggagtcacttgtctctgctctccccagactcagctgcatgggctgagtctaagtcagcttgatgggctggaaggtccactttcaagatagctcattcacatggccaacagggttgtattgctatcatctggaagttaggctgaggctgaaggccgtgaacctcagttcctttccacatgggcccctctctgggctgctcagacttcctcgcagcatggcagctggctcccaagagtaagcaccacaagaaaaccaagaagtagccataccaccttttatgatctgaccttagaagtcaggtagcatcactgcagccagtcacaaacccacaaaaaaaaaaaaaaaaaaaaaaaaaacccacccagatttaaaggaaggaacatagaccttacctgtcaacaggagagccaaagtcacatttaggaagagtaagcacattggaatgtactgtggtggtcatttttggaaaacaccagctgccacagatggctagtaagtgatttaggagggtttcttattcttcagcgaatatgtcttgtagcctaggtgctagactagatatgggcatataacatggaatcagacatggtcccagccctggcagcttccacttcagacagggaaacagacaagacactggccatttccattcagagaggtgagagctggagtagagataagcttataggttataagcacacaaggagggattcctaacaacagtttcaaggcccaggaagaattctcagatgagttctaggtgagaaatgtttgtaccaagttgaatcaaatgactaaggcaaaaaagctaaagctgaagattaaaggcagcatagttgcccccaagtgttgctgcatttggggaaagatttgtttttttgtcatggtcatcacagctgttactattattatcttcatcaagcattcctctactcatgtaggacattttcctggatcaaaaatttctcagtttccaggatttcttgggcagtcaggatcagagaaacctgggtttaaatcctggtactgctacatggtggtcattttgacctcagacaaatgactttaaccatatgtgaatgtggagatgatgggggacttgagctgaaaatttgtcattcttccctgtttcttacccctgggaaaaggcctatgcttactctgtgtgggtgtgtgttcacgtgtgtttgttcatatgttttttaggagaccatggtctgtcagccccctagagcttcagcacaaggtgaattcatgttggctgaaggccataggtgtgtctggggcacacaagccctgtctcacatgactttcttgctggaatgtattcaagagattgtactctgggaagcagtttcccaaagtacaagtcatggacctcatcagtctagctgttgaaccagtaatctcagagatgtctgtaatctaccaaacaatggtcccagttagctctaagcagaactttctgtccttcagccttgttatctgaggcatgttcccagcaggattttatagtagggaacattttaaatgtggcaacctgtagtgagggaagcagaaaagatttgcactcaaaactccttggtttcataaagaagtgaagtcacaggcatggattgcctcttaagatcaatcacccagctcaccctgaagtcagtgatacatatttatttttggttaagggaaaccatgctccaaggaattagaagtttatatttgatctttaataaaaggaatcattggagttcagagatggaccatactagaacactggaaccacagtgagtagaaaaagaacactggccaggcacagtggctcacgcctgtaatcccaaaattctgagaggccaaggcaggcagattgcttgaacccaggaggtggagaccagcaacatggcaagaccccatttcaaaaattagctgggcacagtggcgtgtgcctgtagtcccagctactcgggaggctgaggtgggaggatcacttgagcccaggaagtcaaggctgcagtgagctgtgatcacgccactgcactctagcctgggtcacagagtgagaccttgtctcaaaaaaaaaaaaaaaaagaaatttagatagatagatgatagatagatagatagatagatagatagatagatagatagatagatagatagatagatacagtatgagtttggcaccttaatgggattggcaggcaatgagttggcctgagtccctccctgtccctaaccctgtgtgtagctgtgtggccaaggtaaatcatttcactttgttgggcctcagctttctcatctgtaaagtggaggagctgataccagagtcccaacatcccttccaattaaagaacaataatcttgaaattagaaaagcccatttcctggcaaggttgtgtgctgttgctcatgcagaaaacaaactccctgatggtcagacttagtgtgcttagatgctcttttcttttgttgttgaaacatcaattgcagaagctaaattcccaagtgttccagttacctattgataatagaaaccaaaacagtggcttaaagcagtaacaatcatttattttgttcaaaaatcttagggttgaccaggctcagctaggcagctctcatctgggatctcttgggtgattgcagtccagcagtggccagggtcatcttgcaggctcttcactttcatgtccggtgcctggctggggctgggacagctgggtctcctcaggcgttcctgttactctctgcaaggtctctttatgtggccaccttgagggaactggagttcttacggggggccaaagcccccaagagaaacctgtaaaagctgcatgagctttttggctgtagcctcagaagggatgtagggtgtcacttctgcctcattgtattcatcaaggcagtaacaaaggcctacctaggttcaaagggaggggaaacagactctacctcttggtgggaagaatgtcagagaacttgtagacacaatttaaaatcacaccaagagtccaggatggttcagaagacttctcagactgctatgattcgctgttaaaagggtttaaaacagcaatgcacaaaatatcttgcagtagaaaacctagtttaatggggaaggaagatctacttagaagaaacttaaaattatgaaaaaaagataaaattctatttttatgaattttctgtgtaacaaatatgccttgtgtgtatataagcaattttaagagaaagtgtgtatgtatatgtgtgtatatataatttttgttatatatatatatatatatatacacacacacacatatataattttgtggtttttatatacataatttttattctaccaaacaatggagtgtatgagatgttaggattggggaagaggagagaattaaatcaggggcttccagtccttttattgtactactacaagctcccccggttacttgcaaaatgaatttaatttactgggttgttaaaagaacaccaaatatgtcatacagagccctggaatagagatagaaaaaaaacaagacagaagaaaagtcaagagaccaacaatagagaatcagttctccaaagatgtgaatcattgcttttgaatggcagagccccctggggagatgggtagagcagaacaataaatgaaagtagtcgagagcatagactctgcagccaagctgcctaggaacaaattgcagcttgccattccccagctatatgaccatgggcaagttcctgtacctctctgtgcttcttttcctcaattgcaacagggagctaataatactacctgcttcatgaggttgctgtgagaattaaatatgtcagtacaggcttagccctttgagcagtgtatagtacatattagccatttctcttttcatcaattcccttgttgcctttgccagatgcaaatgtcatgcccaatatggactgcaggcagccaaccaaataaacagaaggaggaggacctttccttcccttgggtcctgagctcatgtatgcattggaattttcagtaggaggagaccttcttgtgatgtctggacacccatcaatatgtagattccaccccacaacaattgtccatattcagacacgttttaaaaatcggttccacatttcaagcatgtgaagctaggttttagctttagtctctactacatatttggaattaaagcctctagagtccattatgcaaatccatgcaaataatatgcaaagaggcagtagcctcagattgtggggagggggagtgtgtagtccagcacaaagggccttgaatgaaaatttgcatgtgttagggaagccctgggttgaaggcctcagatgtttattgtgacagtgtgcatagcattcagttgttaaccttttgtgccaaagaagagaggtaaatgcttgtctgatttccatattgaaggtgacagtagaggttggaggtggtatttggctagcacaacattgtagggatttttattatacaaatgaaaagttgctttgaaataatggctgtggtccaggctgtgtccccaaccagcaatgtgttcttggacaagtcacttccctccttctgttgcccactctgtgaaatgaggggattggattaggtgaaatgccagatcccctctcactgtaacatgtaaacatcatcctccaggtaaaaatcccttggcacccacggtggcagtatccgttcattgtgccaaagatgatgtactctaaagtccaaagaagaaagggctaagaggtaactctacagttctagagagaacaataacttcaggggatgctgatagctgagtgggggaaataggcagcagcaacaaagacaaacatatttacttaggctgtgtatcttacagcaccaaggattccagtcaaaggcttcccagctaggaggatgttagttcctggaatgccagtgatgggaaagtcaggggaatttttttccctgagtgttttaaagatcagtctgtattaacccctctctctgcctctggagtgccgcaaaagttctcctagaggccatggtggctcctctcccacctgagggcctgtccctggggtcagccaatgttgcttccaaaagactgctgtgtccttggtctccggtcttttattgtatctgacacatctggtgcctggccccagagattccccgggcccttaattttaactccagctgttgcagcaaacaccagctgggtgcaggcagaacctgacagccctatggcccagaacttctctgatccagctaatggagacctggcgtcagtcaggaagtgcagtgatgagcatcccaggagcagcccttgatcagtgaatatgggagcctctgggtgagtgttcttttcaggcagacaatttgaggtgcagcctactcagctccactgacgtcccctgtgagtttgaggtgcccacctggaccagctcataacctgccctcagattggttttccctgtttcactaatctcagacccccacggctgaccccacagatcattttccagtataaacttcctgcacaaaagccctgtctctgtctctcctttttcagaggatctcttaacataaggcatgtgtattagtttgctagggcttccataacacaataccacagacagaaatgtacttcctcacatttgaggaggatggaagtctaaattcaaggcgccaatagggttggagtcccccgagtcctctctccttggcttgcagatggcgtcctctagctgccgtgtcctcacatgatcatccctctgtgcacacgtgctccagatgtctgtgtgtcctaatctcctcttcttaagaaggacaccagtcagatcgaattagggcccactcttttggcctcattttactttaattacctctttgaaagccctatctccaaatatagtcacattctaaggtactgggaattagggattcaacatagggattttgggggtgcataagtcagtccttaacaacacttaacacttgtgagctaaacagacacttgaaagggaatgtccatcaaaacatggaggtcaccaccactagccctaggaatagattgtctctctggtgttaagctgtgggcaggataggggcaccagaataaccctgagcaggtcagagcataacagcacattaattcttctgggatgcaacatactgtcctcttcttcctccttctgcatcattgatagtggttgaccaggataagcatgcactttaaagacaacccttgtttcacatacttctgctactgtgtgactttccacatgttgcctaatctccccaaacctcaatttcatgctccaccaagtggtcatatggattaaagcatgaaagcctgggccagggcaagtgttcagtaaacaggttttaggattgactcgaatacacagaatgtgctgtcggtgtgtggtctagatcaggggtccccaaccactgggtcacagaccagtaccagtctgtggcctgttaggaaccaggctgcaccacaagaggtgggaggccggtgagccagcatcaccaccggagcatcaccgccagagcgttactgccagagctctgcctcctgtcaggtcagcggcaccattagattctcataggagcacaaaccctattgtgaactgcacatgcaagggatggatctggttgcgtgctcctgatgagaattgaatgcctgctgatctgaggtggaagagtttcatcccaaaaccataccccccccgaccaactccagtccatggaaaaactgtcttccacaaaaccaagtggaagacaatttgtccctggtgccaaaaaggttggggaccgctagtctagatcatgaatgaaagtttagaaaaaaatagattgtttagggcaaatttttggtcctagagttggtgggtgctacagcctcagtgcaatctaaagtcccccgcagcctcccactccccaccaatttagaagtgcagggtgaggacacaggcccatgcccaggctccaccacacaccaaacggtgatcctgggccttgtgtcaaaggcatgcctggagatctcctccccatctctgcttctcgccagggccctgccttctccatcagacacctgggaatcacagctggggcccctgctttggccgtttgtcctgctggaatctgatggaggaaagacgctctgagagagtaattagacgcagacagagatctctctccatagtcagaggagcctagcaggggctgaaggaactgcctgaggatgacaaagaaggggatccatgaacaaggaggtgctaacaggtcagaatcaggcctcagaggactgttggcccttcctcagccgtagagacaggctcttcccaacccatgtgttgtcaacggctcctacatgtcatgcttgcatgaggtaccatttttaaaaataggcacatgctattgtgattgataaaatccacacataactagaaatgtttttaaacatatacgtttttgtccttgtgcattttcttgaactgcaagtatgcacattggctatcatacaaaatcctttttttttttttttttttaatgttcaaaagggctccttctactcaaaaaggctggatatcaccaatgacaatttttcagagttcagccacatgaatgccataggaaaagcagttaataacaaccatgacaccagccggcatttgtagaaggcaccttctgttccaggctgtgctaagtgcttttatgggctccaggtctggttgctcttctctagaccccggtcctcttctgcctgtcactcttctatggcactgagacatctttgtcttattttaggattgtttgtggatatgtgcgagcttatccagggccagagactgccctgttcgtttttgtgtcctccagggtcagggagagggttgaacctccataattgtttggcgaatggtcctgaagggacagaggtctgtttgcttgtacctttgtgtagtttataaatggaagattcagaaaagggcataagagttggtacatactgccacccaggccttcctcatttggcttggggtggctcacacagagttcacacaggcttccccacaggcaagctgtccttgaccactcctggctgcagaggaagaggcagatgtggaggccacaagccttctacacctccagccccagcctgttctgaaaagttgcccttgtggggagggctgatggcgtttctgaggcatgtgggaaaggaggagcctggccagggtagctgctctgcttcccctggtgctggtctctctttccagcaggtaccaggcagcacctacctaatagacctgccccagctccacagacagttctggttcagtgtaggagcactagtgtgggctcaggaatgctcctgacgtttcctgagttcccagcactgtcctaggccacaggtaagaaaggcccaggctgtatgctgctccccaagtattttacctcttctctctgtctccttttcaaggtttcctgctgatcttggcactgaccgaagcgctggcatttgccatccaggaaccatctcccagggaatctcttcaggtcctcccttcaggcactcccccgggaaccatggtgacagcaccccacagctctaccagacatacttctgtggtgatgctgacccccaatcccgatggacccccctcacaggctgcagctcccatggcaacaccgacaccccgtgcagaggggcaccctcctacgcacaccatctccaccatcgctgcgacagtaaccgccccccattctgaaagctccctgtccacagggcccgctccagcagccatggcaaccacatcctccaagccagagggccgccctcgagggcaggctgcccccaccatcctgctgacaaagccaccgggggccaccagccgccccaccacagcgcccccccgcactaccacacgcaggccccccaggcccccaggctcttcccgaaaaggggctggtaattcatcacgccctgtcccgcctgcacctggtggccactccaggagtaaagaaggacagcgaggacgaaatccaagctccacacctctggggcagaagcggcccctggggaaaatctttcagatctacaagggcaacttcacagggtctgtggaaccggagccctctaccctcacccccaggaccccactctggggctactcctcttcaccacagccccagacagtggctgcgaccacagtgcccagcaatacctcatgggcacccaccaccacctccctggggcctgcaaaggacaagccaggccttcgcagagcagcccaggggggtggttctaccttcaccagccaaggagggacaccagatgccacagcagcctcaggtgcccctgtcagtccacaagctgccccagtgccttctcagcgcccccaccacggtgacccacaggatggccccagccatagtgactcttggcttactgttacccctggcaccagcagacctctgtctaccagctctggggtcttcacggctgccacggggcccaccccagctgccttcgataccagtgtctcagccccttcccaggggattcctcagggagcatccacaaccccacaagctccaacccatccctccagggtctcagaaagcactatttctggagccaaggaggagactgtggccaccctcaccatgaccgaccgggtgcccagtcctctctccacagtggtatccacagccacaggcaatttcctcaaccgcctggtccccgccgggacctggaagcctgggacagcagggaacatctcccatgtggccgagggggacaaaccgcagcacagagccaccatctgcctgagcaagatggatatcgcctgggtgatcctggccatcagcgtgcccatctcctcctgctgtaagtgccgccctctcccacccatcctctccctctaccacatcactggctcaaccccagcattcctttgtccctgatttggcatccttgccaagtgggctacaaaaattcccagaatctcaggaaactaggtatcaggacaggttatccctgaccctagtcctcagctctgcctggccatggcttgaatgcctgctgatcataaagtcacaactcccaggagctgggggaggaccttacaggcagtctaatccaaccctgcattttgcagaaaaaaaatgccaagctagcagtgacatggttcacccaggatcccagaattagtgagaggcagggctgggctgagagcttgtagcagctgtcttccagcccagtgcccttgtcatgacaccactctgcctcaaggtagcctgccaatgcctctagcaacctggcaccaagacaccgtaggtcaatgtcgatgcttcaaaatttacagcctccaactagcaaacccctcaccttcctctttatcttccatcctctttcttgtgttttctctcctcctgcccctcttctctccttctgtctctcttctcctaagaaagaaaaagagataaagctttcatctggtgggaagttctatagctttggcaaaaacctagttcttgcagctaaattaaggcttgagagttacgtaaactctagcaactctccacccccaccccactttatttgttcgtaggtgatgtgagctgattgcattgtggaccttgtccttagtttttgccctcccaaggccaccagcttctccttgctgctgcctggcactctgtgaatgaggagtcaggaggcattctctctgtattctccataaagaatctggtacaacctctcagaactttagggatttcattatgtcttccctcatgtacttgagctttgattcttatgattcttagagtttctctgatagccttgcaggaatcctcagccacaccccaccccaaatggttaccatctgccactcccttaccccttccagggatggccacactgccccaccctcatatccccgctccttggacagcccattctcctctgaccctccaggttgttgtccagctctcctgggggcctaaagtttgccttcttgtgattcccactctatggccctaagctgtgccatctgaagccatacaactctagtttgtctagcaacgtctgaaacatttgaaacagctctgaaaggcagccttctcttcatccaagctgctcagccccggcccttcaagtcttctttgtagggctgcattgcctgggcctgtctcccatctgccccctctggggtagcttctgctttgtctcccaaaaggaagcacagcattccacctgtgtctggctacggaagagggagccgatggtggactctttctttagtagcactcaggcagccagcactggcatcagctctgctggttgtattggcttcaggtcatacataggcttgccctgatctcaagaggaacaaagccccgaaggcttccctcagggaaggctgctgagccaggtctcccagcttttcctcctgctctgggttgttagtgcaggaggtttatgcctttaatgcgaaccatgatttccacttggccttgtgttgcaagatctttttatatccggagtctagattcttttcaggagccgcctctcatagctttcggtctccttcaggttgatgagcaaagtaaactttccatgtcagggctgggcaaactgcttctgctgaaggacccaattcaagaaaagtaaaagtgtttgcaagttgcatatttcattcttaatgaaaacagctttattgtctctcatgaaaacacacatttacacatttattcttaaaactgcagttgcccacttctaaaacagaagaatgatcatgagaaaatgtagccctattagccaatgaattcttaataatggttggtcatatctgagaagtaactacagtagagacagctttctaattttccaatctttacatgtgtctaggatgctctcgtttacaaagtgcattccgttatttttttatcattccatcttagaccagccagagacataaaagcaggaacaagcaaacacactgctaaacacacaggtgccacagtgactccagctgtcctccacaccttacaggtagggagtgagtcaccaggtgaagtgattgacccaaggtcctgaccacacagtgagtcagcctagatctggtaatacaaaatctgtttgattcagtgcaggatttcctgtgtgcccattgtgtgccagacactgtgccgagcattagggaatctgagatatgggcctccctctttgagctggatagcctgcaccccacaggctacacccacctggattttgcaattctaaaagaactcctacttctcccccagcccttctgttatgtataagcttgaaattagatcagatcttattgcaaagctggaaagcccatgggctgcctaaaccatgcataaaaatgtcagccaagacaggaggaaggacacagcctgggactgtcccttgaggattcttctggcaccctgaaaggagccttcaggtgctggagatggaacatattactttctaaagaaagacacaaacttttaataaaagtggactctggtagccccttgggaaccgcacaccccactccctttgatgtctgtcttgcgtttccactatacacaaggaggctcttgccttggccctgactgcctccacatcagctccatgtcctcagtcatggccccaactcctgcgggaccatcgttaaccctgtgaaggctccagtgagagggccattaaggtggaagaatatttgtccagcttcagaaccctgtgctctcaggaactatcctcatctatttggactgttttcatagcccagcaccactctagttatcaggaaagcagacctcttccacgtctaagggccccttgttttggaccttctcagtggcttcatttatcttaaagctactctacagacctcaaagaagggtttcatcctttgccagtttgccagatatttcaggcactctgagtcaggagtaaagtgcatgcatcagtttcctctcatctggcatttcataccagcactggcccctaccttgcttctctgaagccaccagagtcagaattcagatgggcggggtgctgggcagcggtgatcctctgctcctggtagaagtgggagttgagtaaggcagatcccaggcctgtgcaaggagggagggtgtccgttcacctgccctcccagattgcaagccacaaccagtgcctggaggcatatatgtgtcccggggctgagaaatgcttttctctcctgagccctgccagacactctaagccacgcacgttttcagaagtgctgagaactgaaattgattggattcaggccataatgggctagggcagaggagccaggtggctcccaagctggtctctgctgccaccatcaggacgcacagagcccaccactcttgccagaagcctccacgcctggcgctgaattggtcggcgctcaccattgtcagcggtctgagttttcatgagcgtgtcagttttgtggctctgtcagggtcctttgcctgtttgtcacatgtgatgtccatttttgaaaatgccttcacccatcctccctgcaagaagatggggctgtttggagggtgagattagaaaaatagactagctgcagatgtttgtcatcaccaactcaagttcaccctggccaaagtggagtagcccctctctctctgacactagacacttgagggcaccctctgcacctggtccccagagcagtctggcctccttctagacagtggagcattagtgcagcattcaaagaggtcacataccattgtgctgatggttgctcagtgaatattagacctgaatgtatatgtgtgccttttcactcacaggccctgaatgagtttataattattatataagaaaacccgggtgagaatgactcttgccaatgaaaagagtagaagagattgggatcagaaggcattatggctgggaaacatgtctccttggagcttacggatcaaacagggatgggagagcctcaaggcaatgcagggatatccagggaatgtcccccagctgttccagtgttagacccataccctgacagctcttccctgtgcatcccagccagcacctccaggcagcactcagtcctcacttcatggcttctccccaagagggccgtgggcttctacaggcacattcccgcctgccaggctggtgggtcagacactaagccccccagcctgacctccctccataccctgaggcctccctgtgacctcctccctcagcctccaaaggagggaaatggctgtgcacagcccaggtgcacccctcccactggcacccatgggcgaatcctttccctcactggtctcaggtttctcatcgacaaaacaaaggggccaaactgaaatgtgtcatcactccctgtcctcacagttaagcctgcatagatcattagagaggaagcctagtatgcttctaagacttggcttgtggaatcaaacatacctgcacacaaccccagctcttaacatttgttggctgtaggacttacacaagtaacttcatcattgatccagtgtctgtctgcaaaatgggactcctgtccactgtgttagttccttcgagatgcaggcaccaagatgggattaggcatataagagaattattgggggaaacacctgtaaaatgttcaggaaggaactgaagtaggcagaggaagccccagactgcagtgcaggcctgacccccatgaaaggagagggagaaggaaagagaattcagtaggaagagtcttagactacagtgttgttctaagaaagtttctgccagccagtgggagtccttaagccattagaggggttccatgtccagcaggaacaggcctgcactagtacccctgtcatggtcaatcatggctgaccagggcattttcatggctgcaacctcgaagacttgtaaaatcagagatgatgcatgttaggtcttatcttagcatctgccatggagaaggtactcaataaatggcagtgatcaaacagtgatgattattcatcttattgtttttaagatttgcaatgcctgctcaaacaggcccgggaaagagcaattcaatagttgtttgaaaggttgaatcctcaggggacctgcagggtttcatttccatttctcatcacacagcagatcctatcacctgaaagcatgcccttccacaaatgtgaatacagtactcagggctccatctgaaaatggagtgacccctcttcttcctgtcacacatctgacaagccatggatgactccccagtgacattcctgggaacccaagagagcttaattcccaactctgttttaaaactcaaggaaattgggactccatgacctcctccagagtcttgatggctactgcctcaggagaaacagagcagttgaagcttttcaactaaatgggaaagggaacagttaacatcttgtgtttgcatagagctgcgcagtttacaaaacgcttctgcatatgtcatctctataccctccggtgttcaggacaatacaggatagtggatatcaacttgaagatcatcaagacctggactcaagttgcagtaattagttgggtgatcaagatcaatactattagcttctatgaccttcagttacctgttctgaaaatgggaagagcaatagtgccttcctcaggcagttatcatgtgggctaaataagcttcaaagtgcctgggtcagtgctgggaatatagtagagaccctgtaagtctgacttgtacttttctttcttggatgaaaggtgagaccactgaaatagtgaatgttctaacccctaggtggagctttgtccttgagccacccaatagtcatataacacagtttttctttctagatctctcttgtagaggatgttgggagaacaagaagagaactgtcattaattaagcatccattgtgtgtcaggcattgtgtttggcattttgcatccatgatctctttaattctcattacaagcctatgaagttcatcttaagtgactttccaggtggaatacatggcagagtcacaatttgaacctaggtctttctgtagccaggctggctttcagtaagtaaatgaaatggtgtttgagaagcactggaaactccctgagagaaatataatcaggccaggagcatgaacatgtgaggggaagacagcgtggagcagaactttctgttctgactcccaggccttcccgcagggcaggatctctgcatctggcattctaacaacatgggctgttagagcactggactcgggggcggaggacttggattctgcaacctctaccagcccaggttagcagcatggccttgagcaagttcacctctctaggtttccatgccccaccttctagaataagaatgtaggctgggggaaggggctgatttgtttcagcacctactgtgcaccagggacaatttgaagtgctggcagatgtatgactgcatttaatcttcccaaggaagctgacgctgagagaggttaagtaacttactcaagtcatgcaagtaatagattgtcacctagattctaattctaaattcgatgtcccttttgccctattgactaggcctaagatggcatctgtcactttgattctgtttgcttataactgctcagtagatcagaggcacaaatatctttctaccttagagaggcgtgcaaactatacaaatctgactcacagatacacttttcccctgccagcctgtgttctgtgtctatggcagtgttttgtggggcatgatgggatgtgcccctacaggctgataactgaagagctgttctgtttgtcctgattgctcccctccctctagctctaactctaccaaaactgagctggagctgaggaaacagcacttttcccacttcccagatggttccctctttatggcttctgtcacaccagctagaactcctccaggtgtttcaccatgccagctgcaggagcagagtgaaaggtagtgacaatgaagaacagagacaccagagaaggggacaggggacccgggatcttgtcccagctctgccactcacatacctgtgacctgtggcaaggcggccagcactttaggccacagtttttcctctagaataaggaggcggcctgaattagcaagtttcaggctgagcaccacagccccctccttgcccctttcctcttcaaccatctgaagaaagggttttttggaaggaagggagggaaagaggaaagagatccacaatatttgaaaagttctgtaccagctaatctctcaaatccccgttagccctaacactcagaaattccttctatgttttaaagattttttaaaaaggatctagaagactgaaaagcaaattagaagtctttttgatcaaagcagataagataaagtagaaacttaccctatctcctaaccttgtacagagacctttccaggttgagaggccagcaaggctggcagctggaaagaaagctacagaattccccaggcagcctacagggccctgggctctgggctgtgaggtctcagcctatacaggtgccagcttgtgcaactgccccacaccctggcatgaacccacccctgatgctggccagaccctcaggctgctgcgaacagagctggccctctgccaacccccggtgctggcctctctggacagcccagcctgggaccccgactccccagcacagagatggttggcaccaccaggatgtcagatgtggctcttggcttcagctctcctcatccccagaggctctggtgatgatgaacctggggcaggatatactcagtcctcacttcatggcttctccccaagaggcctctgtcacccttgtccttgtgttacccttctgcagtgtgaatctggacaggccaccccacctctctgacctcagaagccttccctgctcacaagccactcaattcacacatggttaatcaacaatatcgagacataattcttcctcctgggccctgggagtctcagggatgaacagacagggtcacatgtcacactgtgctcagtcaagctgtgtggagcccacctcaggccatctgtgcaggtgggcttttgcatcaatctaaggcaggaatcagctggtaagagcatagactggccaggtgcagtggctcacacctgtaatcaatcccagcactttaggaggctgaggcaggcggattacctgaggtcaggagttcgagaccagcctaaccaacatggcaaaaccctgtctctactaaaaatacaaaaattagccagacatggtggcaggcacctgtaatatcccagcttcttgggaggctgaggcaggagaatcgcttgatcccaggaggcagaggttgcagtgagccaagattgcgccactgcactccagcctgggcaacggagctagactccatcaaaaaaaaaaaaaaaaagaaaaaaaaaaaccatagactttggagtccagatgtctgggtttgcttttgggcctatcactttacctctctgagcttcagttttcctatctgtaaaatggggatcctaacagtactgactttatggggctaaatagaggattaaatgaatatttctatgtccttggaaccatgcctgggacgtaagtcctatataactattaacacaggattttttgatgatgatgatgatgatgatagtaccagaaaagctattttatcagcattcaagacttctgccccgtgattttgctctgtgaacttctgctgtaaaggtcttctgtggaattaaggctcactttgtacagttcaccatgccctgccccttttcccaccatacacttactccagctgggaactctcctcatcagttcggtggtgcaacccaggcaccatccttgctgcctccctctcctctctgacttgcactctctccatagctgtcctgctgacggtgtgctgcatgaagaggaagaagaagaccgccaacccggagaacaacctgagctactggaacaacaccatcaccatggactacttcaacaggcatgctgtggagctgcccagggagatccagtcccttgaaacctctgaggtaatgagcttgaaagtgctggccccactgcagggaaaccaggtccaaagagagccatggggcatctgctcatttctgagtgccttgctccttaacgtatggcccatggaccagcagtatcaataacacccaagaggttgtaggccctaccctggtcctactgagccaggatctgtgttttagcaagaatccccaggtgctttctgcacagtaaattttggaagcactgttcctgggacttttggtttctgggaacaagtgaacaaatactcagtgaggacctgttttgtgccgagcactcccagggcactatgaagatgagagcttgctcctaaggggctcaggttctgagatgtggctggaggacaaaccccaacatcacccaaaaacaaagccaattaggggaaacacaaacacagacgagttatagacaaagagctgtggaaacccaaggaggaaagccttcccagtgcagatgctaggaaggattaatggatttcaacaggcattccagcagaggaggtagcctgaggaaaggtgaggatacgtgctggatctgaagggaaagaagaatacactgtcagcatatttgcccaagacacctggctggtcagtgagtgagctgagctttgaacccaggactttaaccacagaatccatactctttccatcctcacacggagggtggcgtagaggccagagtgaaacagtaaagaaggataaaggcccaattagacacagccttaatggggtattatggcattgggactctagtttggggcagcagagagtcactgaaagttttgatctttgggtgacccagttttagaaggattatgctgatggcctggtgaaagcaccctatatgtgatcagcgaatggataaggaaagaaaataatggcttgatggatgagtaaatagatggaatgacacagaaagacagactaaaaataggtagctcaactaggatgcaattgagatggcccaggagaaagataacagacatctgagtaaggcagtgagagctgagaagagttcttgtggaggtgcaaccccacccctccttcccgtgtgggtcccttccccagagcagccaaggtgagcttttgtaaacataactgtggtcacatcgctcacatgcttaaaaccttctcatttctctccagttaaagttcaaagtcttgtataggacctgcaaggtagacctagacccaggccaactttccagcctcacatcacacccctctccccatcttttgctaagctccagccacactggatttctttttgttccttcacagcaccaggttacatcacacccactccaggtgtgtgcatgggctgtcgcctctcctacaacatcttcaggctctccccagcacccccttcacttgctcacctcagtgactccaacccatcctgctgcagggcccagtctaaatgtcacttcctcagcgaggccttccttaacctgccaggctgggttcagctctcctgtcacgtggtcttagctccctgtgctttttcattgtgaccctttttagagctgtgatatgctactggtctgatattagtttagtacccctctcccctacttgagtaaccagttgcttccacatcgctaaacccagcagccaattccgagcactcatcctactccatctgtgcagcactggcactgtcacatggcagcagaggccctgccttctcaggctctcccccagctcccattactgattccctgtcctttccccaacctctattcactggagcgccccatctcggtcctgccaccacttctcttcttttttttttttttggttgttgttttgtttttgttttttgagatgaagtctcaactccgttgcccagactggagtgcagtggtgtgatctcagctcactgcagcctctgcctcccaggttcaagtgattctcctgcctcagcctcccaagtagctgggactacaagcacacgcgaccacgcccggctaatttttgtgtttttagtagagacagggtttcgctatgttggccaggctggtctcgacctcctcacctcaagtgacccgcccacctcagcctcccaaagtgctgggattataggcgtgagccactgcccccagtcacttctattctctttctacttagtcccatgacttaaataccatctctgcactagagagtccagatttctacctgtaaccttaatgtctcccctggccccagactcacctacccagctacctgctgcacatgtctaataggcacctcaaactcaacacacccaagattgaacccttgatttcgccctcccaaccccaaaacccaaacctcacatgcagctcctgattacgtagatggtactgccagctgcctttccttcctgcacaccccacttctagtctgtcagaaaatttcattggttctccctaaggaccagcacctctcattgcctgcacctctgcccctgatccaagccagtctcctccctcgcaccatgagtgctgcaatggcctctaaattaggactccccactaccatcttgccttctgcagtctgccctctgcacaagagccagatgatcttttcaaggcaggatcccatgtccgccacagcttccactttcaagtggctcttctctacattttgaataaaatccagactcccattctcatgcccttcacaagttggcccctgcccaccacctgagcccccaccacacttcccattgatcacacaccagcttcagtggcctctttgctcttcctcctgcacaggaagcttgcccccaccttagagcttcgttcttgcaccctatctgaaatgcttttctcctggataccttgaaccctcaattccttcaggtctctgttcaaatgccacctcctctgggaggccctccctcccttaccactctgtattaattaaatctccaacctcattctgtttcctcttccttactttacttgtcttcagagctcttctcaccacttgacattgcatcattgtctctctgttgattggtttgtggtctggctgtcctgctgcctgaggcaggagcattgtttgttgtgctcactgctctattcccagcacctggagcagtgcctggcacatggtaggttcttagtaaatgtttatcatgtgaatgaactataaatgttgttcaccacaatttacccatcacccagtcagagcctaacacacagtaaatgcccaagaaaaatttttaagcagaggacaaacgaggggccagcttcactgcagcattgacctttagtgtggcctgtacacattttgcatggaaaaggtgttcctgagatctgttgtagtaagtggaaaaaaatatgtaacttgacaaaggggctggtcctactttaggtatgggctgtgaacccctgaactttaaatttctcatattctctttgcaaattggtaaatgaaaaccaaagccaaaggacaatactcgtgaacgcactatagaaaaggcccttgcttttagaacatcccagttagtcatttggcacagagcacgagggctgccgtccaacacaatccagaggctctggtagaaagggctgccccagccagtcgtgatcttcagaccaggagggcgccataggacctgcagcacaaagctcagcttggcttcagagtggattggattttgctgtttccctcccagcaagccgttcctcttgttctgctttatttagagtaatattacaatttgttccaattctctgggctcacactatatgagggtaaatgcaggcagcctagggccaggatgaagccagccaagcacacacacactgctgaccatctctagagcaatcataaggtcccagttcatattccaccatgttccacatcctcaggacatgtactcaccacctgccctttagctgctaactttggagactgccaaatggtttgcctaagcaagttcctcagttgccctgcccccactgctgtgttgatgcaagcagcaaaacacagatccagggctgtacagacaaaattgtgatgcccaacaagtgcttggaaacttccattcttttttctttttcccacctcctcctcctccttctccctgttttctcttcttccttcttttctccctccttctctcctcccttcttttttcttctcctttgctttggttgtttcctgaataactctctctttaatgcagcaaaacatacccacatggttttgcctttggtgaagacttgctttgtgaaagctataaaatgacaagccaagctcagcctccacagttaaacccaaaagcatggtggaggaaagggatttttgtctcctctttgaagtgctccactattttccttagatggctggccccatatccacccttagataggtgttgaactaattccagacactgaaggaaattcttgtcttctgaaaagacattttatcaacaatggcatttcttccttaccttatgattcatacagcagtaagtactcctcagaaagtatctgttatgtatgttttgtttaaaaataaacttcagagaattaattgtggctaagcaaatctggcatgagccagtatacctaggcctatagttgagtctttgtcctgaaatggcttgaaggttccaagacattagctgttttaattggaagaagctatgactttctttttttctctctcttaattagtaccagggcccaaatccaagtacagccatttagtagcccgtaaatgtttgcttgtccttggtaagtgaaaccaaaaccctgccaaagccatacagattaccttctgggcagtggatggcctatttctaggcttttctgctcctgcaactgaacatacagactgaaattttcatctgtcacttattatgcagtcacacagagatgcagatccattcagctcagcatcactagtgctataagaaatggggcaataattctgaccaggctctggaaggactcagagcgggaaggaattggcccttgaagcctcttgacaggtctgttagatcctgacaggtgggtagcaggaaacaggcgagtgagtctaggtgtattcaggaaggaaaagcagagaagtttcccagaagtctgtgagaaagaggcaggaagtagtctgggtgcaagtggactgagttttgccactagtgcagtgagccatgcactgtatgtgtgtcatgcatggcaagtcccctcagactttgacaaggaaagcagtaccatctctggcaacctgggattggggtgattccagaagcagggaacattttttgaaagctgctataaaaatatgaaagaacagcacaaaaattaaaatatacacatacacacacacacacaaattaattaaaagaatggcatagagggctgtgcacctcagcattagcagtagggatgatgaaaatgtgcaccaagccatcagtgctgaaataaatgttcccatgtgtacatttctttaagaatggccacctcttaagccttctccagctcactccatctcctccctctctcttcccaggaccagctctcagagccccgctccccagccaatggcgactatagagacactgggatggtccttgttaaccccttctgtcaagaaacactgtttgtgggaaacgatcaagtatctgagatctaactacagcaggcatcactttgccattccgtatttttcgtctctaaattataaatatacaaatacatatattataaatataacctttgtgtaaccctgacttaatgagaaacattttcagctttttttcctatgaattgtcaacatcttttttacaagtgtggtttaaaaaaaaaaaaaactttacagaatgatctgtggctttataaaataaaggtatttctaagcaaagcagttgcattgattgcttctcttaataactattcttgagcacctggggatcccaggaaccctggtcaggtgaggtaagagactgacctcctgtagaagctgaatgttacagtgcaagcgcacgattctttgagtgattcttaaagctctggttcctcttgatttggtgtgaccccatttcctcccttctcatacgcacacctgtaaagggaactggaccgcctcaggggaagacggcagactcatgcacagagaaggaaaagggaacatctcatcacctctgaggatgagtaccctggagccttatgacggcaccattggatgtcatgtttaattccatccaagttgtggatggcaggcaggagcatggagccctcaggaatccatggaggacatcaaggcatcccaaggccatattcccctaacattacttccactgctaacaacaggactgcctttccctggtgggaaaatgctccctttatgcccattcctgtatcccctccaacacccacatctgcattaaacacccgtgcctttctcttggagagggtttagatgcagatcccggccctggagctttaaaatgcttgcccttccttcttcaaggatcaaatgtttattggggttcagctttgttttctcaaaaggccatggtatcgtgcccctgaggaacatgtttatctaagaagctttgaggtagtagagcgataatttttgaaaccttcctcctgcaatctttaaaaaagaaaaaaaagattgcccaaacaaatcatttgggagaagacatcattatactcctacttggcactgcaaacctgctcgcagcaccagccggtggacttgccatccagctctcagcttccactgctccccttgttcccggccggctggctgcctccccgtgctgtgtccagcacggccaacaacgtcagaccctcagagacgcccaaggggcttccagaggtggccgcttctctattttttcctgattgtggctgagagagatgattactgctttgacacttcctttctctaaaagaaaaatagtttgatagtatattttgaatatagatgctcttatagtcagattgggaattgaacttgaatattgggtcatatgtttgtgttgttgctgtagtctatcatgacttttttctttctgcattttccttaaaaaaaaaaaaaagatggccttcaaaagtgtgttctcaatgttgtatgaacctccttcacatgagttcggttgttgtctctcttcaaagactcttcaacccacaaagaagcaactaaatgtttctctaagtttaattttctagcgtgttgttgtcttacctttttaaccttaccataatatttctgttaactgttacatttaatataccaatgtgtgtaagtatacagagaaaaatctgtttgtaaagtaaaatttatatataatatatgtaatcaaagatacatatgttatatatacatatgtggatgtatgacttatttttccttatccacagatttcagctaccatgtatatataaataaacttattttattagccagaggattctgttgctaatacat

SEQ ID NO: 589 - DNA, 78335 bp, Homo sapiens
gctaggcgctcgcgaggaccgccgttgtgagcagttcgactttccgcccaaactgggggatgctagaccgcgggcacctctgaatcttatgccttcagtgatataatcctccgtgtccttcgagtccctcctgctgcagacaggtcccctatacttcggtacacacgagcctttcgcgcccaccgcaacgcagcctcgggaggcaggacagacccctgcgagtgtagattgcagctgcatcccagctcccccctccctggcacgctcctccacctacagctgcgctgagctgccgcatctgaacgcaaagcaaacgctgcagtgacggttcctgcgtcaccttaactccaaagtaaatgctaacgtttcccgtgtctgtaccttctctcaatcggcactctcaaaacatctggcacggtgttcactaccctaataagacctcagcttccctcgggaggggtaagtacctctgttgatgtagctgcattttcttctaattcatttgcattgggaatggatagaagggttcgtttactttttaatcatccctacgggaaaacagtttaatatttgatgaattcctgcatgataacttttttccgtttacaacatacggtatttacctctcttcttacctcattctccttccctgaagtaactgcgtttatgtggaagcgtttaggttatatcaccctcatacagcttaaaactatctcggatatttacatctaaggacaataccagatgcattctgtccacctagaaatctctgtcgcctttctcctctccaattcataaaatgcaaaaattcctttagcatggaaaccagccatctcaaaaccacagtagcctttgcttaatttagtcatgtcacaatgtcatgtggcttccaacttcaacaccaatgacacatttactattttttgcttggggatcccatgttttaaaatatttcttatgcatgtcacacttaaaaattaaagccagctgttccagctcccctttccaggcctgaatttaaagcaaagcttgcagtgacaattttgcggtcaccttaacaataaaagtaaatgtgaacgtttcctgtatatgtagcatggataaaaccaggagtcttcacacagattatgtttccagctgaactcaaagaaccatgacttttttgtaagcctagtagtcttatcttggggaaatgtatgatttttgttaggcttttgggaatattctaaataacttcttattctcaaaggttaagatgtctctttttttttatcatgacaaggacataacaatataggaagagtgaaccacacacctatcaaggggcacaagaaactttaatagtggaggaaagtttggactcggaaactcaagaacaatatttggcatgtcaaggagaatatcatgtatgtccttagcataatgtgcttgattttactactctctcaccctgaagccccttcatttgtctggactgctaaaaactagagaaactggctcacgcctgtcatcccagcactttgggaggccgaggcaggcggatcacctgaggtcaggagtttgagaccagcctgaccaacatggtgaaacccctactaaaaaataaaaataaataaaaaaataaaaaaattagccgggcatgatggtgggcacctgtaatctcagctacttgggaggctgaggcaggagaatcgcttgaacccgggaggcggaggttgcagtgagctgagatcgtgccattgcactccagcctgggtgacacagcaagactccatctcaaataaaaaaaaaaaaaaaactacagaaactgggttgtgggcccagacctgagttttattgagtgataactttttcactgactttagttattcactgtatgattttgggagagtctctggacctcatacccatcttcaaaaccagaaaaaggagtaagaatagtgagtatgaaaagtatatttaaaatcctctaagcacaagtcatttttctccacattcaccttctgtcactagaaataacttctaccatctctgctcatttgtgagagtaaactacagagaggatccttaggttaagttcttaattttatggaagaaaattaatgcaattagagtttggaggcattttgtacttcaggtatttataggacagataaaaatcccaaatgtataaaatcctccctaccactaatataataaagattctcgacctggtgcagtggctcacgcttgtaatcccagcactttgggaggccgaggcaggtggatcacttgagcccaggagtacgagaccagcctgggcgacatcgtgagaccctgtcttaaaaaaaaaaaaaagattctcttttatcctgatcttctcccccaaaccaaagccttatccccagtctctatagtgcaaaaggccatgctgcagtatttgattaaacagtcctagctgttgtgtttcagactttcaggtttccccaagggctgagagtcttggggcctaggagccatccccagattccagagggaaaggcaagaaagcaagagtgaagcattgtgggtaatggcaggtcttttcatacacaaaacagaaaatagcaacccgagacacacacagtaaaaataaagaggaagacaagccaagaaatcggaactgggtcctgtccaagaagtccatcagccaaccacaagggccagggttaaaaggtcaaccctgcaattttctggggcaggagaggtagctattcatttaatcatatattcattgagcatcaggcactgtaataggccctggggattaaaaaaaaaaaaagtgagcaagacggatgcacaccctatcttcacacagcttgaagagcaaagaatatctcagcacctgctgtgaacaaggccctggactggacgtgggcattcagcctttgttggtgtacagcagttccacagcttcgcctaagtcaaaataaacatgggatccaagcagttgcccttttaaaagacttcgtttcacacaatgtagataaaacaacctccaggattgccagataaaatgcagggccagctaaatttgaatttcagataaacaacggacaattgtttagtacaaatatgtcccacgtttcagataaacagtgatttttttttaactacagtaagtttcatgtaatatttaggatatatttacaacagagaatcatttcattgtgtgaaataaaataattcaaacttaaagctgttgaaactttaaattattctgagctttgagagggacatggctatatggcatgagtcaagcagcatgtagttgtaacttctgctttttcctgtaagtgatctggaatgattgaggcgtgccagagataagacccctgagaacattacacctcctcacagaatattaaaggaatcttccttggaatgtagcaagttaaactaatcaaattgttacaactgtttctgcctatataagtgaaatcttggcctcctcactttggagcactgaccccattcctttggaatcatgtttcgcgatggctatcctcaagctttgtgctgcagtaaactttatacttagtcatattttctgaatctcattattgaaggttgacatttgtttaactgaaattcaggtttaactgggagtcttttattttatttgctaaatctggcaaccttctcaacctcatacttttctttctttctttccttttttgagacagagtctcactctgttgcccaggctggagtgcagtggcatgatctcactgcaacctccgcctcccgggtttaagctattcttttcctcaacctcccctatagctgagattacaggtgcatggcaccacgcccagctaatttttgtatttttagtggagacagcatttcactatgttggccaggctggtctcgaactcctgacctcaggtgatccacccgactcagactcccaaagtgctggcattacaggtgtgagccaccgcgcccagctcaacctcatagttttctgttaacactttctggctcctttttcataatgtgcacagaaatctatgtttcttcaaaggtagtaaactcttacacacttcaccccttaactttttatcagtttgatttgcctttttttttttgagatggattttcactctttttgcccaggctggagtgcagtggcatgatctcacctcaccacaacctctgcctcccggattcaagaaattctcctgccttagcctcccaagtagctgggatttcaggcatgcgccaccatgctgagctaattttgtatttttagtagagacagtgtttcaccatgttggtcaggctggtctcgaactcccgacctcaggtaatccgcccgcctcagcctcccaaagtgctgggattacaggtgtgagccactgcacctggcttgatttgccttttaaatcccccttttcttttctttctttttttttttttgagacagcatctctctctgttgcccaggctggagtgcaatggcgtgatctcggctcactgcaacctccgcctcccgggttcaagcaattctcctgcctcagcctcctgagtagctgggactacaggtgcgtgccaccacgcctggctaaattttatatttttaatagagatggggtttcaccatgttggccaggatggtctcgatctcttgactttgtgatctgcccacctcggcctcccaaagtgctgggattacaggtgtgaagccaccgtgcccagcctaaatcccccttttcttagttttgagatatatttgataataaaagacacatactgaaagtatgcagtttatacaggtgtacaggatatatacctgtgaaaacactacgataatctgaataaatattattatatattcattattttctaaagttttcttgctcacctttgtaatccttaccccccacctactatctaggcaactactgatctgttttctgttgctgtagattaatttgcattttctagtatttttaataaatggaatcatacagtatatactttttaactggattatttcacatagcataactgttttttatttgtatgccttttctttttcttgccttattgcactgactagggactctagtatcatgtttaattggagtagtgaaagtgaacatctttgccttgttcccaaccccagagggaaagcgttcagtctttcaacattaagtatgatgctaatttttaaaaatgcctttttttaggttgaggaagttcccttctactcctgatttgctgagagttaatcatgaataaatgctgagttttatctgatgctttttctgtatctagagattatcaaaaggtttttcttgcaaaatgtattaatatggcgaattacattggctatcaaattttgaatgttgattttgtttttgaatgttgatgttccaaatattgcatttttgggataaacctacttggtcatggtatattatcctttttacatgttgttggatttgacttgctaatattttgccaagaattttgtcttttcatgagtgacactggtatgtaatttccttttcttgtaattcatttgtctgtttcttatgttaactcttttgcttttcaaaagaggatatctagaaatcatattgatgtaatatgtattatactggtatattaaagaagtatggtataatttatattatatgatatatagataatatgtattaggtataataactaattattagctaatattagttattttttatttatttattttttagacagagtctcactctgtcacccaggctggagtccagtggcgcaatcttgactcactgcaacctccgcctcccgggttcaagcaattctcctgcctcagcctcccaagtagctgggattacaggcgctcgccaccacgcccggctaatttttgtatttttagtagagacggggtttcaccatgttggtcaggctggtcttgaactcctgacctcgtgatccacccacctcggcctcccaaagttttgggattacaggcgtgagccaccgcgcctggccaatattagttattaataaacaatagctaattcgtagcacccttaaactacttatatatacactacaggttttcttctcttttctgttcaattttttccattctacctgtctgctgctgtcttctgctgcagtagcttttctttgccactttgctgtagctttctgtccctcttctgtgttgcccttttcctttgttgtaaacttttcctgttctagtcttctgccttttaatctcaaaatttgtttgttcatttattcgttcattcaacagagttcgaggtcctcctatgtgcaagacactgtgctagaggctggggataccgcagagaacatgacagacggggttgcaggcatagctgctgcccttaagaaactcaagacactgtgctagaggctggggataccgcagagaacatgacagacggggtggcaggcatagctgctgcccttaagaaactcaagacactgtgctagaggctggggatactgcagagaacatgacagacggggttgcaggcatagctgctgcccttaagaaactcaagagctccggaggagcctgcccgcctcagctagcaagtttaaaggagcactactggccactaagtccctgagcatcagttctgtgtgactagggaatctgctctgggtggacaagggaacttgaaggggaattcttcctggactcaggggtgggacctctcagcttattaggccttgccctccctagggaaggcaggagtcttgaccaccaggggttctagattgactcactgaatgaccaactgtggcattttccaaagctaaacaaatttacataaagtgcaaaattccacccatttacataaaactgtttgtttttcgaagatatcctcaatttgtactggatggatttgtagtccaggaaggctcagggagccaggattcttgggtcgcgggtcttcaggcattcctccttctcccaggcttcttctctctgtgccccgcaggttccctgctctgggatgaggagcccaggctgggggagactaactaaagcacagcgtcttgcacatagcagccactcaagctctgaccctcttcatgcagtggagggtcccttctgtgcagctttactcagcgagagttgcaggaagctggggcagggacaaaacgaacattcgtcaactatgttaaggatttgctcagtctagaaataagattttttttttttgagacagtctcactttgtcacccaggctggagtgcagtggtgggatctcggctcactgaaacctccgcttcccaggttcaggtgattctcctgcctcagcctcccaagtggctgggattacaggcgtccgccaccaagcccagctgatttttgtatttttagtagagatggggtttcaccatgctggccaggctggcctcgaacttctgacctcaagcgatccgcccacctcggcctcctaaagtgctgctattacaggcgtgagccactgcactcagcttagaaataagatttttaaaattttcattttaacattaaaaattgcacattttctttgggaggccgaggtgggcagatcatgaggtcaggagatcgaaaccatcctggctaacacagtgaaaccccgtctctactaaaaatacaaaaaattagccaggcggcagcgggcgcccgtaattttagctactcaggaggctgaggcaggagaatcgcttgaacctgggaggcagaggttgcagtgagccaagattgcgccactgcactccagcctgggtgacaaagcgagactccgtctcaaaaaaaaagaaaaagcacacatttttatccaccgttcgtggctggcaagtgttcctatatagttttttggggttttttttttttgagatggagtcttgctctgttgcagtggtgcaatctctggagtgcagtggtgcgatctcagctcactgcaatgtccacctcctgggttcaagggattctcctgcctcagcctcccaggtagctgggattacaggcgcccaccaccatgcctggcgaatttttagtagagacaggatttcaccatgttagccaggctgttcttgaactcctgacctcaagtgatcctcccacctcggcctcccaaggtgctgggattacaggcatgagccactgtgcccagccagttcctatataattgaataaatgaaccactactaagtgcttagaggggatggaaatgttgctataaagacagaataaaagctaagtaattaaaacttggcaaaattcttcaaaagcttttaaaatcatctcatcagatgaactactataagctttatatatgcctaacagaaaaagaattttggtaaatcagtaaatttggtaaagtcagtgaattggtcatttggcaaaattggcttaaaagacttttagaaatgctacctatggggaaaacataaattaattttaaactgtctttaaagttaatcattacaagattaaaaatttccatgtgaaacactaaaatttttgttatatttagcaggatacagtcataagaaaacaaaaccatactaagatcattgactatttttttaggtccccatgaaagcagaaccttgactattttttaaacttgcaaatgtagagaaaagttgcaaaaatagtgcaatgaatacccatatatcctctacttcgccaattaatgttttgccacatttgctttctctctgtatagaggtattagttgttgttagacaatttgagagaaagttgcaggaattatgactctttagaatctatttctaagggctgtgtgcagtggctcacacgtgtaatcccagcactttgggaggctgaggtgggcaggtcacttgaggtcagaagttcgagaccagcctggccaacatgatgaaaccccgtctctactaaaaatataaaaactaactgggcgtggtgttgggcacctgtaatcccagctactcgggaggctgaggcaggagaattgcttgaacccaggaggcacaggttgcagtgagctgagattgtgccactgcactccagcctgggcaacacagcaagactctgtctcaaaaaaaaaagaaagagaatatatttctagggatattccttaacataaccatgctaaaattaccaagtttagaaaatttaacattgatgctgtactattatccaattatggttcatgttcaaattttgccaattatactacaaaatttctttttctttttctttttttttaagatggagtcttgccttgttgcccaggatggagtgcaatggcatgacctcagctcactgcaacctccgcctcccaggttaaagagattctcctggctcagcctcccgagtagctgggattacaggcgtctgccaccattcccagctaattttttgtattttgtattttcagtggatccatgatccagcctgagtgacagagcgagactccatctcaaaagaaaaaaaaacaaaagaaggggttcaggattatgagggaaagtagagggatgggataggtaacgcatggctagtgcagattattgtcatgtttattaatggctttaaagaaaatccagtacatgtaacttgaacttggacatatgagaaaaagcctgttttccagcctttttgctacaattttagtttttggatttcttttttttctccccaagacagtctcactctgtcacccagggtggagtgcagtggtacaatctcagctcactgcaacctctacctcacgggttcaaacgattctcatgcctcagccacccaagtagctgggattacaggcgtgtgccactacacccgactattttttctttgtatttttagtagagacagagtttcactatgttggccaggctggtttcgaactcctggtgtcaagtgacccgcctgcctgggcctcccagtgttgagattacaggcgtgagccaccgcttctggcccctaggatttcctgataaagctgattgcctttttttttgaaacggagtctccctctgtcgcccaggtctagctctgtcttccaggctggagtgcagtggcgtgatctctgctcactgcaagctccgcctcccgggttcatcacgccattctcctgcctcagcctccggagtagctgggactacaggcgcccgccaccacgcccggctaattttttgttgtatttttagtagagacggggtttcaccgtgtcagccaggatagtctccatctcctgacctcgtgatctgcccgccttgacctcccaaagtgctgggattacaggcatgagccaccacgcccggcctttttttttttttcttttttcagacgaagtcttgctcttatcgcccaggctggagtgcagtagcacgatctcggctcactgcaagccctgcctcctgggttcaagccattctcctgcctcagcctcctgagtagctgggattacaggcgtctgccaccatgcccggctaatttttttgtattttttagtacgcctgtaatcccagcactttgggaggccgaagccggcggatcacctgaggtcgggagttcaagaccggcctgaccaacatggagaaaccttgtccctactaaaaaatacaaaattagccgggcgtggtggcggatgcctgtaatcccagctgctcaggaggctgaggcaggagaatcgcttgaacccgatcgcgccattgcactccagtctagccaacaagagtgaaactctgtctcaaaaataaataaataaataatatagtgttaatttgggattatactgtatgccaaaaaataaagttcatacatttatagaactagaagtaaggccaggtatggtgcctcatgcctgtaatcccaatactttttgggtgactgaggcaggaggactgcttgagcccaggaatttgagaccagcttaggcagcacagtgagaccctgtctctaccaaaaattaaaaaaaaaaaaacaaattagctgggcatagtggcactgcctgtggtcccagctacttgggaagctgaggtgagaggatccgcttgaggaggttgaggctgcagtgaactgtggcagcgctactgcaccccagcctgggtgacagagcaagactgcgtctccaaaagagaagaaagtcacagaaggaagagaaatcccaatgagtaatattgcccctttcttaaagaagtataatcgtttagtaggaaaatgagaaagtttgaaagagagtatttttttaacctaaatgaaatcataaatggcttcaagaggctctttcatttcatttttaattgccaaaacacttttgtcaagtttgaaaatacctaaaagccatatattattttaatatagagtcattagtttttcacggagttattcttgatcgctctttctccctcacttgccacagtcagtcctttatagagtagtgctgattctgttgccttcacattgctgtaatctgagcctccttgttctcttcaaccgctgctgtagtttaagcctgggtttgcaaactagcaactcaagggccaccttcagcctacagacaagctgtgtttggcctgtgcaaagttgaaagtttaaaaaatttgttgccaacgtttaaaaatttggaagtagtgcttaaaaatgcagatcctagcttcttttaaaaaatcaaaatatcatagctaggtgtggtggctcgcacctgtagtcccagctattcaggaggctgaggaaggaggactgcttgagcccaggagttccaggctgcagggagctatgattgcgccactgcaccccagcctgggcgacagagagagaccccgtctttgaaaaagaaaaaagagaaaccagagtatctggcaaccctaggcccacgtttctttcaactggttcgcttcacttcttagcattacttggttatcccccataaggatgaccagtctcctatctagccttccaccgttacctcaatatagtattatatctgccccatctcctgtccacattgtcaaaagtggctttctcatcagattcgatcaaatcacttcttgatttgcatatgcttgatttgctgattgttttcaggataaaatccaaactccttaaaatggcatttcatgatctggtttccccacaccagaatgcccacaccatgctgctgctcactccttcccagctctggctacccagcacctgcagttcccaagccagcacttccttccttgtatctgccgtgttgctctctccaccttctcttctttctcctggctaacccgtactcagccttgaaaactctgcgttgacatccatcttccgagagcccccagaagcctttctctcctgctcttttatgatcccaaagcaacctgtgctcttgtttgtgagcgcttcatttaaatgctcgaggtctccaaacaccaccagcggacattaagccagggcgggctgagtggggttaatcgtaccgggattagattagcgttattgcctagtctacatctcggactgagttcggtccccagcgtgtaatgtcacgggggtgaataaggatacgccccggcacggattcctgagaccaaggtcccccgccgcttgcaagccggcccagccaaccaccgggtgcgtagtaatccacgagcgcggcctgggattggagggcgcggcctgcgggagcggcctgggattggagggcgcggcttgcgggagcggcctgccgttggaggggcgcggtctgcgagcgcggcctgggattggaggacgcgtcctgcgggagcggcctagcctcggagtgctcgccgggggctgtagtccccggagccggaagtgggggtggccgggatagaagccgcagcccaggcggcggtccctcccgctgtcgccgcccgggtgtagcgcatcacccggagcccaccggccgcaggtgcctcctccggccccagggggccccgggagccctgaagggcgaagcggcagggacgcctctcttgggcgaagaggcggcctcaccgccccggatgcggccggagggcgcgggaatggagctcggaggcggcgaggagcgcctgcctgaggagagcaggtgggctgggagccgccgcggagtcggggcagcgacaggcgccggagccccgggaggcttgggagggcgcggggtcacggagagaagggccgggcgcgacgagtcttgaggacgacggctgcggaggacttgtttgggaagcatttcgcagaggaaggacgggcggggcggggatgggacgaaggaaccggcttagggtgaggagggtgggtgggatttgcggagggcaagggcagcagaggagggtgaagctcagatccaagactgctggagaggaggtggcagctgagagactgggcgaagaggccagaggggtgcagtgaggttttacaggccagagtctatagacaggggcagggcaccacccggactgaaacttgccgtgacagcaagtggggccaacgcgaagaggatgtgagaattcctgggagcagaggtgaagcgttatgagtggcctcggaagaagcttaggcagagatgagcatggggatgaaggcgaggagagcctggggagaaagtgagcgagtgtcatggcagtgcggtggggcggggactgctaatgagaccagaaactctgcactttgtcattgccgaatccctgtcagagagtggcaggacctctgtgccatttccttttcgtcttcaaacctgtccctttttcctcacaatgcaaactaagcaagttcacatttatttatatggaaccatgtcagaaagctcatatcttctagaaattgggggatttaaaatataaaaactactttggaccgggtgcggtgcctcacacctgtaattccagcaccttgggggaggctgaggcgggtcgcttgagtccaggagtttgagaccagcctgggtaacctagggagatccccgtctctacaaaaatacaaaaattagctcggcgtggtggtgctcacctgtggtgccagctactcgggaggctgaggcgagaggatcacttgagtccaataagtcgaggctgcattgagccgagatcgcaccactacactccagcctgggtgacagaggaagaccctgtcttcaaaaaacaaaaagccaaagaaaccccgaactactttgactaaatgatgaatcggagtctgtagagatgccttccatatttagggtttgcttcattaataactctggtcttaatcttttttaaagaggctggaatgctgacaggcgagagcaggaatgtggcttaagggagtcatacttgacatttattattttatttttattttattttttgagacacagcctcaccctgtcccccaggctgagcgcagtgccgtgaacacggctcactgcagcctccaactcttgggctcaagcgattatactagctcagcttcccaagtagctggggatataggtgccagctaccacatctggctactttaaaaaacttttttgtagagacagggtctcaccatattgcccaggctggtctctaactcctgggctcaagcaattctcccccgccacgtcggcctcccaaagtgctggaattaacaggtgtgagccaccaggcctgacctcacttgacatttagaaacagtttcagatataatgatggtctcaggagcagctgggatccaaaaactagaagcagaatatttacctctgagaaaatatcaacaagggaagatttatgagatgttcctgggtgaagacttgctatttttaagggtgactctacttttatgtgcaaagtggcctgttgaacaaaacctggactgacaggactttggggctcctgcctgagatctgagaatgatttgtgctaagtgaaactgaacatcttacttcccttttccatgtttcagtttctgctttgcctatttgactatttattcttcctgcagatgtctgtgacgtgcttcgtgtgaaaggtcccatgtaaattctaaacacgttttaggattgttttgatttccctctaccacttcatgtgagggaggctgggttagttatttttttaatgtatgtaacaaatgctatttaccacatgccaggaattgttttaaggtattaagatatgaatactgcgttaacttctttaatccctataactattgtatgtggtcggtactactgttattgctgtgtcacagatgagaaagctgagaaatggacagggtaagtaacttgccaaggttgtacagcgaatccctggcagaactggattcaaacccaggcagttcggcaccagagtctgcgcttttttttttttttctttttttagacagggtctcactatgttgcctaggctggtctcaaactcctgggctcaagatattctccagcctcggcctctcaaaagtgctgaggttacaggcatgagcgaccatgccggcccaagagactgcacttttttttttttttttttgagatagagtcttgctctgtcgccaaggctggagtgcagtggcaccgtcttgcttcactacaacctctgcctcccaggttcaaacaattctcctgcctcagcctcccaagtagctgggattacaggtgcccgccaccacgcccagctaattttttgtatttttagtagagacggggtttcgccatgttggccaggctggtctcaaactcctgacctcagaggatctaccagcctccgcctcccaaagtgctgggattacaagcgtgaaccaccgtgcccggcccgagtctgtacttttaatactcaccctatgctgcctctcactatgctaatagtaacaacggaagtataagatagtgaataaatttcacagcattctgtgcctgtcattcaggccagtaggatagctcctttgcagaatcttttcccgtcttttattctttttatgattgcctcttaaccaaaaaactttaatcaaaacttaattttagtagtggggttatcctcacaaagtcactcccgtcattgttataggcatactgtgttggcggctgattaattcagaatgcgttgtttaatgaggcttcatggtactgatggcctccttagctccagatacacaactggtaaatacacattccttgtgcctattaattgaggctttgtgactgggttactgcaaacataacctttctatggccaatgaaatacccagttcagaaacagtcttcttgatgagatagcatcatttttatttatttatttatatattttaaagatagggtctcactgtgtcactcaggctggagtacaatagtgcaatcgtagctcactgcagcctcaaactcctgggctcaggtgatcttcccacctcagcctcctcagtagctaggactacaggtgtgtgccaccactcccagctaatttttaattttttcagattttttgtagtgacagagtctcaccatgttgcctaggccagtctcaaactcctggcctcaagggatcttgctgccttggcctcccagagcactgggattacaagcatgagccactgtgcccagccggtagtgtcattttaaaaatgaaggatgaaacttttcagtgtattttccttaagtagttgatataatgaaacgtgaataagctttaaagtcagacctgcatttgaatcctagttcacggattaatttggcttaacttgatcaagttactttacgtaacctgcctgagtaggaagaataatgctttcctgcctgagaagttctgaggattcaataaaacaatgtgcataaagctcctgagagcctgatacgtaggaagtaggaaaaatgtcgaatccaccccttgctagtttttttgaaataaggcgagggtctcccccacaagtgactgtttgcaagggtatcacttgttcttcctctttcagtggctccttcatccgagttgaacacattgggacctagagtgttggcttagcttcccacttccccggtagtgtgcttaggtgatgggcttccctattgttttccgtctagctatcactccagccagatgctctggggcttagggatgatacttcactttccctccgtttcctaaatgccagttattttgaggttgcctggtaaaactactacactacactgggcacggtggctcacgcctgtaatcccaacactttgggaggccaaggtgggtggatcacgaggtcaggagatcgagaccatcctggctaacacagtgaaaccccgtctctactaaaaatacaaaaaattagccaggcgtggtggcaggcgcctgtagtcccagctactggggaggttgaggcaggagaatggcgtgaacccgggaggcggagcttgcagtgagccgagatcacgccactgcactccagcctgggagacagagtgagactcgtctcaaaaatacccaaactactagactggtaaactgctaaaggaatggtctttctggcattgctctgtctccctagaccgccttggccatgcagtgtactgtctccctagactgccttggccatgcagtctactgctgagcttgcagctcaggtacatgtactgctcagtgctcctggcaccgtgatccaggtacagtcagaattcaaggagtaagatccgttttagcatctccaaactaagcttattccactgaccaaaacctgcccctcctctgatctctgttaatagcattttccactcactcaacatgccagagcgtcagagtgacatttgacatttcgctcttctctatttcccatatgtaagcagtcaccagggtctaaaattctgttcctaatttttcttttgaagccttctttttctctccatttccaaatataatggcttatagtactaaaaaatctagggtgactgggaagtgaggagccactctgcccggccagccgccctgtcccggagggaggtgggggggtcagccccccgcccggccagccgccccatccgggagggaggtgggggggtcagccccccgcccggccagtcgccccatccgggaagtgaggggcgcctctgcccggctgcccctactgggaagtgaggagcccctctgcccggccagccgccccgtccgggagggaggtgggggggtcaggccccgcccggccagccgccccatccgggaggtgaggggcgcctctgcccggtcgcgcctactgggaagtgaggagcccctctgcccagccaccaccccgtctgggaggtgtacccaacagctcattgagaacgggccatgatgacaatggcggttttgtagaatagaaacgggggaaaggtggggaaaagattgagaaatcggatggttgccgtgtctgtgtggaaagaggtagacatgggagacttttcattttgttctgtactaagaaaaattcttctgccttgggatcctgttgatcggtgacgttacccccaaccctgtgctctctgaaacatgtgctgtatccactcagggttgaatggattgagggtggtgcaagatgtgctttgttaaacagatgcttgaaggcagcatgctccttaagagtcatcaccactccctaatctcaagtacccagggacacaaacactgcggaaggccgcagggtcctctgcctaggaaaaccggagacctttgttcacttgtttatctgctgaccttccctccactattgtcctgtgaccctgccaaatccccctctgcgagaaacacccaagaatgatcaataaaaacaaaaacaaaaacaaaaaacctctagttaacacataataatgcccgcactgagcagatgttcactaaggtgttgaataaatagttgaaactgtaaaaaaaaaaaaaaaaaaaaaaaaaaaaaagatgcttttaaaatatgaaaaaaaaagatattttaatgagaaaagctgagtgttgggagagaagctgatgcagggcttgcatgtctgctagacttgctggctccttgcttctagcactcccattatctcaagcagccatatgtttctcattcacttgatacactgtttcctttcaacccccacatcctcaccacctgtttctttgtttgatcatcaataaatggtgtgggctcccagagctccgggccttggcacagcatccacactcgtgatggccccctggtcccactttctctctcaaaaaaaaaaaaaaaaaatctagggtgtactgttgcttcagaaatgcccaaatatgggtgttcaaattaagaatttgtctctgtctctgggctctgcttccagatgtgttgttttcattctcaggtagactattctacaggttaccatagcaactccaagcttagcaataccagcaacaagaaagatgcagtcccagcagctccagcaaaagcaaaaatcccggggctgactctttttggactgacttgagttatgtttctgttcttgtggtcggggtatgggctattctgcttagtcaggcctaagttatgtgcccaaccctggatcctaagggagggtgagatcttggaacctcatggaccagagtaagtagtagagaggtggttcctcagtggaaaatcagggttctcttaccaaaataaagggacaaattctgggcagatataaagtttattcactgtagacccatataatctcttcttggggattacctcagtagcttcttaactaatcttccaacctgaatttagtcccaattccagatagcctcaccctgctactagtttaatttttcagaaacaaagctactataatattttactcagggatgttcagtgattggctggatttggtggctcatgcctgtcatcccagctcaccctgctactagtttaatttttcagaaacaaagctactataatattttactcagggatgttcagtgattggctggatttggtggctcatgcctgtcatcccagcactttgggaggctgaggtgggtgggtcacctgaggtcaggagctcaagaccagcctggtcaacatggcaaaatgctgtctctactaaaaatacaaaaaattagccagatgtggttgtgcacccctgtaatcccagctactcaggaggctaggcaggagaattgcttgaacctggtaggcggaggttgcagtgagcccaggtgatgccactgcactccaccctgggcaacagatcgagactgtctcaaaaaacagaacaaaacaaaagcaggggccggacgcggtggctcacgcctgtaatcccagcactttgggaggccgaggcaggcggatcacaaggtcaggagatcgagaccatcctggccaacatggtgaaaccccgtctctactaaaaatacaaaaaaattagccgggcgtggtggcgggcgcctgtagtcccagctacttgggaggctgaggcaggagaatggcgtgagcccgggaggcagaacttgtagtgagccgagatcgcgccgctgcactccaggctgggcgacagagcgagactccgtctcaaaaacaacaaacaaaacaaaacaaaaaaaacaaaagcaatgttcagtggttttcccattgaaaacagaatattttccatgtcaaaactcctcaccctggtattgaatcttttttttttttttttgagacggagtctcgctctgttgcccaggccagaaagcagtagcacaatctcggctcactgcaagctccgcctcccgggttcacgccattctcctgacctcgtgatccgcccgcctcggcctcccaaagtgctgggattacaggcgtgagccaccgcgcccggcctgaatctttctgttagtacttaatgaagtttccaattacaaaaccatggcacactcacccactctcacatctttcttgccattctcattcttgcttttctacactcactgcaatacctccctctttgcctggagagctcttagtcgtcccttaaatgacgctcctttagaaggcacccctctctgttagagcacatctgacatctcccttcatagcatggttatgtaagtgtccatttcccccattacgttctgaattctctgacagatgggactcttcctctttaaccgctataacgcttctttaagcaccagtgcctagcccagtgcctgacatatagttggtgttcagtgaatatttgtttgaggaatgaagacattaacgttgtggtcatccctcttacagatgggcagatgctagtggaactgttgtcattggaagtgccactttcttcgcatttctcctattcattttcactttttcacgtttttatatttcctgttttctttctttcccgtccctgtttgattattctaggagttaacagtttacatagagctagtagcaaagcaggatgatcacatgattttaaaggaaactagcaattgctagttcgatttttagtacaaaaattacagaaacatacccttgaagcttttggggaagctgctgttgtcagaacccaggaggggactgcaaggactctaagcctgaagcttttcctctccccacagctgtttttgttttttgaagggttctcacattgttgcccaggctagacttgaacttttgaagtcaggcaatcctcctgcctcagcctcctgaggagctgggactacaggcatgtgccactgtgcccagcataggtcaggcagtcctcctgcttcagcctcctgaggagctgggactacaggcatgtgccactgtgcccagcataggtcaggcagtcctcctgcttcagcctcctgaggagctgggactacaggcatgtaccgctgtgcccagcgtgccttttacctttaaatcatctacctgaaactgaaaagactgaaacactttgtctttcctcccgtgccattgctattaaagtggtgttgtgtgcctgctttaccttgtttgtaaagcattctgctacctagacagtataacatgagcctggtgaagtaataagattgtctttcttatatgtctcatgaaatcagccttattgtgccgcagtaacaccttgacagtttcttccattccgtcaagcagatttaagtctttaccatataaaagtcatatccagtatttgaggaagtccttcctagctttcctacttcagtgagaggaccaacagcatcaacagggccttgcaatccatgcttacctgcagacctgaccttggtttaaacgcagtggagatactgtttggatgtggaacactgtaaccaaacttcattatgctgcagactgtccaatcctttacaatttttggcagaattttctttttaagcagaatgggtaagaaggctttattctaggtacccttcctgattttgttggatttattagatttatgcaatggaagttcacagggggaaaatggcagagaaaagagaatattattctctgctctatgataatgcttcccctagattgtcagttacaccctcctctgtgaagcaattgttgtctccattttacagtgagggaattgaagcttcaagagtttaaatggcttggtcaagaatgtggatctaggccaggtgaggtggctcacgcctgtaatcccagcactttgggaggctgaggcaggcagatcacttgaagtcaagagttcgagaccagcctggccaacatggtgaaaccccatttctactaaaaatacaaaaattagctgggcatggtgtcaggcacctgtaatctcagctacttgggaggctgaggcaggagaatcatttgaacccgggaggcggaggttgcagtgagctgagatcgcaccactgccctccagcctgggcgacagagcaaaactcagtctcaaaaaaaaaaaaaaaaatagaatgtgcatctagtttgtgagcagctaagattcaaattcaaattcagtttaaatgactatgatgtctattttctttctactgggtgacattttcttcctgcttattaaaatacaaaagatctgtaatcccagcactttgggaggctgaggcgggcggatcatgaggtcaggagtttgagaccagcctgaccaacatggtgaaaccccgtctctactaaaaaatacaaaaattagctgggtttggtggtgggtgcctgtaatccccagctactcaggaggctgaggcaggagaatcgcttgaacccaggaggcagaggttgcagtgagccaagatcgcaccactgccctccagcctgggtgacagagcgagactctgtctcagaaataaaataggctggacgcggtggctcacgcctgtaatcccagcactttgggaggtcgaggcgggtggatcacgaggtcaggagatcgagaccatcctggctaacacagtgaaaccccgtctctactaaaaatacaaaaaattagccaggcatggtggcgggcacctgtagtcccagctacctgggaggctgaggcaggagaatggtgtgaacccaggaggcagagcttgcagtgaaccgagatcacgccactgcactccagcctgggcgacagagcgagactccgtctcaaaaaataaaaataaaaataaaaaataaaataaaataaaatacaaaagaaatagaagatacatagtccctttccttcaggaaacaagctatgtaatattaaacaacagtcttaaagtatttttagaaggaatggtatagcgacatcatacgcttttggagttctaataaaggagctatagtgggtcagattatttagaacctttttagagaaagttgaattagagctggacctgaatccctgaatggggtgagaacaggcattccaggtggagagctctgcatgaataagatcatggcagtagagtgaggttggcatgtttgtaatagtgtgtgatgaggtccccgtacctaacctgaggagtactgggcagcaaagttggtatttagattggggccaatgatggagaatttttcacctccatgctaaggagtttgttggtggttaggtttctgacataagggatttttcatccgtatgttaaatccactgattgttgaaattcaatgcatttgatgttactcaggtgttaaataggtgtcgaattacaaagcatacctacaggtactgcttattccctcctgtacattaagattctcctttggctgcgtgcagtggctcacgtctgtaatcctagcactttaggaggccgaggcagatggttgcttgagcccaagagtttgagaccaatctcagcaacatagtaagactctggtctctacaaaaaaaaaaaaaaaaaaaaaaagattctcctgtcagccatgaaatgtatgggactggccgatggttacattctcccaggtgccccagagctgagagactatataagagagtcaagtatgtttttcctataagcatgttatttatttaaagcatattatttatgtaaaaaggagcacattcaactacacagcctgcaagttaaatactagataattaaaaacagcaaatatatggccagataagaagaaacattaaacacacatgtgatagtctctcgctacctcagtgttaccaataattatttcacttaattatattttttctacctgaaggaggaacccattacctctttccaggaagtactttctggcattaaaagtcccagggacacttgcctgaccacagtcttccaacttcgaagcccttgatactgagtattttaaaaatcctttatggtactttccagcttctggtttgttcagattattgatcctttctttgtggggagggatttttttagtttttttgtagagacgagattttgcatgttggccaggctggtcttgaactcctgagctcaagcaatgcacctgcctcagcctcccaaagtgctggggttacaggcgtgagccaccacacccagtctactgatcctctattaatcgctagtctcaggaaagccctaaacaattctgctcttctctacagttcccccatattactaaaggtaaccactattaacgtattatttcttttcatatttttatgttgagatcgtaaatctaattttacattctgctttttatactttaatatgctataattagctttagaaactttttggtcaaaagttttcattcttcatggtattccatcatgtggatgtcacatctttcttcctccactttggggatcaaatcattacctgacttgggacaacctgactttcagctgtgatccatgggcctgtcccagataaagagctcactgtggaagggacatgccagtaagctgaagctgtttcctttaccactaaaaagagtatttggggattgaagatagaccagtatctatttcttaccttgaatcacactttgcaattgcatagtactttcacttatttactatttattatatatttcatatatatcacatataagatactcacatgtcatgtttttagtgattatgttttagttatgtattagttatatagtgtaatactttacagagttttgtagctttttactttaatcttgagtgttacttattataacatacttattataacatggtgagcttaagactgagttggcatctaggaaaactggttttccccagatatacttatttgggtcacttaagcaatttctgttcctctttaaaggagggatgtggtcaagatcctcccagaagaaggtagttggtattttattctgagattggcttcgttgtgagttgatgaaaatgatttatgtagggatgggttatactctcccttgccacttaggccgccccccaggttcaagcaattctcctgcctcagcctctcgagtagctgggattacaggcatgtgccaccacgcctggctaatttttatatttttttagtagagaacggggtttttccatgttggtcaggttggtctcgaactcctgacctcaggtgatctgcctgcctcagcccctcaaagtgctgggattacaggcgtgagccactgcgcctggctgggaaaggatattttatttctccattgtgatctgtttacttgcatctaagattcaggcataatggtttaatcaaaccagtgtgtatgagcttcagttgaatttagtatttcaactctctgatattgataattatatcattaggataaacgatcctaaaaagatgaagacactaaagagataggcaatataaaaatatgtaaaatgggacttcaaaaattccagatttggggaggaatggagttaaagtataggttttgtttgtttcttccttttcctatctttatgatcaaacttaagtcactgtcagtttaaaataactttttatgggcctggcatggtggctcacacctgtaatcccagcactttgggaggctgaggtgggcaggtcacttgaggtcaagagtttgagactggcctggccaacatagtgaaaccccgtctctactaaaaatacaaatattagctgggtgtggtggcaggtgcctgtaactctaattccaactactcaggaggctgaggcacgagaatcgggtgaacccaggagatggtggttgcagtgagctgagatcatgctactgcagtcctgcctgggtgagagtgagactatgtctcaagaaaaaaaagaaaattaaaaataaataaaataactttttataactacaaaatgtgttttgtaagcctcatgctgactacaaagcaaaaacctatgacacaccaaaattgaaaagcaaggaatcaaagcacactactagagaaaatcaagtgccacaacagaagacagtaacagaaagaaaggaactgtaaaaaaactagaaaacaagtaacagaccttacttatcgataattaccttaaatgtaaatgggttaaattctccaaataaaagacagtgactcaatgaatttttaaaaaccttccaaataagccccaaccgtatgctgcttccaagaatctcacttcacatgtgaggacatacatagacttaaagggatggaaaaagatgctctatgcaaatggaaaccaaaagacagcaggagtagctatacttatatcagagaaaatagacttcaaatccaaagttgtgaaaagagtcaatatcattatgtaatgataaagagtcaattcagcaaaaggatataacagttgtgtgtgtgtgtgtgtttatatattaaggtgctcccatgttggatgcctgtatatatgcatgcatgcatccaacatgggagcaccttaaatatgtaaagtgaatattagtagacctagatggggagagaaagtctgatacagtaacagtcgaaaactctgataccccactttcagcaatggacagatcatgcagacagaaaatcaacaaagaaacagcagtgttaaactatatcctagactaaatggacctaacagacatctacagaacattctactcaatagctgcaggatacacattcttctcagcagcacatggaaccatctccaggatatatgatatcatatggtaggccacaaaacaggtctcaacaaacttttaaaaactgaaatcataccaagtattttttcttttttctttctttttttttttgaaatggggtctcactctgtcacccaggctggagtgcagtggtgcaatcccagctccacctttgcctcctgggttcaagcaattctcctgcctcagcctcctgtgtagctgggattacatgcacgcaccaccacacctggctaatttttttttgtatttttagtagagatggggtttcgccatgttgaccaggctggtcttgacctcctgacctcaagtgatccgcccacctcggactcccaaagtgctgggattacaggcatgagccaccgcacccggccattcaagtatcttttgtgactacagtgcaatacaactagaaatcaataacaagaacaacttaggaaactatacaaatatgtggaaattaaacaacatgctcctgaacaaccagttggtcaatgaagaattaagaaggaattagaaaatttattgagacaaatgacagtggaaacacaacataccaaaaacagtgggatactgcaaaagtagtactaagagggaagaaaatagcaattaacatctatatcaaaaagtagaaagagctcaacctaatgttgcacctcaagaaactagaaaaccaggacaaaccaaacccagaattagtagaaggaaagaaataataaagatcagagcagaaataaatgaaatagagaatgaaaaaatatatatataaaagattaacaaaagagttgtttgtttcagaagataaaattaacaaacctttagctagaccaagggggaaaaaagactcaaataaataaaatcagagagaaaaaggagacattgcaactgacagcacagaactatgaagaatcactagaggctgttatgggtaactgtgccaacaaattggaaaacctagaagaagtgaagaaatttgtggacacatacagcttaccgacactgaatcatgacaaaacagaaaacctggacacaccaataatgagtaatgagatggaatcggtaatgagtctcctatcaaagagaagcccagggcccgatgttgtcactgccgaattctaccacaacttcaaggaagaactaataccaattcttcccaaattattccacaaaatcgaaggagagagaattcctccaaactcattctacaaggccaacattatcatgataccaaagctacagaggggcacaagaggaaaaactacaggctagtacccccgatgagtatagctacagaaatccttcacaaaatactagcaaaccaaatctaatcgctgcacattaaaaaaaaatcagaagatagccggtgtcggtgaggatggggagaaaagggaacccttacacgctgctggtgggaatgtaagttagtacagccattatgcgacacagtctggaggttcctcaaaaagttaaaaatagaactactgtgtgatcaagcaatcccaatactgagtatatatccaggggaaacacaatcggtgtatcaaagcgatacctgcactcctctatttattgcagtgctattcatgatagccaaggtatgaaatcaacttaaatgtccatcaacagccaggcgcggtggctcactcctgtaatcccagcactttgggaggccgaggtgcacagatcatgtgagcccaggagtttgagaccagtctggccatcatggagaaaccccatctaactaaaaatacaaaaattagccagacatggtagcctgcgcctgtagtcccagctacacgggaggctgaggcaggagaatcgcttgaacctgggaggcagaggttgcagtgagccaagattatgccactgcactccagcctgggcgacagagtgagagtctgtcttaaaaaaaaaaaatgtccgtcaacagattaatggctaaagataatggggtgtgtatacactatggaatacacttcaaccttaattctttcagttttggcaacatgggtgaacctggaggatgttaccttaagggcaataagccaggcacagaaagacagctgtcacatgctattactcggtaatctaaaaagttgttctcatggaggtagagagtggaatagtggttgccagaggatgaggagggtaggagggagaagggcatggagagagattggtcaacaggtacatggttgtagttaggcaggaggagtacgttctggtgctctgttgcacagtaaggcgggagaagggcatggagagagatcggtcaacagggccaaggggacagacagttagacagaaggagtacattctggtgcacagtaagatgacgagggttaacagcagtgtatggtgtagttcagaatagctggaagagaggtttttgaatgttctcatcacagggaaatgataaatatttaaggtgatggatatgctaattactttgttgcgatcaatgcacaatatatccattgtatactatcaatatgtacaattatgtatcaatcaaaattttttaaaaaggtgacactaaatacggtagctatgtaaatcaattttttacagaagttttcttctacatgagcagataccaaatatagattgtttggtgtatcttagaataaaagccacattcttttgtagctttggcaccttagggacacttcattgtgaggaagggaaattcttcagctttgtccagaggaaattataggtagatctgaatgctcaaagtttctaagatgtcaatgctctttgtgtaattttggaatcaaagccctaggatgatagagtacttaatgtttgcttttgggatttatcatgttcttttttttttttttttttttttgagacaatctcacacttgttgcccaggctggagtgcaatggcatgatctcagctcactgcaacctccacttcccaggttcaagcgattctcctgtctcagtctcccgagtagctgggattacaggcatgtgccaccacgcctggctaatttttgtattttttggtagagatgggttttcaccatgttggccaggctggtttctagctcctgacctcaggtgatccacccgcctcagcctcccaaattgctgggattacaggtgtgagccactgcgtccagcctcatgatgttctttaacagttaaccttgtaagatcagtacagaatgaatcagaacacaggtatgcagagtcacgtcatgagtcagactgattctcaggcctatgagaccggattgtaacctgttggcacatgggaaaactgtgtcactaagaaatcagaggctagtttgctctgaggaagaggcataggatatgcagagtcactgggcaaaagttggcagtccattggcctctgcgatggccgtttcttacggtataatcataaatgacattttagtgaccgccttagtcctacagtttctgtccttcacgatgctgtagttagcgcttggaaatataggaaataagaagttgtttttggccttttttgtttggcaaaagatgtctggttctgtgtggatgccttcatctttttgtatattgtgcaggtactgtcattgttaagaaatggatcttaggctgagtgcagtggattacatctgtaatcccagctctctgggaggccgaggtgggaggatcacttgaggccaggagttgggcagcatagtgagaccccatctctacaaaaaatttaaaaattatctgggtgtgttggtgcacatctgtagttcccagctactcgggaggttgaggtgggaggatcacctctacctgggaggttgaggctacagtgagctgtgatcatgccaccacacttcagcctgggtgacagagttaagtgtctcaaaaaataaaaatggatctgaatgggttatacccctataaagttagggttataagctgcttatgtgaggattgagtgagatagtagatgaaaatccctttacaaagcataatctaccatttgaatgtgagggtttttgctgtttgttttttgtctttaaattagtattgttcacaactttaattctctcagagttgagttttgtgcccaagtaaaaattaagaggggagagaatgttaggatgtggggcaggaggctcctcggcttagactttctttgatatgatcaggatcaagtacagcaaaggtaactaacgattggtgtaactgatgcccttgcaggagggagcactggcagttgctgggtaatttgaagacgacggtggagggtttggtatcaaccaacagccccaacgtctggtctaagtatggtggcttggagcggctttgcagggacatgcagagcatcctctatcacgggcttatccgtgaccaggtatgcagaactcctttttttgccagattggctgactcgcttgttgaaaagaaacagtcgcattggcagggaggagatgaaggccactggtctgtggactcctgagagcagctgtgacttaattcatttttttaatatacagaacgtttcacatcgtgtctgatggaccatagatgttaatggaatgaataaatcactgggtaggacagcaaatcagcaacaaaagattaggtcaacttaaaactttcctattgttgctgtaacaagtaactacaaactaaatggcttaaaacaacacagatttatcatcttacagttcttgagatcgaagtccaaaatgagtttcacggggctgaaaccaaggtgtctgcagggccacacaccctctggacgctccacagagaatctacttccttgccttttccagcttctctaggtttcctgcattctttggctcttggccacttcctccatcttgagagccaacagcatagcaccttcaaatctctctctgcccccccctttttttttttgagacggagtctcgctctgtcacccaggctggagtgcggtggtgcgatcttggctcactgcaagctccgcctcccgggttcacagcattctcctggctcagcctcccgagtagctgggactacaggcgcccgccaccaggcccggctaattttttctattttttagtagagacggggtttcaccgtgttagccaggatggtctcagtggtctcaatctcctgaccttgtgatctgcccaccttggcctcccaaagtgctgggattacaggcgtgagccaccgcacccagctctctgccccctttgtttgtttgtttgtgttttgagacggggtctcgctctgtcacccaggctggaatgcaatgacaaaatcatggctcgctgcagcctcgacctcccgggttcaagcaatccttccacctcagcctcccaagtagctagggctacgggcacatgcaaccacacctggctaatttttgtgttttttgtagagacaggatttcaccatgttgcccaggctggtattgaattcttggtctcaagtgaccctcctgccttagcctcccaaagtgctgagattatagacatgagccaccgtgcccagccctctctgctttcacatccctttctctccttatggaccattcctgcctacccccctccttatgaccattcctacctccctcttaaggactcttacaattatactgggcccacatggacaatccagtataatcgccccatctcaaaatccttaatttaatcacacctgcaaagtcacttttgtcataaaaggcaacattcccaggttctaggaattagaatgtagacatcttggaggaccagtcttagccaaccacagccaggaagcttttccttctgaatcttagttttggttttaaaaccatgctggtttttttcagaagtaggtaggataaaggaagaaaaacagccaaggcaaaaatatgttcacttatttctgactttcatgcatgaaatgtttctacagaatgagaaggtggccaggcacagtggctcacgcctgtaatcccagcactttggtagaccaagtggggcagatcacttgagatcagtttaagaccagcctggccaacatggtgaaactctgtatctactaaaattacaaaaattagccgggcgtggtggcgcgcacctgtaatcccagctactcaggtggctgaggcaggagaatcacttgaacctgggaggcggaggctgcagtgagctgagaccgtgccaccgcgctccagcctgagcgacagggtgagactgtatctcacaacaacaaaagaatgaaaagatgaaactccatgtgctcagtgacattaaaagtacttccctgtgggaaatccttttgtctagaagccagtgtgttctagtgataattaattgcttaggcttgataagattcgtgtaattagaatcaacgtctctttcctgagacaaaataatcagctcttcctgtgattctttttgaattagaattttcatcttgttccctaaatttagacttttgttattactatctttacttcaaattaataatgggaagaaagaattaatgtgctttctttgtaaggatagtgagactttatcctcaaagtatctgtgaaaactagcaggcataaaagtgactagggaaaagaagagttagtagttaactcatgttagctacgacacgagtagttaataggtactgtggctcagggtagagccagactgcctggattcagttttcagctccttcatgtgttagctgtgtaaccttgggcaaaatacttaacctctttgtgccttagtttcctcaccagtgaaatgaggtagcatctgtctacctctagggttggtgtggtatgtaaagcattaagagaataggaagagctctcctagtatgtgctatgatgaggaggaagaggaggaggacacaatgactcattaaattttcctcctagcatcctaggacaatccgagaactatttataaaatattgtcatatttagaataccctttgagttttactttatagataccttgttgacgcttatgaatggtagtttgattgtagcttaaatttttaaaatataaactttattaatgttgagtttctttttctttttctttttttttttttttcaagatagagtttcgctcttgttgcccaggctgtgttgcagtggcacgatctcggctcaccacagcctctgcctcccgggttcaagcgattctcctgcctcagcctcccgagtagctgggattacagtcatgcaccaccacgcccagccagttttgtgtttttagtagagatagggtttctccatgttggtcaggctggtctcgaactcctgacctcagatgatccgcctgcctcgacctcccaaagtgctgggatgacaggcgtgagccactgcgcctagccgagtttctttttctttatatcctcaaaaactctataatcagctttgagttttgaaatgagtagaatccaataattcttaaaggtttctgctttctctttggcagttactccatttgcagtgttttaaatacattttggttctggataaagttgtcaagtgagtcactggggtttagtatcctcctatttaaaaaaaaaatcagacctcacaaatacaggcataattgtgtgttctcgctcatgtcatcccctgtcagggcctcgtataactacctggaactctaagctcatcttgcttttttatcagaatttattctcagccagtaatcacattggaaaagagctaatcaactaattggtattaaagtgtgtatacttggctgcgcgtggtggttcatgcctataattctagcacttcgggaagttgaggcaggaagatcactagaaatttgaggccaggaatacaagaccagcctgggcaacacagcaagatccctatctctgtaaaaaatttaaaaacttagccagccatggtggtgcatgcctgtagactcagctactccggaggctgagctgggaagattgcttaagcctgggaggttgaggctccagtgagctatgattgtgccactgcagcctagagggagaccctgtctcaacaaaaaaagcaaacccaaaacagcaaaaagcaccatcctaggactgaggaggcaacattgtatcatagactgacaaaagtctttggagtcagttagaacctagatcagaatctagactcattgctcacatccatgggaaataaagtgacgtagcagttaaaattacggacttttgaatcagactgctcacattttaatctcagcttcaccattaactgagtggtgctgggcaaattatataactcttttgtctttgtattctcttttttttttgatacagagtctcgctctgtcgcccaggctggagtgcagtggcgtgatctcagctcactgcaagctctgcctcccgggtttacgccattctcctgcctcagcctcccgagtagctgggactacagcgcccgccaccacgcccggctaatttttttttgtatttttagtagagacagggtttcaccgtgttagccaggatggtcttgaactcctgagctcatgattcgcccacctcagcctcccaaagtgctgggattacaggcatgagccaccgtgcctggcctggaattttttttaatgcagttctgccgtatgcccttctctcttcttactctgtgtattttcctgaagcagtttcatctgctcacattgcacgatcactcacccattgatgacccccacctcagggttcagcaggttcacctctctgctgaactctaaatccagaagattagctgtctcctgtaccttactgtctggctgtctttcaggcccgagcacaacattaccaaaactaaacttatgttctctcatgagattgcccttcttcctatttgtggcattgacctgctcagtctcccaagtcagaaacttgggaatcctgccagtgtgttttacagaaactcagtgcaagtttcccaggctgctgaccaaaatagctaccagatgagtggcactgccactcaatgggtcaggtacttgtgtcctaatagcaaatgggttcttctcttggccctgttactaatattaaactgtcatctagagtaatcacttaaccatattacaagacagtttcactatctgtgcctgaaagagaaatggaagtcaaatcaatgagaatctcaaatgaaagctgcttgataaatgcaaaacactattcacatatcttgttatagttattaagagtgataatatctggctaggcacagtggctcatgcctgtaatcccagcgctttgggagactgaggcgggcagatcacctgaggtcagaagtttacgaccagcctgaccaacatggtgaaaccccatctctactgaaaatacaaaattagccgggcgtggtggtgcatgcctgtaatcccagctactcgggaggctgaggcaggagaatcgcttgaacctgggaggtggaggttgcagtgagctgagattgcaccattgcactccagcctgggtgacaagagcgaaactccatctcagaaaaaaaaaaaaagtgataatatctgtgaaagtatctggtcatcagaatgaaaaatatcaaagcatatgatcatctgcaaaatagcagtagtatttttaatttttttatttgtttttattttatcttttctctctccttttttacatgcctcctatcctgagaaccccagtagtgttagtaatcagaagcagagctaatcaggcagatttgtcatatggacacacacacatttagcaactgcaggctctagtgggaagaatcaaaagatccgtgccggtttccttgctgctctgttctgcctggtaaagatctgagaattaaagtctgcgtcaagaacttgtttttcgctttcatttcctccctctgaaagatgagggctttcaaaggtttcaggctgctgcgtcatcaccgagctattctgggtgttgtgccctcgtcaggaggaggggctgatacagtgattcatgctgctcatgtcccctctgggctctcaggaggatgcgttatggaatgtgaattgtatttttaaaaattcactcagggccttaggaaagctgtaacatcatgatcgtattcttagagggatctcatttttcttgacagctgcatctgggctacctttttagtccttccagaaggcaaggcatatttgatagcctcttttctgttgcttagaaatgtggagacatttagcccctgagattgctcagctgaataggagaagtgaaaggattcctccttttgccacaatcaagaagaaactagttcttggcagcatagatggtccaattaaaaaaaaatcaataatgaaaaaaagacctctgtggtttttttctgaatatgtaatgtaggtaatatattttctttgttgaaaattcagaaaatacctaaaagactttagaagaaagtaaatatcacccataatcccaacaccaagcgatagtcaccactctaacattgaggtatattttctgcttttttctatgtatttatgtgttttaaaaaaaacattaaggttgtactatatatatcactctataacttgaaaaatatttaatttttgaacactgtattttacgtagctagataatcaaaaaagtataaaactatacagtgaaaagtcttgctcccttctgatcacataaaaaactaccatttactagtttccttacagagaatttttttttttaattaaaaattttttttaaagacagggtctcactatgttgcccaggctggtctcaagctcctggcctcaggcagcctcccagcttggctcccaaggtgctgggattacaggcatgagccaccatgcccagcccttccagagaatttttatgcttataaaagcaattaccaatgattttctttgctatacctgcaagtttttaaatataaataatagcatactgtagtaactattctgtatcttgcctttttcacttaatatgttttgtaattcatccgaaatcattacatagagagcttcttcattctttcttacagctgtcattttataatattccattgtacgtatgtaccatcacttatttagccagtcccctggtgaatggatatttagattgtttccaatcatttgctattagtaacagtgcttgtgtataaataattttgccctttaccgtaggataaattcctagaattcttaaagggcatgtgcatttgatattttgatagctattgctaaattactctccaggaagttatgtatataaatatcctcaccagaggccaggcgtggtggctcacgcctgtaatcccagtactttgggaggccaaggcaggtggatcacgaggtcaggagtttgagaccagcctggccaatatggtgaaaccctgtctctactaacaatacaaaaattagctgggcttagtggcatgtgcctgtagtcccagctgcttgggaggctgaggcaggagaatcacttgaacccaggaggcaggaggcagagtttgcagtgagccaagatcacacaactgcattccagcctgggcgacagagcaagactccatctcaaaaaaaaaaaagtaaaagattacacttctcttagcatgaaaagatattataagtgtcattgaatttttttccctgtgaactttttcctattttattcctattttcagtagatttagtcttttcctactgatttatagatattctttatttattgaggaaattagtcctttgtaatgggagttgcaaatattttttcctagtttgtctgttgacatttctttctttttttttttttttgagatggagtttcactcgttacccaggctggagtgcaatggcacaatcccagctcaccgcagcctctgactctggggttcaagcgattctcctgcctcagcctcccaaatagctgggattacaggcatgtgccaccatgcccagctaattttgtatttttagtagagatggggtttcaccatgttggtcaggctggtcttgaactcctgacctcaggtgatccacccgcctcagcctcccaaagtgctgggattataggcatgagccaccgcgcccggccgtcttttgacatttcttatggtggcttttactgtgccaaaatatctgacttttagtaagtcaaattaatcagttcttttatgacttctcttagggctttgtgtggtgcttagaaagggcttttctactgtgtgatttttttttttttttgagacagagtctcactctgttgcccaggctggagtgcagtggcacgatctcagctcactgcaacctccgcctcctgggttcaagcaattctcccgtctcagcttctcgaggagctgggattacaggtgcatgccaccacgcctggctaatttttgtatttttagtagagacagggtttcacatattggccaggctggcctcgaactcctgacttcaagtgatccgcctgcctctgcctcccaaaatgctgggattaaacgggtgtgcgccaccacacccagcctactctgcagttattaagagtgttttcccatggttttgtctattacttttatggcttagttttttacattcaaattgttccatctgtaatttatttggaatgtatttaatttcctatgcatttgtatcaacttctcaatttctattctggtgtgttgttctctgtttatttgccatcaccactcagttttaatatagtagcttttcaggccgggcgcggtggctcacccctgtaatcccagcactttgggaggccgaggcaggcggatcacctgaggtggggagtttgagaccagcctgaccaacatggagaaaccccgtctctactaaaaatacaaaactagccgggcatggtggcgcaagcctgtaatcccagctactcaggaggctgaggcaggagaattgcttgaatctggtaggtggaggttgcggtgagccgagatcgcgccattgcactccagcttgggcaacagagagaaactccgtctcaaagaaaaaaaaaacccatagtagcttttcattatggtagcgggtagttcctcattcttacagcatctgttggtggtggtggtggtgatggtggtggtttttccctcaacatgcaaacatttgttcttttatttactctgtgaactccacaccatttttcgataagaacaggaaaaaactgcttatgcaacatgacctggatcattaactgattgacgaagtgagggaaatcaagtagtgataatatatgtaactcaaacattttattttaatttaaaacataaatttatatctattcaacaatcttaggatattgggtcaaagcctattctgtgagtatgggcccactgatggagtctgtatcatctttcttatataaactatgcgatagaatttccagtttcaatttcttttatactgagccagcaatttaaaaaatcctgtagtatgaatataaaattttcatttttcatttttcccctaacttctgaaaattgtcttgcctccacctaattcagtatcaactctttatagtgacttacctttactgaaaaggcttttcagagcatactagtgtttataaatacagtcatttcctcaaagtgcataatcattactttaaatgtgaaattataacaagtacaactgacaggaataggtttgggaacaaaaataactgattcttggtaagccacaactcaattggtgggagtaaaagtgcatgtttattctagagaattatctatacccaacttgagtgcttctttggcaacgttgggagaattggaaagccattctttcagcaaagaatatagcattgctctttttttttttttttttttttgagtctaccactgtagtctttttttttcttcgtagcattgcttttaatgtgtatatattacaagtgtaccctaatttaaccagtactctactgataaatgttcaagttgtttacatataggccgggtgtggtggcttacgcctgtaatcccagcaccttgggaggctgaggtgggtggatcacctgagttcaggagttcgagaccagcttggccaacatggtgaaaccccatctctactaaaaatacaaaaattagccaggcgtggtggcagacacctgtaatccccgcgactcgggaggctgaggcaggagaatcgcttgaacctgggaggcagaggtttcagtgagccgagattgcaccattgcactccagcctgggtgacagagcaagactccgtcttggaaaaaaaaaaaattgtttacatatttttctttatttgctatcataaaaaatgctaaacattctttttttatgtaaagaaatttattcataaaatttatccctctctctgttcctttatgatttgcacttttgtagcaaggaaagacctgctgaatcagaacttgcattattattatttttttttttttgagacagagtattgcactattgcccaagctggagggcagtggcttgatctcagctcactgcaaccttcacttcccaggctcaagtgattctcctgcctcagcctcccgagtagctgggactacaggcatgtgccccatgcccggctaatttttgtatctttagtagagacagggtttcaccatgttgaccaggctggtctcgaacttctcctgactcaggtgaccctcccacctcagcctcccaaattgttgggattacaggcgtgagcccctgtacccggcttgatttgcacttctgcttttaaacattgtaacttttatctgcatagaaatccaatatccttacttttcttagtggatttgtagtttcctttttcctttttaactcttcaatacaggtggaatttattctggaatttataaaataaatcatatttattttctatgatttgaggagaatgcctaaattggtctacttctagccagccaattttctcaacaatatttcttgaataatcaattttttccattttttttcccaaacaaaaaagtagtttatttaagggtttaagttagtttaaaattttgtctgaagaaaagaaaccaattttacatgcttttctttttttttgagaccggagtctcgctctgtcacccaggctggagtgcagtggcgccatctcggctcattgcaagctctgcctcccgggttcatgccattctcctgcctcagccccccgagtagctgggactacaggcgcccaccaccacgcccagctaatttttttgtatttttagtagagacggggtttcactgtggtcttgacctcctgacctcgtgatctgcctgcctcggcctcccaaagtgctgggattacaggcgtgagccaccgcgcccggccacaattttacacgcttttcacttaaaaatgatgtaaccaagagacatgctggagttgatgtcccacggctgcccagccctggctggccacttaaaatccactcaaccagataccagagtccctgccgcactaccaccagaatactgaaggtcttcatgatgtttattgtcaaaagagcctgcacatctgacatttccggttctcacttctaccctcgcagtatagaggcgagaagaaagactttttacaaagaagcacctctgactgttgaggtggttttagatcgtgtattaagttctgatatatcttaaggtctctttcaggctatttattttgtaccattgattggtctttgtctctttttttgtttgtttttttaagacaggatctctctctgtcatccaggctggagtgtagtagcacgatctcggcttactgcaacctctgcctcctgggctcttgtgatcctcccacctcagcctcccaagcagctgggactacaggcatgtgccaccacacctggctaactttttggattttttagtagagatggggtctcgctatgttgcccaggctggtctcaaactctgggctcaagtgatccgctcacctcagccccccaaagtgctgagattacaggcatgaaccatcgtgcctggcctggtctgtctcttgatacttgtgctagctctatatatttttaattatttagattttagttttaatccctacccagtagtctcagaaaaggttatcgaaaaacaacaattgggttgttatggtacaaacattttgcatgttgaggcctgtcccagcgtgagaccatttcatctggtctgggcatttctttgcctccacagctcttccctgacctgggtggcgtggaaaagtagatgtttccttatttgattttgcttttgcagtaggggctaaagacatccagctctggcttttaacaatagctctttaccagttttaagaattattttttagaaaacagaacggtagagagaaaggagtagaaaccattattttcagccgggtacggtggctcatgcctgtaatcccaacacaagtgacccaaggcgggcagatcacttgaggctcggagtttgagaccagcctggccaacatggtaaaaccccatctctactaaaaatacaaaaattagccaggcgtgatgtcatgtgcctgtagttctagctgttcgggaggctgaggcatgagaatcgcctcagcatgggaggtggaggttgcagtgagctggatcacgccactgcactccagcctgggtgacagagtgactctgtctcaaacaaaaagaaaaagaaaacattatttttactgtataccttgtatgtcatatgcatatgttacctgttcaaaagaatggttaaaataatctttaacaattattctttaaaagggtaaacatatgtcaagtgtagtattccttttttttttttaattccttttcttttttttttttttttttctgagttagggtctcactctgttgcctgggcaggagtgcagtggcacaatcatggctcactgcagctttgacctcccaggttcaagtgattctcccacctcagcctcctgagtagctgggactaaggcatgtcccaccactcggggtaagctttaaattgtttgtagagatgggccagtctacctggactcaagcagtcctcctgaagtgctgggtttacaggtgtgagccaccacccctggcctctgtgtgtatcctttgattgctgctaagaacctttgatgaggcaagggaaggttgtggtccttttcctatctttgaatgccaaccctagaactagatctggtccagaatggtcgtgatttgctcattgtatgtgttccctttgcaggcgtgccgccgccagacggattactggcagttcgtgaaagacatccggtggctcagtccccactcagcccttcacgtggagaaggtaagagtgagagcagagcggctgtgctggcagagctgtgggtcttcactgtttgaggctctgtcagaagaatcttctaggctccaaggagggaatatgtccagttgcctatcagctgaggaaaggaaattaattatccctgtagggactgactttatttgcttaaaaaaaaaaaacatgcaaacccattggtccaggccactttttctcctctggggaagggaaaaaaagttttgctattttcaaaaaagcctgcctacatgggacccagggtgaagcctttcaaagcatttcccttacctgtctcaatttagttctcaggtcattaggcctcaatcttgccgtatctaccaggatgtgtgttttgactcatgcccctttgcttcccagttcatcagcgtgcacgagaacgaccagagcagtgctgatggtgccagtgaacgtgctgttgccgagctgtggctgcagcacagcctgcagtaccactgcctctcagcccagctccggcccctgctcggggatagacagtatatcagaaaattctacacaggtaggtagaggccacttaggactgtcatctgtgcttcctcgttgtcacccacctcactatcctctacccctctggtaccagggcctcctatttttctttttttctttgagatggacttacgctcttgtcacccaggctggagtgcaatggcgtgatctcggctcactgcaacctccgcctcctgggttcaagcaattctcccggctcagcctcctgagtagctgggattacaggcatgtgccaccatgcccagctaattttgtaattttagtagaaatggggtttctccatgttggtcaggcaggtctcgaactcccaacctcaggtgatctgcccgctttggcctcccaaagtgctgggattacaggcgtgactaccgtgcccggcagggcctcctgtttttcacttgatgccatagggattctactcagaaacatatatccagacttacctctcacctcccaagtaagacacaatccagctttatgttaaggtcgtcccctacggccacacacacaaaccgtaagaatagccaccatttaccacgagtttcctgtgtgcccgtcactgctgtccagtatcttcacagcagccccgagagttgggcattggtgctactgtttccaatccacagggctccaggaggttaggcgacttggccaaagtcactcagagccaggattcaaatctggatttttctgacgttgaagcctcttgccctggccattttgctgcacctcgcgttcttcagcttctcctctactttgtttctgatctgccttcaccctcctcctcattcatccttacctctccctttctgcttcctcaagcttctctcaaggcctccctgatgggctctatcactgtggcagcttttctctccccagatgctgccttcctgctaagtgacgctcatgtcacggccatgctgcagtgcctggaagcagtggaacagaacaacccccgcctcctggctcagatcgatgcgtccatggtacaggggacaaggaattatccacgtctatgctgggtccctggagctcagcaggatgtagccctctacagcaaactttttcacttagccatttttgtgagctgaaaggcttgcatttttttttttttttttttttttttttttttttttgagacagagtctcgctctgtttcccaggctggagtgcagtggtgcaatctcagctcactgcaacctctatctcctgggttcaggcgattcttgtgcctcagcctcccgagtagctgggattacaggcgcccgccaccacacccagctatttttttgtatttttagcagagacagagtttcaccatgttggccaggacggtctcgatctcctgacctcgtgatcctcccgcctcggcctcccaaagtgctgggattagaggcctgagccaccgcgcccggccagctttcatttaaaatgcttggaggaggggaggtactgttaagtacctattgaagtagaaagtctaggcttaggtcgtgtgcttagtagacctaagctggggagtggggaggtagattttgttaaacctgtggtatcttttgacaaaggataccaagccttgacaaagatctggggaaaagagggatggttttgaatcggatagagtttagtgtcagacctggcatagcttaatgttacacggggtcagttttttcatgtttttttctttgatgtaaagaaaattttatagtacaaagaaaatttgttgcctaaaattaacttatcccatcactaatactccagtcagtgccttagctagaatggaatcagagtccccacttcttagagaagcagatcccctatctctccagattcttttaattaattattatcattattattattttgagacagagtctttactttgttgtccaggctgggctggaatgcagtggcatgatcttggctcactgcagcctccgcctcccgggttcaagtgattctcctgtctcagcctcccgagtagctgggattacaggtgcacgccaccacgcccagctaatttttgtatttttagtagagacggggtttcaccatgttggccaggctggtctcgatctcctgacctcaagtgatttgcccgccttggcctcccaaagtgctgggattacaggtgtgaggcactgtgcccggcctgattcgtttaattttgattgttggttactatccatttaatactttgtatgtgccaggcacggtgctatgtatgataaatgtatcatgtcattgactcttcataaccctgtgaagtgggcattgatctcattttataaaggaggctgctgaggcacagagtagatacgtggtccaaagtttggatcaaatagctgataagtgtcagggcctggatttgaaccctagtctgtctgacttctgattccacatacatcagcactttgttgtgctgcctctgtaataaagtactcctggtttaacacctggaaggattccagtgcagatgctgtggtttcacagttgtaaattacatactgtagtagaaggtagccttgctgtatctacaggctctggctaaagtccaggcctactgcaaaggtagcttctatggcatttctgcagtactgcgttgcccccactctgaggccctttgtccttaactctgacacattttttggttttgttttgctttttagtttgccagaaagcacgagagcccgctcctggtgacaaagagccagagcctgacagccctgcccagttccacatacacccctccaaacagctatgctcagcattcctactttgggtccttctctagcctccaccaatccgtgcccaacaatggctcaggtatggggacaggaaaaagtggtcattacatttatccccagccctggaaagtaagaagactttgtggttgctcataggcttggaaaattgagacttgggttggtagtttttcttaataagggacatctttacaagttatatagtgactagcttgaaataattcagtagaatcatgaagtaacagaagagagagatgtttgtagattcccctgggtttctaatccacattgccaagaaggcatttcaatactagctaacaccgaatgattgccaatcatgtactaggctctgttgtgttcagtttgtatgtgttatcccatttgagccttcaaacagtcctcttactgctcatttttcagatgaggaatgcatactaataagcaataaagcactgtctcaggagcccatactcttgacttagctgcttctaaataattttgtactttatttggcttgccgtttctgaggtgacatcgtatgtcctggtcacccagtccttcatacatactgcaggattccacctcacccttgctccccttaccatttccttttatattctagagagaagatctacttcctttccactctctggccctccccggaaacctcaagaaagcagagggcacgtctcaccagcagaggatcaaaccatccaagcccccccagtttcagtctctgcactagccagggattcccctttgaccccaaatgaaatgagctccagtactctgaccagccccatagaggcatcctgggtcagcagccagaatgattccccaggtgatgccagtgaggggcctgagtacctggccattggcaacttggacccccgaggccggactgccagctgtcagagtcacagcagcaatgccgagagcagcagttccaatttgttctcctccagcagctcccagaagccagattctgctgcctcttccttaggggaccaggaaggaggtggggagagccagctgtccagtgtcctccgcaggtccagcttctcagaggggcagacactcactgtcaccagtggggcaaagaaaagccacattcgctcccattcggataccagcattgcctccaggggagctccaggtaatgaggaacaccggctgctagttagcaagatgaccctgaattgagagtaagagagggcttgttatggggacttttcaggtggcagaaagagatgttctgtttctggtgatacaacatcttattttgtaatgaaagaagtttataacgaaatactgagactcaaaatctctaagtctatttatgtttgtttctttatacattgctaatattaaatgttttcctggattctttactagtttggtaacatcagaggatagcgtgactcatagtgcgagttttcaaagtatctcttggattggggaaagtattattgagctttaaaaataatcccattaagttctgtcatttcctgtgacgtcttagaagtttgcccagggtgtaataataccaatgtgagagaggcagagagatactggggtttctaattaaaacgaaggctatagtgagtgcagggtgatgcgatccagcaactgagtcggtggggctgacggccgcatcactgattcagggtgagaggccgtcagataaggaggccctggcagctgggacctccctcaccaaacaccagctgatagcaggggcagcctactcgtggggaaggtggggctccttgcttttgccatctccctgccatcatccttcccggcttgtggtatccggcaggctttggttgggttttgtttgtagtaggatctccataagaggaagtatagcatggagctttgtgctcaaagccattctgggtcaggaaagccccagaaataaaatataaaaataaaatgtgaaaaattcaaggacctaaaaaaaagagggggcggtttctttagcaactggagatagcgttgctttctctttgtaatttctggaaaggtgagagctaaggccctcatctgaaaccttcagaattacaaacttttgtctttgttttccctcaagaatgtgatttaacttgttggaaatcttgaggagaagaatctccaaatcaaagcctgtcttcccatgagctttcttagatgtgaagatgactgggctggaccctcacttcacatctcctgctgcaggcctgatgtctgccatactccaagccactggcctttgagcatgtaaaactttcccgccccattcttgaatccatatggattccagtggaatcctgccttggaaaaagggagcccgcgaaaatgtgtgcggaaggatctgaggaaatatgggtcacgcacagcttcttggacaagccatccgtccttcacaactggggtttcctcttgggagttccatccccacttctgctgggtaaaatttaggacactttttttctctctctgtattctcattgctctatctggactctcctctgcacctgtctgtctaccggcaggaggccccaggaatatcaccattatagttgaagatcccattgcaggtttgggaatcggtcctccacctcctctttgttctgttttgtgaccacctttcttagttcagaacctccttcagtctggtgtcaaatcaagtctggctagcctggtcttgttgtgatgcttggaactgtctataaaatgataccagtatttcatatgatgtgttttctatacacaattccaaatgcctcgttcagtctctcaacagcttctgggaggcagagtcaagacttatcaattcagttttgcccaaaggtgaaactgaggcctgctatttgtctgaggcatcatgatgaatcagtagcagacttttttttctttttttaaattttttttactttttttttttttttttttttgtagagacagggtttcaccgcattgcccaggttggtcttgaactcctggcttcaagtgatcctcctgtcttggcctcccgagtgctgggattacaggcgtgatccaccacacctggcccagaatttttcttataactgaatacttcctatggattactttattttccttgaattaacaccagaatgtattttatcccctttctgtggtcttagatatacttgcatgtttggtttttttgttttttgtttttttgttttttttccctctcctgcagttccgtttcctttttctttcacctgttttcatttccctataaatccctgcaccccattccagctattgcataggattcttctagttatttcagtctgtttccttggtgttcatggtggtgttcaaactgagatttgtgttccatcctgggtaccataattcatggacatgaacactggaatgtgtctgcaaggcagagtattgagagagggctgaaagccgtggcctcctggaagtgggtgaggccattgggtatgttagcttggaaaacagatggttaaagaggaataaagtctgtaggaccatcatttagaatagcgttcttcttaaggagataagaaattggaagaaggcagataacgagtgtaagggaattctaagaattagttaaatggtggcattaggaggtagtgaactcagtaagtaaaggctgaatggccacatgttgtaaagaggttaaggtcgtgttggagtttgtgttgtgtgctgtttgggaatcttgaaggtcccttccaagtcatatcatggttttttaccaaggcatcgtggcgactactagtttgtcctcagttcagtaggaaggaacagagcccacagccagggctaccagaagtctttgaggcccaagaagaacacaaaattgtctcttgcacagagtagcattttttgtgagaggagcaagttggtaacatctgtcagggaaatgggttagatgcagctcagtcattcactctcccacagcatcctgctcattttcaagcacccacctgcttttccacctgttcttccttctgtggtcctggaaatgttgtgtttccttgtgaagaatatcagtttctcattcctgcaaaccctgcctgctactgttctccctcccagctctcgctcttcctgtcccaggcattgtctgtctcgccagccttccctccctcccttcttcagtaaggccgggccgagccccgtaacggagccctttgcttacagggccctctccctgggcttctccagcactgccttgatgcttctttttaggatgctgctgaattttatttccttagtgaatgtaaatcttctgatgttactttaaaacctaatgtcaagatgtcagaaaagtttcaatgcacttgtctttgttttaccatctaaagacttttctaaattggtttgtcaagaggataggaatcagctgatattcctgtaatgtttggttaaaagatgtaaggaaagagaagcaaattccatgaatccattttgatttgattctttcctttatgttgccccattctggatcacgtttcttcttttccacttagaatgtactgacctgccatctccttccctccctgtgtttctgtacccttgggctgttccgttggtgtgccgcctctctcctgcttgggagggctttgggaaggggtgcagttaagtgttgaaactccagagttgggaatgtacctgttgctcatttcgtatgtgtttttactcgctggtggtcatcgtcattagaatcctgcaatgataaggcgaagttgagaggccctttgccctactctggtcaaagcagtgaagtcagcacacccagctctctgtacatggaatatggtgagtactaggaaggccagggctaaaattgtatattttctctgctcaccccttgtgcctgctaagttctgagttttggggttcatctcagctctctggagggtacacactgttacagtctcagtcactcttttgtcatttttaacccccgtgctagaaatcacactgctctgccatttctcttgcttctctctgacttgggggtcccaccctctcttacgtgctgggtgttcgcaccgggtacgtcggctggtccagatgggatggctctctgagtggatgagatggaccttgaaaagaggccttggagtatctgggcttagtaaccagcagacagactctatgtggaaatcatgcagaggaggaagccatttgtgtccttttctgcctcccagcccaaagttctacatttttattttgttttttctttactgtatggtacgagggagagcatgttctctttaattttagatggcagaaggattctctctgtttattctaccgttttccaaccaagaggcttagtgctctgggattctaagagtccaagaaattcttttttgttttgtttttttttttttgagacagagttttgctcttgttgcccaggctggagtgcagtggtgcgatcttggctcactgcaacctccgcctcccaggttcagatgattctcctgcctcagcctcctgagtagctgggattacaggcatgtgccaccatgcccagctaatttttgtatttttagtagagatggggtttcaccatgttggccaggctggtctcaaactcctgaccttgtgatccgcctgccttgccctcccaaagtgcaagaaattcttttagaaggtggacatcttcttccaacctctaattcccagttacctgggaagacttgggagcatctttaatgacaaaagcttaagacttcctgaagaagcctggctgtttcatccacattccatttcccacagaaggtggtcggtacctgtgctcaggggaaggcatgttccgaagaccatcagaaggacagtccctcatcagctacctctctgagcaagacttcggcagctgtgccgacctggaaaaggtgggaaatcgagggcctcatgaagagctcatgagttgggagattgggtctgaaggtctgtggtgccatttgttctgatgaggttttgggtatagattacagtaaagataagttcacggtaaagggaagctcagcaagttctgtttctgaggaactctgcagggagcatgtgcccctcactgagtccaaattattagcgattttatcttagaagccaacctgggcagagaagcatcaagtttgtgtgtgtgtttttgtttttttgagacaagagtcttgctctgtcacctaagctggagtgcagtgtcacggtcatggctcactacagcctcaaattcctgggctcgagcaatcctcccgcctcagcctcccgagtagctgggactacaaacatgcaccaccacacctggctattttttttatttttttgtagagatgggggaggtctccctgtgttgcccaagctggtcttgaactcctgggcttggcctccctaagtgctgggattaacaggtgtgagcccatgtgtctggggtcttgaactccttggcttggcctcccagagtgctgggattcacaggtgtgagccactgcgtctggggtcttgaactcctgggcttggcctcccagagtgctgggattcacaggtgtgagccgctgcgtctggggtcttgaactcctgggcttggcctcccagagtgctgggattcacaggtgtgagccgctgcgtctggggtcttgaactcctgggcttggcctcccagagtgctgggattcacaggtgtgagccgctgcgtctggcagcattgtttttgctgcatgattgcggttcccttgactctggcaccttaggtaaatactgtttccagaatcaaattctatcttttgttctaaggctcagataagcaataaatgacatctgtgtagcattttatagactacaaagcacttttatcttgagacatagcatttatcttaatattttgtgtacaggtgtatgattttgggaaagaacctgattgaaatcctgggcctcttctctatcatatttttatgtagaaatgagacaggaagggacaggcttggcaaagtaagagagtgaagaaaacctagaataggttttccagccatcagctttcctcgtagtagaaatgtccatttctccagggtgtttttggcaggaacagttcctatcttggaaactcccttttccacattataatgagtatgtcattcaatacttctaaccctttgcctgtttggtgctctccttccgccaggagaatgcccacttcagcatctcagagtccttaattgctgccatcgagctaatgaagtgcaacatgatgagccagtgcctagaggaggaggaagtggaagaggaagacagtgatagagagatccaggagctgaagcagaagatccgccttcggcgccagcaaatccgcaccaagaacctgctccccatgtaccaggaggctgagcacggaagtcagtggagcctgtggatgcttctgttcccacattttcccaacttcagcataaggcctggtgcccaaaccagtggttcctctgctgtcagatgtttctatgtagtcctactttttttctatcatgctaggaatactcatcctagagtcgctccgtttcctgcatcagaaatacctgccttccaggccaggcagagtggctcacgcctggaatcccagcactttgggaggccgaggcgggtggatcacttgaggccaggagtttgagacctgcctggccaacatggtgaaaccccagctctaaatatatatatgtatatatataaataaaggaatagctcccttcccaaatagcttcctgatatgaggagacctaagaacactgctcccagatttgcttcccagatagtagtaccttctatttacttgaaactttctaaagggaaagtttccatttctctctgttgaggtcatatcagatcccttatattgtgacactggaaggacaagaagacctctttctgccctgtttattcctttttgtttttaaacataacaggctttcgggtcacctccagcagctcccagttcagctcacgtgattcggcacagctctctgactctggctctgctgatgaggttgatgaatttgaaatccaaggtaagaagtgacactttgttacaagggaacttttattctgtttctttccatttagaatgataagctgcgaagtgtttcctaagtagaagatcttcattatggattgttgttagctattgtaagggacagccttctgctaaaaacaaaaccccttcacagtttcagtagggaagaacactggaagcaggtgttccaggtggatggagtggctgctcgttgatgtcaccctgacgcgtcctcctcagtggtgtctttctcctgggttcccactctgactcctcctttcagcttgtagggctggtccataccacttgaaattagaatcctattctcttgggttccataacacaactgaaattgtttcagagtgttcaaaagagaaaaggacaaaaagaatcattgggggcagggggacaaaagaggaaaaacatcaggtttacaaagtagagcttgaatttctgcccttgcggtcggtgctcactgctcagcacagtcacagactctgtttttattggtggtggtggtggtggtaggagtatcagcatagaggaacagtggggttccagtctgggaaggcagttatgttaaatcaggttaatgtcccactcctgcaaatcatagatctcttcaagttcccatcagcaaaacaaacacacaaacaaaaaaacagttcagggacaaacgctcttccttcatgggtgaaactaagagtagtttccttactgaagtgaatggtatctataattctctgttacaacattgtgtatgtagacagaggtgaactgtatctataattctccattataacataatgtgatgacagataggtcttgtgttgcaagaggctttgatttcctgtttacacaatctagagagcccattcgcctgcacaggcctccagatggaggaaccacatgtttcttcccattcagaaactccgttttttcacacattttcgaggtattcaggaagtcttccttctatgttctccttaatgtctctgatttctatgtatgacaacaataggtagtcatttaaaactccttttgtttgtttggttgtttgtatgtgattttccaactcctctccaattctctaccatcagctgggtgacttacaatttagctctgacactaactacctggagttagcacggatcctgcagctacagtcctgtgaaattaattccgcttcagatgccagacacaggtcaccaagctacctgcccttctgcttgtaggctgactacaaattcagagattcccacgacccccttccccaaggcaggataatttgcttgaatgatgcccagaacttgggaaagcttatgcttatagtctgttgtaaaggatccaaatgagcagccacatgaagaagtacacagggactaaggaagagatcacgagcacaggaactcgtcctgcccccgtggtgtctggggcaccaccctcccaggtgcattgatgtgttcgccaaccaggaagcctggacatcattgttcaagtttttattgaagtttcattatataggcaccatcgattaagtcatcggccactggtgactgggctgagtcttcgatccctctcccctccctggaggcgatgggggagtaaaagctctaaccctctaatgacgtggttggttctttcgatagcccccaattgccccaattgtgaagctgtctatctaggggcctgccaggagtctcctcattagcataaactcaggtatgattgaaaggggcgtattttgaataatttcttgaatgattcaagaaattccaagaattttaggaattctcaccaggaactggagacaaagacaaaatatctatttactgttataccatagtctgtgattgacttcatctcctaattaaaaaaaaagaaagagggtctgacctcactcccaggatcagcagtcagaatttcaggaggagaatagtgaggtaaattcagatccgtccacttgactaccacatctgtttcctgcagcaaagcagggatccgggaagctgtgcagtctgtaaggagcctgccgagagagaggcccaaagcacactcctgttagaaactgttgctgcggttgtaggccctgaggagatgttcaatcagtaattctctagtcgtttcagaacagaaatccttaaaggaaaagaccttaggccggggtttcccaacacgtgggccagatcattctttgctgtgacggattgggctgtggactgtaagatgtttagtgtcattcctagcctctacctactagatgccagtggtaacccctccccagtatcaagacaatcagaaatgcctccgtcattgccataatcacccgtggctgagaaccactgtcgtaggaggtccttgaggctgggcttggcgtaggaagtagcagtaactctcctccaagctagagtgagcacctacccaaggatgcaagttcctaaacgccatttcatgtttgggagcaaatggcaagttttgattccaggaacatatggtatagaatattagtttatttcctgctggaatactaagggcccccttttatcatcattattacacagatggtagcgaaggatctaacctgactcacatatcaaagaacggactgtcagtgtcactggcctcgatgttctcaggtagcctactttgcaagcgtggatgtgcttgtagatgcatgtgtgagaatgttgcaccagctttcgtatatacttaatcatgtgataactgtcaaggttacgaggactgtaggggctggagaactagttggaagaaactggagctaagccagaacaacaagccaggaacaattcagatactcactgattcttcctcatgtgaccccaacaatcttcctcacaagtttgtccttggtgatccttccctatggtgataaatttagatttagtggccattgtgactgatggaggtagtggacagtttagaaaggaatagttagatgaagaattttagttcaaacctatacctaagctcctgccacacattcagacagcaaaagtaggatagaatggtatgaagcttactgtctctttagaactttgaatttgcagagccaacttttagaaagccatctcttctgggtactttgtgtacaagtaggatttactgctgtagatgtttgttcttgctttgtgatccaaataagtaggtttcctgtaggtgaggttaattgaaagaaagtagcagttttctactcagaatggctttaaaacacaaaaacaacaacaaaactcagaacttttgtattttttttgagacggagtttcgctcttgttgcccatgctggagtgcaatggcgcaatctcggctcactgcaacctctgccttccggtttcaagcaattctcctgcctcagcctcccaagtagctgggactacaggcagctgccaccacacctggctaatttttgtatttttagtaaagacagggtttcaccatgttggccaggctggtctcaaactcgtgacctcgtcatctgcctgcctcggcctcccaacgtgttggaattacaggagtgagccaccacgccaggcccagaactttttattaaaacttttaatattgttgggcattagaatttgaaataattgtgtaagattagatcaagatttagagaaataaagacaaatattacaggagctcccgtgttctcactcatatgtgggagctaaaaaagttgatctcatggaggtagagaagagagtgatagttacagaggctggggaggaggtgggttggggcgtaaagagaggttggttagtgggttcaaccatacagttagaagggatgagttctagtgttcagtagcacagtagcgtggctgtagttgacatattctgtatttcaaaatagctagaagagattcgaagtattcccaacacagagaaatgataaatgttcaatcaatggatattctaaataccctgctttgaccattacacattgtatgcatgtatcaaaatatcacttgtgccctgtcaatatgtacaaatattatggtatcaacttaatttttttaagattagagaaataaaagtaattaggttcctttttttcctactcctgaacgactgtcattgattctaacatgagtcttccctgcctgaggaggagttatcctgactccctttctaactggtttccggtgtgtttagtcccagtcctctgtgggggcatgtgttgagtgtcagccacttctccctcagagcatgtccaatctgcactcaccaccaggcaggccttgatttggtctttctagcatgcttcctttccccattttgggggctttaaaatttttatacacatgacaggttttacactaagaatgtgaaatgtttttcaattaaaaagctgctttttaggctgggcatactgactgtttatgtcagtaatcccagcactctgggaggcttgaggtaggaggatttcttgaggccaagagttggagaccagcctgggaaacatagtgagaccccatctctacaaaaacatattttagaattagctgtgtgtggtggtgcgtgcctgtaatcccagcactctggaggctgaggtgggaggattgcttgatctggggaggttgaggctacagtgagccatgatcatgccactgcacttcatcctgggtgacagagcaagaccctgtctcaaaaaaaaaaaaaaaagaattcacccacttcaagtgtacaactcaacgatttttggtaaatttaccaagttgtgcagccatcaccataatccagcctgaaaacattgtcatcgccccagtagtatcccttgtgtcagtttacagtgaattcctgtctccactcgcagccccactcagctgctcgtctttctgtctctgtagatttgccttttctggacacttcgtataaatggaattatccaatgtgtgatgcgtcatcttttgtgtctttcacgtcatctacttctgctgatggtgtctgccaagttggtttgatatctttcataggctcccaatctcagacagtcttttcagcttctttggatttagagttttgttgttgctatttttttccccatctccatcttcttctattatagctgcatcaatttttctttatcttcctttgtagattcttcttgaattttcatcttgtgcatagatgtatctagtcagggtccgatcaggagacagaaactacacagtaatttgaatagggaaagtttaatataaagaattatttctactataatgtgggaatcatggaatgggaaactggctcatgaggagtaaagaagactctcaagagtacacaggagaagcctcacgtggtggctcagcctgtcatcccggaactttgggaggccgaggcgggcagctcacctgaggtcaggagtttgagaccagcggtggctcacacctgtcatcccagaactttgggaggccgaggcgggcagatcacctgaggtcaggagtttgagaccgacatggccaacatggtgaaaccctgtctctgctaaaaatataaaaattagtcgggtgtggtggtgtgcacctgtaatcccagccactctggaggctgaggcaggagaattgcttgaacctgggaggtggaggttgcagtgagccgagatcatgccactgcactccagcctgggtgacaagagtgaaacttcacctcaaaagaaaaagggggtgcacaggaggagcagatagaggagcagtcactatccctggggctgagatggagcatctggggtaggaataaatgtgaaggagtgatacatccccaaggctgagatccagacgtcctggcttgctggatggtggggttccctgaaacacagagctgccctgagatggtgccaggggacgctctccacagggaggtggcatgccagcagctgtcaccaggaaactgttctctggggtgctgagggagggtgtccatgggaggtgctatctcagaacccaagggtactggtgaaagccctctgtgggaaggtggtaggccagtggcactcactgtaaagctctccagggaagctcttccggcaggtgccgagggagctgtttatgagggcgtcactcatggcactctgctgcaaagctgcccaaggtgtgcttcccccggagtcagcttagaggagcaaccagagccagccggagaaaccccttctgcctccagcacccctccagtgccccctaccacaaaacctcacatcatgccagctggcaaaggagaaatgtttctgtgtccagctccgttattgcagagcaggcaaaaacaagggcagatttggagttgaaagacaataaattgatagctggcataacagataaaaaggaacgttgatgagctatactttctgacaagtttcaaaattatatccaattcaaggtcaaggtaatcagttccttctcccccatcccttttttaattactttttttcctctttataaaacaagaatactttgggttctccattttgaagtgtttccttttgagtcagcaattacagaaaatgtgttgaagttggattcccagatacgttgggtatcaccttatcttctagaaagaaagcaggatggaaaccggcatcaaactggccagtacattctgaagttgactcttcttgtgactcacttactttgtttaaaaatttgcatagtttgctaaggtaccaaggttttaaccagctcttctctgatcgttcaataccagtgtctggacacgcagcaaattcttctccttataacttgtcattgtttttgttgttacttgtttttatatttttaaacttttttcagtcagtaataatggccttattctatgaagttggtgcaaaagtaatggcaaaaactgcgatgactcaacctaatatctgatgcatcagaagcacctgaaatcagttcttttgcaaaacaatacttgtttttgtacaaaaaaatcaataaaaagtttcagaattgtgttaaattccacttggatgctgagtgtctcggacctccttcttaagtgctctcacttgggacacgttgaatccatccagatgggcagctccccctctcttcactcctcagttctctggcttagaccttggtctgcttttatccagatcttcagtagggtttcacccgtgtcaacttagttgtctgcttgaaccgaccagagagtgatgagggctgcagcgcaggcccaggacccgcagagctgcgtggtccttggccggggtcaggggtcatggcccctttgacgagtgtgcttctctccctccagtccggggtcagagccttgcctccgaagctgggtggcccctccccactcttggacgtattcatgattgcctaggaagcccctgcatgtacctccgacctcactttacctctagtaaaaggaagaaacacgttacagtgtgactcaattgtattttctgaagagagaatgattttttctctcaaaggaaaaaaaaaaggtttcttctctgtgaggatacagaactgctaaatagttttatgaaggcaatggtttccttagaaaccatgaattaccacctgtctgttctttctggcatgtagtattttctttaatagcctggcacgaaaataagaaaattggttagctccttattcagggatagctaagatttttttttttcttttgtgttactcccaaacaggatggaatttgaaatagctgttaattgcttttagccaattaatcatttattcagaaaatgttttctgaaaacctttatgtacaaagcactctgagggctcctagctcaaggcaagacttaggtacagcccaaggcagtgtaagtgttacccaaataaatgttgcaaaccaaacagtctgtgaaagtctggcctactgttgcctctactgtttttcttttctctaccagcactaactagccagaaataagacagctagcagtgcactgggatctgggttttgtggcacagattccgccagaaaacatgatatacttgaacatctttgttgtgaaataggctatgctaattacgagcaaaaatgtgtcgatgtcttgtcctgtgctcagagaacataggaaaaccaacagatttgacttctgttaccttactcatacatgtagctttgaagacattagtttgtcaacaatgttatttgagtatatgtttgtatatgagccctgtgttaagtattttagagccaagggaagaataagacacaatcttatttcttgttagggtgattttataatctagttgtccagacaaaaatctgcatacagaggaaacgtgaggaacagtagagctgctcacagcccagtgcacagagatgccatacaagattggtgtccttctgagtgctcatggtagattggtcattgtgtcggcttcattaggaaagaaaggtcttttcactgggcagtgaaggacatgagagagagtatttatcagaacagtcttgttttcatgacctggataggctgtgtctgcctggcttgaacataactgctgtatttcacatcccccccatcaaaagtatttgggtagatgaggtctctgaggtctctggaggttcagcatatcattattagaaatcgtcttctaaatcctttgtcagaaataggctatggaaagtctgccacagtttcctgtatagctagcctcagaggtcatgttgaccatctttgtcaaaacgtgttggtaaccaggcatctccagagagctgcaaagctgtagagaagttccttttcctccatgaagcttttctaaggatatagaagacttctaacattcaggggtaaaatggcaacagtgatgacatgttagaggcaaaactgcagacacttctaacattcggggtaatggcaacagtggtgaaatattagaagcaaagttccaatttcacatatatttcatgagaacctctatgatcccagttatgtgttaggcactaaatgttttttatatatgtatatatatacgtgtgtgtatatatatacacacacatatatgtgtgtgcgtatatatgtatatatatgtgtatatatgtgtgtgtgtatatatatatgtatatatatataagccagacagagttactgcctaagggagcttaccatttgagaaaggttaagatgtggagagtgagggagagatttgagtcctttgttttgtgtttgtgcatatgaggggttgtgtccctgtgtgccttaggatgctcgtcttctcattcactgttttacaccaaagctgagtttgtctttctgcctgagtttgtaacactttgaccttttcagtgctatgcataatgttactaattcagcctggttttgatttggatagaggcaaattataacctgtgtttagagcttcacctgctcctttctcctgcatagagtgtggcacctggctgttaccctgagagcttagctgggagcaccttgtaatagattccaggttcccttacccaccccgtttccattgcgctccccttatctctggtttccatgtagatgctgacatcagaaggaacacagcctcaagcagcaaatccttcgtttcctcccagtccttgtgagtacttttttttaccaaaaaaaagaaaagaaaaccttaggatatgtagagaaacaaacccagttcttggtgtatggctgggcaaagccatccagatgtaagaggaggcgaggttaaagggaggggcttgctgatggtgccgagcccacgggaagaaagcagaagctctttggtcccagtgggatgggctctcgtggaggcaaagctggaagtgagttattccttctctgctgactctcatcataaccagaggccccagaaggtctcaaaagagagcagtgatgatggtttttggttatgaaatcaaattgaacagattccacatcatagacccaaccaggggacacagtagctcatttgggaggaaaaatcgctttgtagtccacaaagcaattttactcactttgttttgtaagcaggcattataatctccattttgctgttagaggagctgaagttcagagaaaggaagtgacagagtccttcattagcagtgccgtgcagtggcaggaagtggggcttgaaccgaagtcttaggaccgtgagactagtggactttgactgtcccatgtgtgagggtgatgagcaggccagggtgctgcgggtgttcttccagcccagaagttgctgcgtgggggatgagatcatgaagggaagcctcgcatcgcccatcctttccctgtgttcagccgtccttgattctcccctttccagctcccactgcttcctgcactccacgtctgctgaggcggtggccatggggctcctgaagcagtttgaggggatgcagcttccagccgcctcggagctggagtggcttgtcccggagcatgatgcccctcagaaggtaggtccttagctcttcttcctacccaggggccatcgtgagcctctgtgaccttgttttccttcgtcacatgtccctagtctggaatgagcctgggtgttccccccttactcgtggaagccattcattacaatgtgtcaagtgataaatgaacgagtgaatgcttgctcaccttgtcagagcagagatgacggcgcgttcgcggtccttattcacgtgactgctcgccagactcagtcatgtttggtttgtgaccacctcggagacactacgcaaaagtaaatcgcttggattctttgctctgcagttgtctttaaggcatgaaacacactggcacagcaagggtcctgggatgggtgcagggacagcatgagccgtggggccactgccctggtaggctgtttctgtttgcttcttggaacccacggccctcacttgtagtaccttggcgcctcctggttgtttctgaggttccctgaagcccttatcctgtggtgttcctgaaatgtctttcactcattatgctctgtcatggccaaaagggtcccgcatttctgtttctcaagcccgtccgtgtgaacttaccccaactgtgtttttctcctgcccatccctgactcactgcccatctcaccagatgacgggcagcacactgacacgagcttaccccaactgtgctttcctcctgcagctcctgcccattcctgactcactgcccatctcaccggatgacgggcagcacgctgacatctacaagctgcggattcgtgttcgtggcaacttggagtgggccccgccccggcctcagataatttttaatgttcatccagccccaacgtgagtggccagtgtctgtgccctttggagcacagatccgtcctctttggattgtcagggttttcgtctcacccacttgtccctgcctccagctgtccttcccacaccgttctcttcatttaaaggcagagggggggcgtcgtccatttggtccttcgtttcttactcttaattcctggagctaattggaaacgaggcgggttttgttttgctggcattcccaacctgtagctttcctcccagtagttgtgtgggcttgctggtttttcttctctttctaagatagatggatgctcttctctcctgtcattctctctcctttaccacatctcattccttatatttgtacagaatgtgtggttccttactgggcagagtgactgcctagacctaaatcttatatggagttagctctcccaataggttcatttttgtccaactaaaatgtaggtgaattcccctctcttcccatacttaactggagctgtatgtatgtgtgctcactccttcacacctccaaggtctcacgcagctgctctgtgccaatgccctgtccttacccttcctcaggaggaaaattgccgtggccaagcagaattaccgctgtgcaggatgtggcatccggactgaccctggtgagtgccttcccttcccaccatgctgcctccagaggctctgtaccctccccgacacgtagggagaggtggcgtgtcaaaggcggtagcaggaggtggcgtggcagaagtagggaaggagaaagaaaggttcgtagtaggcaagagtgctggcaatcggagggaaatgatttctgggagcacatggccaggattgtatcctgtggaaagttgggtagttccagctagctggtaaggcgggatcttactatctccagctggttttatttcctcagggcctccaaggtaggacattatcaccccaggatccactatgtggatttctgcaagctttggggaactcagacagaggttgctggaggccattggctgtccctctctgccctttcaagggaaaagcagagctgccttcccagcttgtagatgggaaagttacatctggctttctggctttccggtttttccagattacatcaagcgactgcggtactgtgagtacctgggcaagtacttctgccagtgctgccacgagaatgcccagatggccatccccagccgggttctgcgcaagtgggacttcagcaagtactacgtcagcaacttctccaaggacctgctcattaagatctggaatgatcctctcttcaacgtgcaggacataaacagtgccctctataggaaggtcaagctgctcaatcaagtccgggtaagaccttggaaaaggccaccttagagtcttgcccttctcctcccctcatcccctcccctcgtccctcccccgtcccctccccccatcccctcctcttgtcccctccccccatcccctcccctcgtctcctctccttgtcccctcccctggttatatagggcttcccacaattaccacacttcttgttatcgcagtgtcaaagctataaccgtctctccgttcatgccctcactatgtactttcttaatctcttcccatttcccaggttatctgtctagttggagcctcaaacgtggcaatggcagctaggaagctgtagatagcacttgagggcaaaagcagaatttcttccttcactaaaaacattagtgaatgaatgaggaatcgggtatcgagtaagaaattggaatttcggagcactcctctgcccagactgcttatgtgactcgggcagacagacctggcggaggggccttccctgactagagggcactctgaagccagttgtcagagtgagttagagcaagttagagcataggacagtctgaagccagttgtcagttagagcgtaagacagtctgaagccagttgtcagttagagcgtaggacagtctgaagccacttgtcgagttagagcgtaggacagtctggagccagttgtcagttagagcgtaggacagtctgaagccacttgtcgagttagagcgtaggacagtctgaagccagttgtcagttagagcacaggacagtctggagccagttgtcagttagagcgtaggacagtctggagccagttgtcagagcgtaggacagtctggagccagttgtcagagcgtaggacagtctgaagccagttgtcagagcacaggacagtctgaagccagttgtcagttagagcacaggacagtctggagccagttgtcagttagagcgtaggacagtctggagccagttgtcagagcgtaggacagtctggagccagttgtcagagcgtaggacagtctgaagccagttgtcagagcacaggacagtctgaagccagttgtcagttagagcgtaggacagtctgaagccagttgtcagagcgtaggacagtctgaagccagttgtcagagcacaggacaatctgaagccagttgtcagttagagcgtaggacagtctggagccagttgtcagagcgtaggacagtctggagccagttgtcagagcgtaggacagtctgaagccagttgtcagagcacaggacagtctggagccagttgtcagagcgtaggacagtctggagccagttgtcagagcgtaggacagtctggagccagttgtcagttagagcgtaggacagtctgaagccagttgtcagagcgtaggacagtctggagccagttgtcagagcgtaggacagtctggagccagttgtcagttagagcataggacagtctggagccagttgtcagagcgtaggacagtctgaagccagttgtcagttagagcgtaggacagtctgaagccagttgtcagagcgtaggacagtctggagccagtggtcagagcataggacagtctggagccagttgtcagagcgtaggacagtctggagccagttgtcagttagagcgtaggacagtctggagccagttgtcagagcgtaggacagtctggagccagttgtcagagcgtaggacagtctgaagccagttgtcagttagagcgtaggacagtctgaagccagttgacaagttagagcgtaggacagtctaaagccagttgtcagtcagagcgtaggacaggctgaagccagttgtcagtcagagcgtaggacagtctgaagccagttgtcagagcataggacagtctggagccagttgtcagagcgtaggacagtctgaagccacttgtcgagttagagcgtaggacagtctgaagccagttgtcagagcgtaggacagtctgaagccacttgtcgagttagagcataggacagtctgaagccagttgtcagagcataggacagtctgaagccagttgtcagttagagcacaggacagtctgaagccagttgtcagagcgtaggacagtctggagccagttgtcagagcgtaggacagtctgaagccagttgacgagttagagcgtaggacagtctgaagccagttgtcagttagagcatacgacagtctggagccagttgtcagagcgtaggacagtctgaagccagttgttagagcgtaggacagtctggagccagttgtcagttagagcgtaggacagtctgaagccagttgtcagttagagcgtacgacagtctggagccagttgtcagagcgtaggacagtctgaagccagttgttagagcgtaggacagtctggagccagttgtcagttagagcgtaggacagtctgaagccagttgtcagttagagcatacgacagtctggagccagttgtcagagcgtaggacaatctgaagccagttgtcagttagagcgtaggacagtctggagccagttgtcagagcgtaggacagtctggagccagttgtcagagtgtaggacagtctgaagccagttgtcagtcagagcgtaggacagtctgaagccagttgttagagcgtaggacagtctggagccagttgtcagttagagcgtaggacagtctgaagccagttgtcagttagagcataggacagtctgaagccagttgacgagttagagcgtaggacagtctgaagccagttgtcagagtgtaggacagtctgaagccagttgttagagcataggacagtctgaagccagttgtcgagttagagcataggacagtctgaagccagttgtcagagcataggacagtctggagccagttgtcagtcagagtgtgggacagtctgaagccaggtatcgagttagagcatacaacagtctgaagccagttgtcgagttagagcgtgggacagtctgaagccagctgtcagagtgtgggacagtctgaagccaggtgtcgagttagagcgtaggacagtctgaagccagttgtcagtcagagtgtgggacagtcagaagccaggtgtcgagttagagcataggacagtctggaaccagttgtcgagttagagcgtgggacagtctgaagccagctgtcagtcagagtgtgggacagtctgaagccaggtgtcgagttagagcgtaggacagtctgaagccagttgtcagtcagagtgtgggacagtctgaagccaggtgtcgagttagagcataggacagtctggaaccagttgtcgagttagagcgtgggacagtctgaagccagctgtcagtcagagtgtgggacagtctgaagccaggtgtcgagttagagcgtaggacagtctgaagccagttgtcagtcagagtgtgggacaatctgaagccaggtgtcgagtcagagcataggacagtctggagccagttgtcagagcgtaggacagtctgctctgggtgcagcatgcaaggcttctagaaccccagggtttaaaggccctgggcttcccacactggattcctcttctcacatctccctcccactcctgcccccctctctttcttttcagctgctgcgggtccagctgtgtcacatgaagaacatgttcaagacttgccgactggccaaggagtaagtccttttggagctagagccctctggccacgttgctgtctccgaaagggacacatccccgcgcttggctcttgttatgtaacgaaggagagtagagagattttgcagaactgtaaagtggtaaacaggaggccacagcagtaactgtatctgtgtccttctctctggaaggggatctgtggtcattccatccaggacaggccacctctcttcccaggctgggtctcacatgggccactctgcaggagcctataaatcagtcactcctgccatccagacacctaatagcgtggaacggctgcggcggcctggaaccttgggctggctgatgggtgcccaccctcattactttctgcagtttctggatagggatccttctactacgatgtggcacatgcactgttcattccctcacctgcctcctgtcactccctgtaggcttctggattcctttgacacagtcccaggccacctgacagaggacctccacctgtactcactgaatgacctgactgcgaccaggaagggggagctggggccccggcttgctgagctcaccagggcaggggctacccatgtggagagatgcatggtgagaaagtctcactgtagcatgcagctgagcccttgcttttagggatacagggaggggggtggacctggggttcttgccacttagcttgaggaagttgaaatggccagtcagcactgggagaggaactggaaagggctgctgttccttagcctggagagcagccaaatcatcctgatctaaagaacctcgagtgaggggaggagctggtgctggctgtggtcctgggtagctccgggcaagaccgagtagactttcactcaagaagtgttggccaggcacggtggcttaggcctctcatcccagcaatttgggaggccgaggtgggcgggtcacctgaggtcaggagttcaagaccagcctgacgaacatgatgaaaccccatctctactaaaatacagaaattagccgggcatgatggcgggtgcctgtaatcccagctactcgggaggctgaggcaggagaattgcttgaatccaggaggcggaggttgcagtgagccgagatcatgccactgcactccagcctgagcgacaagagtggaaaaaaaaaaggcagttgtcatgatgtgagaggagagctctggattggaatcgagagggagtctaccctcggccgtcatttgttgttctcagtcattatgaccaaaataaatactttgtcccctctgaggcctcgattttcttggctctaagatgaagagaataatttactttcttctcagtatttttgagggttgatggggtaatttgtatgacagcgttttgtatactttatgtattcctcaaacgcacgtcgttattgtcgtcatctactcaacatgttgaaaatgcagaaattacacttttagaacttcctgtcttagcctatgcccagtttatgttcctgtgaccgtcccataattcgagctgggcacaggtaggaaaccctgtgtgtctgggaggaactggaaatccttcactacaacctgactccaggcttggagctgtgtttgaggaacagcctcgtctccacattttatcttaattgcttgtggttcctattctgaaataaaatcatgacccagatgggactgtcggcttaggaagccctttgtggtgccatttcctccttctcctctcttcatggagagccgcgctgggggtcggagcttctccggctggtgcctgtctgatcttctgcctaaagctttgtctaacgctgcccggccctggtcctagtttagctttcatgcttctgagtccagcccaggcctcctccctgtgggcagcagaaccctgtagaccactcccctcctcggtgttcaccctcccgtgccagttcctgatgtgccgctcctcattttgccatctgtgtttttcctccccagctctgccaagccaaaggcttcatctgtgagttctgtcagaatgaggatgacatcatctttccctttgagctccataagtgccggacctgtgaaggtgagggcaggtgcaggcatcgggcaagtgagcctgaacacagggctccttgattccccagagccacccctgttagcaagagttcggtgccactcagcacctcgcggggcctccccaggggacaccacgccttggtggcgagaaggggctgtggcagcaactgacctctagctggagataatacaaattgttttcttctctcccccaccttcccaacctgagtagagtgtaaagcgtgttaccataaagcctgcttcaagtctggaagctgtccgcgctgcgagcggctgcaggcccggcgggaggcactggccaggcagagcctggagtcttacctgtcagactacgaggaggagcccgcggaagcgctggccctggaagccgccgtcctggaggccacctgaagaaagcacgtgcagccctccctccgggccgggtcacacctgttgcagaactgagccactctttgaaggactcgccccacctggggcttctttttttttttttttttttaattatcatcatctttttttttttttttactgacttgtctgacgtctgtgtgcagtcagccgtcggcaggttgatgggtccagagtctgtggtgacagataatttgtaaacaccaggtgtttccatcagaactgacatgcgggtccttcagtgaagcttctagtgcctctgtcagtggaagagacagcaagaccaagttcttccagcgtctgtggccttctcctctaggtttcacctgcatgtcaggtatcatttccaattttcctttgtttcagttctggagcttctgagccaggcctttctcaaccacctctcctgctgctgaaacggggatggcgttttccctctccctgtcctggactggggtcagactgtgccccgaggagaagcagcagagaataggactacgtcatgggcatttcgtccacttatttgggtattttgggggccacagaacaatcctgactatcctagactcctcagagacctcagaggcagctgtgaatgtccctatgttgccgggagttcctgtttgaaatatttgaagcatagaggatgccacaagctgactttcttcatctaccttggtgatcttgaagcaaagaacagaactgatgctcaggccaggctcacctgtagccttacgccgcaagcatacgtgaggcgccagctctgtcgctgaaggagcgcttactcagaggagcggtcggccccctcttggtgttaaggtctcttagttaacctggctttttggtgcaggtgtgatctttgaagctcaggcaggtccctgatgccatcctaaggtgaggacaggaacctcacccaccatcttcttagcgtgtccctgatgactctgtcctctgttagatggtcgttgtgcttctgagtaaaagtacaacccgactccgttctctccccttcctgcagcagagctgggtccttccctggtggccgagtctctcttgccttagcttctttggtcaaagttggagaaaagcttcctgctattagtgctgttacagaacttgacggtttgtggatgtgagtgtgaatgtccctgtgttcttgggataacaagagcctttatgccaattatgcacttaactctgtgtagcctggtaatgtttatctgttcatttgataatgctgattttagtgtgctgcccccctccccccgttaatgtgtgttgatggtgaagtccttttgataatgctgattttggtgtgctgcctcccccttcccccccgttaatgtgtgtgttgacagtgaagtccttgggtggggccatgtgtgtgtttgtgatgttccttaagttgatgcagcttctaacctctgtgaaaacactggtcagagtggcttctccaagagctggcagctctgtgaactaaagcctgcatcatttttgttctgggattgaattctgcccatgggcatgtcttctcatagttgcttgctggtaggaaagaaatgggcgtgggtgctgccctggaagctgagcggaaagttgcctgtggttggtggaagctgatgagagcttgagctggcggtaagaaggagtctcccagggaagtgggagaggcattaaggtgatggccagggctgaggctccaccagcgtgagagggaacatgtgggaactggcccctgcccttgattcctctgcctcaaagttgggatctgaaagccatgtagggctagaagaccctgaggctgttctcccttctgttcatagtgagactcaaaaagccaagtcccagaagttctgaagggctgtgactagaagtgcccaggtccttcagggagctttaagaatgaccccacagaactcaagtttaactaggggttaggtcccagattcagacccaggagtttataaaaatgagctctacttccagttttggtttaaattacacatccaggccaggcacagtggctcacacctgtaatcccagcactttgggaggccagtgcgggcggatcatgaggtcaggagtttgagaccagcctggccaatgtggtgaaaccctgtctcttccaaaaatacaaaaattagctgggcgtggtggcacacgcctgtaatcccagctacttgggaggctgaggcaggagaatcgcttgaacctgggaggcagaggttgcagtgagccgagattgcgccaccgcactccagcctgggtgacagagtgagactccgtctcaaaaaacaaaaaggtgacacatccagctctttctccaggtcactgcgctggaggacagatgtgccgtcttgtcctgcctgtttcacatcagcataggatcaaaggatgacaatgctgacagcttctgaagccgaactcaacagtctcataggctcctcacttgtcacttatttttccctagctccctcaaccgcaccccatccctttagatcgtgcgtctgttttagtgactctgacacgatgccgtcctcaccttccaaatacccagttatttattcaagaggggggaagtgggtagaggatgggatgttttggaagcactttgcaagttaccactatctgaaaatcccctgctgttgcggggagaagctttgaatgcactgaagagaattccttctaaatgaaggcaggtgatagtgttctttctgtaagtaaagggaaagaaaaaaaacatagtttgcttaccaggtggagacaagattcaagacatagcagaagagtggaagacaaatattttccacttaaatgaggctgtttttgacgttctctgccaaggatttagagctttcgttgaactaacataaaaggagtgcgagtcttagtagagatgttccgtgtgtgccgcccgtgctctgaactgcgtttccacctgctgtggtgcttgtgcagcctggcagttcattgtcatctttaataaactaaggaaataaaattctgtctttcgtcagcctgccttgactgtcaagaaatggcatgtgtccactgtaaagcaggtatatctgaacattgagaaggtttctgtgttataatgtaaagcaaactggaccacacacatcaaggaaagtgaggtggagtggctgtgtctctaacttgccatgagacctcgagcgaaccacttcacttctctgggtttctggtgcatggtgtaactgtcacttaaaatgaggtgtcttcctctccgcaacatctgacttgccttagatgcttcagttcccacttctgtgagcagctagcatctttctcttctgctcctggcccactggagctccagctctacgctgcaactctctcaacatttccccttaaatgtccccttgtcatctccaaccagtgtgtctaaaaccagcataaattccgtatttccaaaaacctaaccattagtcacccaggtttgaaaattaattgtcttcaacttcctctgtaagtggcacactgagctcatcacgcatcgtctcattcctactccctgtcatcaagttctgtggatgttttcctctaaaataaatctctcattacttttctgccactagcacacaaa

SEQ ID NO: 590 - DNA, 549721 bp, Homo sapiens
ggccccttcgtggcgaccacaagtcctatcacgccacaagaatctcggcttgttcacctacaaatgaaggccgacgatacttgcagaccgagtctgacatctatgggaccccactcctaccctgcgcctcaggggccgggacaaccgtgacccgtaccgactcctcgcgcctccgggatcaacctcagacccctgtgggctcccggggaagacgcatgcgcactgctccctcctcgtctccttcccttcgttaattagtccatcgcatttcaagtgctggatcctttttgtcccctactgcgtgcggtggcagcttccttgcggaagtggtgaccgtgagagaagaagatggcggcccctgtagtggcgccgcctggtgtggtggttagtcgggctaacaagcgcagcggcgcggggccgggaggcagcggtggcgggggagccagaggggcggaggaggaaccgccgccgcccctacaagcagttctggtggccgatagcttcgatcgccgcttcttccccatctccaaggaccagcctcgggtgagcgccgcgcacgcgagcagccagagggcaggaagggtggcagggctggagcaagttctcatttcggctaactacaacagcatgcccttgaaggacctgcgtctatgctgttatcctaaaaccggatgcagagggactgtctaaaccctgatgactgctgaccaagttagtggccggcagatttgggcattcgtaatgctgtccacctcgggtttgaaaggaatgaagagagctaaatgtagaaacagcgcttgagagaagccttcacgcggggattcagtgcccctagaagaggctgcgccgcttttaaccttgccgatgacggttgcttaggtgaaaagaaacgaccttttgcctctgaaagggcggtaatatgccttaaaaagagcgggctagatctcaggcagtgtattttttttttccttccaggttctaatgatagccggtgctatctgtcgaaaggacaaaatgggtttagtggttgattgccatcagcccccgagttgtctagacaatggggtattggactcagctgggtcgttcagcagtcagttcagaaagagggaactgcattggatttaaggaaaatcctctctaattccctcgaaaaagcctaatggctgttcatttttgacaagtgacgggagatggctaacctctgacacttagaaagggatcaaggaaggaaatcttatggggaagaaggccttagcaatgcttaaatttatggaaatatgattgatttccagtattatcctttgccagcagtgaactgccattctgtcacagctctgtgtctgatacaaggcacatagattctgtacttaccatccccaaattgcaatgtctcagactcaggcttagagcatggcatgaacatcaaaggcaggaacctgtttatctttgaattggaaagatacagcaaaattacactgtttggaaatacgaatagaggagtgaaaattgttgcagtggggtacccaaagggattcgagacctcaagttttttttcatcttgtatccttcaggtcctcttgcccctggccaatgtggcattaattgactacactctggaattcctgactgccacaggtgtacaggaaacatttgtcttttgttgctggaaagctgctcaaatcaaagaacatttactgtaaggccctgcaacttttctttccatgtttcgccatctttttccagttttttcaggatgaatgtaactaaggggaaatgtgagaggggaaaaatgtgtctacttagatgtcattgtaagttctaagggtattttctacacttatcaggaggtgagcagctgaaactttgtatctgtctgtcttgggttttctgtgacaaagattaaagaataaacttgggttttttctgaatctcattataaagtttggtgccagtggactttgcttttatttaatggcttcagtatggaagttacaatgataacatctttgttttcccactgagtttctaaatcttgtttgttctcaccttcaaggatataaatgagctccttgtcatctttgtattcccactgcctagctcagtcccaagcatatagtgagcacttacatgtttgttgaaatcttgaaaactagggaatcgcattgcttatggaagtccaggatgtaaagactaggacattagcatggtctccatcagacagttcctaaatgttatatggattgcagaaggggaaagctgacgtgaagcgtgttcccaggctactttgtgtaccctaggcttcagcaggattttgagttcaaattgatgtttagggacaaggggtcaaggtatggagaggaaataaccatgtttcctaacccataaaacaagactggtgacacaggatgctgaaagcattcattatagttcataatactctttgaagttgaagacgctggcaagaacccaaaaaagccatcgagaaggactgtgagtgctgaaagggggtgaaaaatggggaaggctcaaatgatctttatgcttgatacactcattcccctcaccctcccttcctttaggaagtcaaagtggtgccgccctacatctctcaatgtggttcgaataattacatcagagctctatcgatcactgggagatgtcctccgtgatgttgatgccaaggctttggtgcgctctgactttcttctggtgtatggggatgtcatctcaaacatcaatatcaccagagcccttgaggaacacaggtcaggatgggaaaatgacaggaacaagggttaaagaccagcagagccctgagactgcttttttgcagttctgtccctcctgtcctttataggttgagacggaagctagaaaaaaatgtttctgtgatgacgatgatcttcaaggagtcatcccccagccacccaactcgttgccacgaagacaatgtggtagtggctgtggatagtaccacaaacagggttctccattttcagaagacccagggtctccggcgttttgcatttcctctggtgtgtggatatctggggtcctttgagatggggaagtgacaggcttcagtgggagaaacaaattaaagtccttgtaacttctccccacagagcctgtttcagggcagtagtgatggagtggaggttcgatatgatttactggattgtcatatcagcatctgttctcctcaggtgagctctttagggctggggctgcacacccaaagagtagaactctgtgggtctgttattgtccccttagaaggccagggtatatttcttctccctgtttattttcattatttttacttttattttttgagacagagtctcgctctgttgcccaggctggagtgcagtggtgtgatcccagctcactgcagactctgcctcctaggttcaagtgattctcctgcctcagcctcctgagtagcagggattacaggcacaccaccatgcctggctaatttttgtatttttagtagagatggggtttcaccatgttggccaggctggtctcgaactcctggtctcaagtgatctacctgtctcagcctcccaaagtgctgggattacaggcatgagccaccacacctggccttattttcatttttatttatatatattttttgagacagggtctcgctctgtggcccaggctggagcacagtggcaccatgactgctcactgcagcctcagcctcccaggttcaagggaacctcctgcctcagcctcctgagtagatggaaccacaggcatgcactaccactaatttttgtatttttttgtagagacggggttttgccatgttgtccggcctggtcacgaactcctgagctcaagcaatctgaccacctcagccttccaaaatgctgggattacaggcatgagccaccagttttttttgttgttgttgttgttattgttgttttgagatggagcctcgctctgtcgcccaggctggagtgcagtggcatgatctcagcttactgcagcctccacctcctgggttccagtgattctcctgcctcagcctctcaagtagctgggactacaggtacgcaccaccacatccggctattttttgtatttttcagtagagatggggtttcaccatattggccaggctggtctctaactcctgacctcaggtgatcctcccgccttggcctcccaaagtgctgcaatcacaggtgtgagcctctgcacccagcattttttttttttttttttttttttttttgagtcggagtttcactcttgttgcccaggctggatgcaatggtgcgatctcagctcactgcaacctccacctcccaggttcaagcaattcccctgcctcagcctcccaaatagctgggattgcaggcatgtgccaccacacccagctaatttttgtatttttagtagagacgaggttttaccatgttggtcaggctggtctcgaactcccaacctcaggtgatctgcctgcctcggcctcccaaagtgctggcattacgggcatgagccactgcacctggccttttttttttttttagaatctattgtaaagcaaagatcttgtctccagtatcccactgggagtctctttggaattctggtccatgttcagctgtcatagggtttgctaggtctctgggggattatctgtgctcctagagaatagtacttaatcctggccaagcgtggtggctcacgcttgtaatcccagcactttgggaggccgaggtgagtggatcatgaggtcaggagttcaagaccagcctgaccaacacagtgaaatcccatctctactaaaaaataaaaatacaaaaattagctgggcgtggtggcggacgcttgtaatcccagctacttgggaggctgaggcacaagaatcactttaacccaggaggtggaggttgcagtgagccgagatcatgcaactgcactccagcctgggcaacagagctagacttgtctcaaaaaaaaaaaaaaaagaatagtacttaattctagcccactccacttcccttccacaggtggcacaactctttacagacaactttgactaccaaactcgagatgactttgtgcgaggtctcttagtgaatgaggaggtgagaaaagtcttccaatgcctctttaggagagaggagaaggctatgattgtatctcatgctggtaacttttgatcttttttgtattttattgaggcttaggagggaggaaaagcaggggacaggaggaacagtacacaaagaagaatctttgtggcagtgagaggcagaggggaacttaaaaggattagaaaagttgtacttgggggcattcttcctgtctttcttgcttaggtgacctccctttccttctcattcagatcctagggaaccagatccacatgcacgtaacagctaaggaatatggtgcccgtgtctccaacctacacatgtactcagctgtctgtgctgacgtcatccgccgatgggtctaccctctcaccccagaggcgaacttcactgacagcaccacccagagctgcactcattcccggcacaacatctaccgagggcctgaggtcagcctgggccatggcagcatcctagaggaaaatgtgctcctgggctctggcactgtcattggcagcaattgctttatcaccaacagtgtcattggccccggctgccacattggtgagcacaggtggggaatcaagccaactatcctaggaacaggaacctgggggggccacgtctccagaaacacaagggatggctacacaagggacagtccctgggaataaggaactatagagcggctacctcaggaaaggaggaaacagggatttgaaaacagcgataccttaatttgtagcctgtgggcctctcattggatgactcttcacattccagggtaccctgtagtcacattcaggagcaagtagataattaacatgcagtaacaacatctatttagcacattacagtttacaaagggcttttatatacattgttacatttaatcttcataatttacaaataaacaggctcaacaagattttcttgcccaaggtcattggtaataatggtgggacctgaatctgggtattctgaatgtaagtccagtgttcttttgagtctaccataactgcctggttggcctcttggtatctcattttggttgcaggagtgtgatgcgtctaatagtactgcccctttccaagaacaacagtaaggctcagattctaggggctgagcgtggtggctcatgcttgtaatcctagcacactgggaagccatggtgggaggatcgcttgagcccaggagttcaagaccagcctgggcaacatagcgacaccccttctccacaaatgatacaaaaattagctgggcatgatggcgcgtgcctgtaatctcagctattcgggaggctgaggcaggaggattacctgagcccagaggtcgagggtgcagtgagtcatgatcatactactgcactccagcctgggtgatggaatgagaccgtgtctcaaaagaaaaaaaagacttggtttctaaaatgtaccagaagaggtggaattatttggttctgcttgtaggcgtggatatgattctaataaggttttttgagttcagagggtccccagaaatcctgaaggttctcgggttcttaagctctgtgtgtagtctataattgttgtaaacttggtgaagtatcttctcaggcctgggcttagggggtgagtgggtgtttctggtgacttgcgggatggggaatgagagctaggtgggagctgtgctggtgtcagtcagccctgtcctctatgaagggctctgctctgcggttggaaccctgagttacccagaggtcttcccatcctgagccaggtgataacgtggtgctggaccagacctacctgtggcagggtgttcgagtggcggctggagcacagatccatcagtctctgctttgtgacaatgctgaggtcaaggaacgagtgacactgaaaccacgctctgtcctcacttcccaggtgagacctgatctatactgtgcacaggccctgaattgcatggcagtcacactgagccagaaggggcattatttccacccataatcctgtctaaaaaagttgctctcattatcaggatgcacttttcctccacaccctaatggttctgtgttttttttccccttaggtggtcgtgggcccaaatatcacgctgcctgagggctcggtgatctctttgcaccctccagatgcagaggaagatgaagatgatggcgagttcagtgatgattctggggctgaccaagaaaaggacaaagtgaagatgaaaggtgtgagactcaacaggtgtggggcatctgtgtgtctcgctgcctcatagaagaaccagtgtttcctcctggagggattggtgcttccgccgggccctctctatagatcattgccttttccaggttacaatccagcagaagtaggagctgctggcaagggctacctctggaaagctgcaggcatgaacatggaggaagaggaggaactgcagcagaatctgtggggtgagctaggcctgatgcctgcccttctcctcctgaatcggaatattttgaaggataatgaatacttcagagtcacattacttattcactcctttattcaggcagacagggcaggtatattgctctctgtcaatgactctttttttctttttcctcacccattatggcttctcaggactcaagatcaacatggaagaagagagtgaaagtgaaagtgagcaaagtatggattctgaggagccggacagccggggaggctcccctcagatggatgacatcaaaggtgagtggcaggggagaaatgcgctggaccagtttattctctgcctggatcaactagccagaggcttacgttcctcagaaagggtttggtatcgagtcaagactagatgacttagagcattctgaatgatgttggcccatgaacttatccttgctttgatttcagtgttccagaatgaagttttaggaacactacagcggggcaaagaggagaacatttcttgtgacaatctcgtcctggaaatcaactctctcaagtaagagcagcccctccctgttctcctcggggtgatcccgggaaggtagaggctttctcgtaagtgttttgtctccaaataggaacctattccttcgacatcccaaatggaaagaccagtagtatttggagcaaggagagcattattaagttctagcctcagcatagactttctccttcctaaaccctccccttccatattgttccatccagattcctctccaatgtctatcaaagtcatagttctaagcctgctgaaaggccagtgaaggccctggtgtcaccccagtctccccacaggtatgcctataacataagtctaaaggaggtgatgcaggtactgagccacgtggtcctggagttccccctgcaacagatggattccccgcttgactcaagccgctactgtgccctgctgcttcctgtgagcaaagattggagctgagtacaagggattgggtacaggcaaaggaaatcaggagtagactgtcttgttatattgggtgtatgtcacttctggttcctttttccttgcctctggaagctggttgggctctagagcagccttggctggttcagaggggtcagattgagttcaatactgactggcctttgagactccaggatttcataccatcctaggcccacaaaggtatattcagaatggacctggacattcagactctatggcagcaatttgacccaacacaagatcagcctctggggtgggaataggtattttgaggcagcctatagcatctgatcccctttcaccttccctaaggaatctctttttcccaaaccctgtcaacaactcccaagtccctctgacataattccacagaacctgtatcatctcccttttgtccacccatgtcatcagtatggatttgcttggatgtccaggtataggtgaatgcttaggaatatactgcagctcccttctttcttccatagctgctaaaggcctggagccctgtttttaggaactacataaagcgcgcagccgaccatttggaagcgttagcagccattgaggacttcttcctagagcatgaagctcttggtatttccatggccaaggtgaatatgacctcaagccccattcttctgcacttgctttcaaacgagggttggtgacccccttgggagacataaaatagaagctaatgtgaatccagtatggaccatccactcccaatatgcttattgctagaatagtacagcttggagccggactaataaggtagccatctggggggtggtctggaaatgtgcaaagctctccccagcaatagttccagaagttagacctgccccaggagcagagcgaacagctcactcttgtccgttttggaggaggctactcagtgcatagagggatctgagggcctggtagagtatcctgctggactttccaaggcccctgaggtcccctttattggccttttgcaggtactgatggctttctaccagctggagatcctggctgaggaaacaattctgagctggttcagccaaagagatacaactgacaagggccagcagttgcgcaagaatcaacaggtgcgtcaggctgtcctcctctcgccaagatggttatctcattcccaggtcctggcccctagactctagggtggttggtttctggggctctggttgttagagctgtttatctgccgaggggagcaggagagttatgtgcacctcccccagccgatctctcctctgcttctttacagctgcagaggttcatccagtggctaaaagaggcagaagaggagtcatctgaagatgactgaagtcacactgcctgctcctttgggtgtgattgagtgccctcctggctcctgggctgggacaagtgaggaactagctgcagagggatgagtgaccaccatccaggctgagactgaaaggagcagaggctggaactacagtattctttcccctgctagcaaccatgtgcctcccatcctgactgtggagttgggatgtggaagtggggctggaacaaagcttctgcctagggaggagctaagcaggcccggcagttggaggaaggccagaggaacagctttgtgctccggctttccctcagggaacagcagagagcagttggctctttctgctgcttgtatatgttaatattaaaagagagagtggtgtatttggtttgtctccatccctgactaatcagccagtgaagtatgtgaccagaatcacatgatagcctttccttaacacctgggggagagggaggacgggtgtgccagccactaggtggtactgtggtaccttgctaattaacctttcccatggctcatgggtagtggagggcggaggttcttttccagcctctgtggaccaacttgtgatcctggggtggtgtgcctaagcccgtttccatagagtcccattttgaacacttttctgccagaggattatgttgccaaccatatgtaaagcccattagacatgccagttcctttcacatgccttttccagttgatctggtactcgttctgtcaggaagctgggccacgcttcatcagaaataaggaaatcagctcaaggtcacatgactcttgaggggtaaagctaaggacttgaccctcagaatccagaactctgtccttcagcgtattgtgtttcagtgaagggaaaattggccccacagacaaatataacccagagccagtaatggaggtcccaagaacacaggaaggccatgtgaagggtgctttcccttgagagtgtttactatgtgacaggcaagcagttttcacatattgtttcatttaatcctcacatgagccccatgaagtcttatccccattttcagataaggtgcctgaagctcacagagcttccctagctagtaactgacagagccaggtgtgatattggactcttgacctggagcttgttactttgctgtattgctttaaccttaaccaaaagagacatgcctttctgtcttttctttttgagttccttgtcttcatatagagtgagtcaacaattctggccgcgtgcagtggctcacgcctgtaatcccagcaccttgggaggctgaggcaggcggatcacctgaggcgaagagttcgagaccaacatagcgaaaccccatctctacaaaaatacaaaaattagctgggcattgtggcaggcgcctgaaatcccagctactcaggaggctgaagcagggagaattgcttgaacctgggaggcggaggttgcagtgagccgagattgtgccactgcactccagccttggtgatggagcgagaccctgcctcaaaacaatataataataataatttcctttagtggtacttaaacggtggctaatgtgactgttgtaacaagtgatgctctacccccccatccctaccgtcccagatgttacagaacaaatggttgcctttattcattttagttggatagaaagacataaactggcctaggcgcggtggcttacgcctgtaatcccagcactttgggaggctgaggtgggcagatcagctgaggtcaggagtctgagacaagcctggccaacatggtgaaaccctgtctctactaaaaatacaaaaattagccaggcgtggtggtgggtgcctgtaatctcagccgctcgggaggctgaggcaggagaatcgcttgaacccaagagacggaggttgcagtgagctgagatcacactattgcattccagcctgggcgacaagtgaaactctgtctcaaaaaaaaggatataaactgaggatgggctgactgaagtcagcttgtgggtatgaaggcatcactggaaaaggaaaagacaggctggccagggtttggcttaattttctagtaaatctcagtttctgtcttgttaggtataggatctagtgtctagtatgaagattctggcattatggcatggacctagtacagtgagacatccctgtatctgtactgaatgtatagcagaaatcagaagtagtctacagagctttttcagaaagagagattacttccagttagggtgattagggaaggctttacagaaatttgatgctggagtggcctaaaaaatagaagaggctggaagcatgcattaaaagcaaaacaaaaactttccagttaaatacggaaaattaaacacatgagcctttatgccccctccaaaaattctattgaaataccagtaaaggaattattttaaaaaggcacgtgctggctgggctcagtggctcacacctgtaatcccagcactttgggaggccgaggcaggtgaatcacctgaggtcaggagttcaagaccaccctggccaacatagtggacccccgtctctattaaaaatacaaaaaagccaggcgtggtagcttatgcctgtaatcccagcactttgggaggtcaaggtgggtggatcccctgaggtcaggagttcgagaccagcctggccaacatgatgaaacccccatctctactaaaaatagaaaaattagctgggcctggtggcaggtgcctgtaatcccagctactcaggaggctgaggaaggagaatcgcttgaatctgggaggtggaggttgcagtgagccgagatcgcgccattgcactccagcctgggggacaagagcgagacttcatctcaaaaaaaaaaccaaaaaacacaaaagtttagccgggcatggtggggggcacctgtaatcccagctactcaggaggctgaggaaggagaattgcttgaacccaggaggcggaggttgcagtgagccgagatcatgccattgcactccaacctgggtgacaagagcgaaactctcaaaaaatataataataaagccacatgacccagtgataaggaaaataggaggtgacaatgaatgagagatgccaacattttggaagatgaaaaacagaacagtcaacagtcacttaacagagtagaatgagttgggttctacctgctgagggagttaatggcaagaagtaagccaatgtgcccttctgaacccataaaaggttcagcacctcagaggagggtatggactgacgctgagaactaggggtggggtggaaggagattacacgatgatctgtataagaaaaagccccaccaagtcccaacctcatctgatccagccaagtgattacccctactcccttgcataaaatgggagattccgtctctggagaaatggtagggaggaagttagcaaagatagacttaaggtttcctaagcccaaaggtcacaagtttccagaccaactgtccatgagtgcccagcataatgaatgaaaaagcccatgaaatttcagaatgtccaggggaacttaaactatcagagcctctgcattcagcagcaggcatagtggggatagaggtgaggtattagattgaaaatgaagaattaagtgaaaatatatgagcggtgagactcaacatcagcacacactgacagaacctccagtatgaaaagaaacaactgcagggaaaaaaatgcctatgcatactgacactgacatttttggtttcttcaacaacaaaatgtcagctttccccccacatgatcaccctacagtgaagcctattcattaataataaagcttgtaaatagactgagcttccaatccactttttggtatctcactgttaaatatgaatagacagcaaaggaccattaaacatctgagtaaccttccaatatgaaagaccaaaacaaacaaatagaaaattgaaaccaaggaaacaataacaaagtagggagctttctgaaaacttcatggggaaaaagctacaataactattctcaaaactcaaagaaaagatattgtgtctatgaagtactttaaaaaggaagaattggagaagaaagagttcttagaaattaaaaataagtaaactaattccttctcttgagaattggaggattcgaggaccaaatagcagggtaacgtttcactgtatttccattcttacatacttcttgaatcttgaatcatgaatatattatctatccaaaaaaaaaaaaaaagtagtaaaggatcaatccataaggcccaaaatcatctactgggctgcggaaacagaataggaaaaatcggctggacgtggtggctcatgcctgtaatcccagccctttgggaggccaaggcagatggattgcttgatgccaggaatttgggaccagctgggcaacatagcaagatcccatctcgacaaaaaattttaaattatcagccaagggtggtggtgtgtgcctgtagtcccagctactcgggagactgaggtgggaggatcacttgtgcccagttcgaggctgcagtgagctatgatcacaccactgcactccagccaggaagacagagcaagaccttgcctccaaaaaaaaaaaaaaaaggctgggtgtgatgtgactcacacctgtaatcccagcactttgggaggccaaggttggcagaggataacttaagcccaggagtttgataccagactggccaatgtggtgaaaccctgtgtctattaaaaatacaaaattaggcctttcctttcagtggagcgtggcggcaagatggctgtgcaaatttccaagaagaggatgtttgtcactgatgacatcttcaaagctgaactgaatgagtttcttactcaggagctggctgaagatggctactctggagttgagatgcaagttacaccaaccaggacagaaatcattatcttagccaccagaacacagaatattcctggtgagaagggctgacggattcgggaactgactgctatagttcagaagaggtttggctttccagagggcagtgtagagctttatgctgaaaaggttgccactagaggtctgtgtgccattgcccaggcagagtctctgcgttacaaactcctaggagggcttgctgtgtggagggcctgctatggtgtgctgcggttcatcatggagagtggggccaaaggctgcaaggtcatggcgtctgggaaactccgaggacagagggctaaatccatgaagtttgtggatggcctgacgatccacagtggagaccctattaactactacgttggcactgctgtgtgccacgtgttgctcagacagggtgtgctgggcatcaaggtgaagatcatgctgccctgggacccaactggtaagactggccctaagaagcccctgcctgaccacgtgagcatcgtggaacccaaagatgagatactgcccaccacccccatctcagaacagaagggtgggaagccagagccatctgccatgccccagccagtccctacagcataacagggtctccttagcagctgtattctggagtctggatgttgctctgtaaagacctttaataaaatctcatacaaagacaaaaaaatatatacaaaattagggctgggcatggtggctcacacctgtaatcccagcactttgggaggctgaggcgggcagatcacctgaggtcaggagtttgagacaatcctggccaacatggtggaaccctgtctctactaaaaatacaaaatattagctgggcatggtggtgcatgcctgtaatcccagctactcaggaggctgaggcaggagaatcgcctgagcccaggaggcagaggttgcagtgagccgagatagctccactgcactccagcctggatgatagggtgagactccttctcaaaaaaaaaaaaaaagaaaaaaaaagttagccgcatgtggtggtgtgcacctgtaatcccagctactcaggaggctgaggcacgagaatcacttgaacccaggaggtggagattgcagtgagctgagaccacaccactgcactccagcctgagtgacagagtgagactctgtctcaaaaaaaaagaacattttaattaccatttttccgtttttttttttcttttagactgagttttgttctgttgcccaggctggagtgcagtgatgtggtctcagctcactgcaatctccacctcccgggttcacgcgattctcgtgcctcagtctcctgagtagctgggattacaggtgcttaccaccacacacggctacttttttgtttgtttgtttttttgagaaggagtgtcgctgtcacccaggctggagtgcagtggcgttgggattacaggcatggacctggtcttaattcaagaatttattgttggctgggtacggtggttcacacctataatcccagcacttcgataggatcgcttgagccaaggagtttgaggctgcagtgagccatgattacctcactatactccaacctgagcaacagagcaaggccttgtctcaataaacaggtaaataaaacaaaggagtaaagtatccaggaaacagattcaacacagagacaggtaaagggaattttgaggatgcagagaagtcccaggatgacagctgtgcacaggctgagatagccggcggtgcagaccagagcaaaagaatggaaggttccaccaagcgtggtggctcacgcctgtaatcccagcactttgagaggctaaggcgagcgatcacctgaggtcaggagttccagatcagcctggctaacatggtgagaccctgtctctactaaaaatacaatattagctgggcgtggtggcaggcgcctgtaatcccagctacttgggaggctgaggcaggagaatcacttgaacctgggaggcagaggttgcagtgagccggaatctcgccactgcactccagcctgggcgacagagtgagactccatctaaaaaaaaaaaaaaaaaaagatggaagcctccagggaaaaattgaactgatggattatctaatagctttgactgaatgaacaaaatgtgtattgagaaactattagattacatgggaaaaactaatgataggtataatatattaaaacaaatgaaaacacaaggcaatgattaaagtcagaggaaacaaaaaagttgtaaaggaaacgattataaaacacacatgaggccagcgcggtggctcatgcctgtaatcacagcactttgggaggccaaggcaggtggatcacgaggtcaagagattgagaccatcctggccaacatggtaaaaccctgtctctactaaaaatacaaaaatgagttgggcaggtatggtggcacatgcctgtaatcccagctactcggaggctgaggcagaattatcgcttgaacccgggaggtggaggttgcaatgagctgagatcacatcactgcactccagcctggcgacagagtgagactccatcaaaaacaaaaacaaaaacaaaacaaaaaaaactccacatgacttagcggtgaacatttgctcatagtcaaaataaggtcactactaagtactatattgacttagccaaaaagtgtgctttcactattttaagagggaagggtaaggtggaagacagagaatcatcaatcaaatttggaaatcaataagcaatgtctaaaatgtataaatcaagaacaagtattatgagctaaaaaaaagtactaagagtggtagggaaataggacaaagaattgctcgggttttttgttttgtttttctcaccactataccaataaggaggactgctgttttgttaaaaagctttttaagggccaggcacggtggctcacacctgtaatcccagcactttgggaggccgaggcaggcagatcacgagatcaggagatcgagaccatcctggctaacacggtgaaaccccatctctactacaaatgtaaaaaattagccaggtgtggtggcaggcacctgtagtcccagctactcgggaggctgaggcaggagaatggcatgaacccgggaggcggagttcacagtgagccaagatcgtgccactgcactccagcctgggcgacagagcaacactccatctcaaaaaaaaaaaaaaaaaaaaaaaaaaaaaaaaaaagccgggcgtggtggcttgcgcctgtagtcccagcactttgggaggccgaggcaggtggatcacgagttcagatcaagaccatcctgtttaacacagtgaaaccccgtctctactaaaaaaaacacaaaaaatttggcgggcgcctgtggtcccagctgctcgggaggctggcgtgaactcaagaggcggagcttgcagtgagccgagattgtgccactgcactccaccctgggcgacagagtgagactccatctcaaaaaaaaaaaaaaaaaaaaaaaaaaaaagctgtttaaatactatttgacttccaaacatattactttgataaaaaatgtaaagaaggtgaaggaaagggtatgaagtgacgatatacataaggtgtgtgcaggggctagcaagtgggttcattttcctggagtcaaaaatttggccaggatatgagacaaaaggctgtaaaagtaggtagaggttagattatggggggccttgaatagggatatttgggggctttggggaatgtggaaaggtttctgagtagaagaggtatctgaatgatgttgttattctagtgttaatttggcaacagtgtataaaatggagtagaaggagcccatacttaagaccatagcatccaaggccctatgtaatctggcgggtctatgtttccagcctcacctaggactgttcctttagtcatgatggccttcttattcctcaaatgtaacatgtttattcctgccttgagcctgtatattggctgtgccctctgcctagaaggctgtcaccccagatcttctcatagccacttcatccttgctatttctaggtctttttttctggaagaagttttctctaaccaatcagaaacctctttctcgttttgttttggttgttttgtttttgtttttgtttgaggcggagtctcgctctgtcgcccaggctggagtgcagtggtgggatctcggctcactgcaagctccacctcccgggttcaagcgattctcctgcctcagcctcccgagtagctgggactacaggcatgcgccaccatgtccagctaatttttgtatttttactagagacggggtttcaccattttggccaggctggtctcgaactcctaacctcaggtgatccacctgcctcagcctcccaaaatgttggaattacaggcatgagccattgcgcctggcttcccctgtcactatcccatcactttgttttaccttcttcatagcagtggtcactctgaagttatgtatttacaagcctatgtgcttccctccagctgagggaaggtcctgagagcagccttgtctgtctcgctatcgctatatctcatgcgatatgccttatacacagtaggccttcagtatttattaaatgaattaaaagttaaggggtgaggagatctgtgaggaaccggctatacctagttctggagttctggtttgagacttactgtcttaggcatgcatgcatccacttatctttttttttgggggggggcgaggggggatggagtttcacttttgttgcccaggctggagtgcaaaggcaggatctcgactcaccgatctcggctcaccgcaacctccgccgcccgtgttcaagcgattcttctgcctcagcctcccgagtagctgagattacatgcatgcgccaccacgcccggctaatttttttgtatttttagtagagacagggtttctccatgttggtcaggctggtcttgaactctcgacctcgggcgatccgcccgccttggcctcccaaagtgctgggattagaagcgtgagccaccgcgcccgggccccacttattccgcattcaacccatttattaaaccactaccttgcaactggacgctaaggttatagggaggaatcagaactggatgctgtccttctctcgagatcagtttagtagactcagtgacagcagttgtgcttctcaagaaacactgaagggccatgttgaggtcattctcctccagggatccagagtcagacccaccctctttccccagaccatttctggggaccaaagcaatccctgcattccactcttcctggactgcagaggagtcgccgatcccacttgggtccggagtcagggccttcaggggtccgggaacgccgccatcccggtgaatctccccttccgtttctagggacccgggaccggagcgccgcggcccggccagtgggcgggaaaccctgccatctgccgcgacgccggcgcctctccgcggcggccgggggcggggcgcgccggggcggggccgcgccgggccggaggaggggagcgggcccggacgaagccctgggccgggagggccgcggccaccggaagagtcgcggtcgccagtccagtcgggagagtggggagcggaagcggcggccgcggcggcggcgggcggcgctgggacccggtagcggccggagaacaagggagctggcgccgccagcagccgccgagctgggttgagccgctgggccgcgccgcgcgccgccgccgtctgggaggctcggcccggccgcccgagcaggccgcgcgcgggccgccgggcccgaggccagagccatgggcgagaccaagatcatctaccacttggatgggcaggagacgccgtaccttgtgaagctgcccctgcccgccgagcgcgtcaccttggcggactttaagggcgttttgcagcgacccagctataagttcttcttcaagtctatggacgacgatttcgggtgaggatggcccccgccccgcctccgggagccccggccgctctggcttctaagggatgacgcggtccgtttcgacttgcctcgctacaccggctcctagccccgctctgacttctaggggcgactcggcccatttgggcccctttggttccagccccagtagcaactcccgtttacctctgaagaggggacgttggcctcccttgtttaaggggacgtccaattccccactagcaatcagagttcctgccggtgcggtccccttacctcttcagagaccagtggcccacagagacagacacaccccccctccacctagtttcagagcccgagtcccccatcctcctcctgccgaggagccagagccacctttttccgcacagacttgggtcgtgtggccctcgttcttcgcccccttcatcttttcagcagcacagctcccagccatatttggagtatgctgcatctgagggctctgctgggactttgagctgggggaggggtgtcgggggtgctcgggcgcctggccgcgagcggggtctgcagatctgatgtttatctagctgcctgccctctcctttgtgggctgttgtgggtgttgtcaccggaacagagagcctgacccctgcggagtagtcctcactgacccaggtgctgatctttcctccaattcgggcttttttcctccagttggtggccagtggagagacgttaggaagggcctggggcctgggtgggatagccaggaagagtttcttggtgttctctatcttcccctccctggtggggtcttcccttccacccagctgcagagatctggacaggcacagtttggaagcagtcactttccctttaagaggggatggaatgttggagccggaaggttctgaagcagctggcctgggaagaggggggcctggctgatccccctcgaacccccccaactcccaggagactgggggagggggaggcgcccacacttgcctgccgcctcactaactgggcgctgggcctggaggcggtggggaaggcccctccaggcctgaaggctgcctctccagccctagcctgaggcctgcactgctctttggagctgaggccccacagccaagaggagacattcttctccccagtgttcatctgtctggcttctctcccaagcccctggcccacctagcactaggaagcaagcaccttctgtctaatgcctggcatgttttgctgtcaccttctgccctggaactcagggttggatgagcccctgaaatcatgtgtgtgagagtgctttgtacagtgggcagtgctttgtagattctaactattcttgtttctgttgttgttcctgccctggggtggggtgctcctggtgtgataatgattgtctgccttcagcccagagacagacacctctaattggaagattctgaggagggatggatctagaaggggtctgggtgagggggtggatactttggcctggcaagagaagaatagggttagaagggatcaagctactgcctccacataaggaatgggggaagatgagccagagtccagtgccctggggccacctcagatccagatgccttgagggactaagataggctgtctctccaccctgtacttatctccagacccactggacctggcccctgcctcctaagcctggacaactctgggctgctctcccaatcccaaggcctaactgcagttttaagagggcccccattacatccagtcactgttacttaatatttttctttaaatccattgtcagtccacttactgtttttcttagcttgaaccaagcaataatatgaaaccataggtctgacttttctgtttatatttctttctaaaatatgtttaacataaatatttaatgattgaactaagcaatgttaatctgtgtgccacctgaagccatcttgcaaacatcagtggtacttgaaccaaaatcagagttggaccattttagcagggttgaaaacagtattaaaaatgaagtggaggagatggattctgtttgtatccccagaaggataaatgagcaggggaactgatagagctgtcttgtcacagaggactaatagctgaagagcatatatatatgtttcatttatttaacacacgccttttatgcttagtgtgccagggactaatctaaatgcttttcaaatcttcactcatttaatcttcgaaacagccttatgaaatagatagcgtaatagtatctctagtttacaaatgaaactctgtcaggcatggtggctcacacctgtaatctcagcaatttgggaggctgaggtgggaggattgcttgaggccaggaatctgagaccagccttggcaacatagcaagaccccatctctacaaaaaaattttttaattagccaggcatgatgctttgtgcctgtagtcccaacttgggaggctgagacaggaggatcacttgagcataggagtttggggctgcagtgagctgtgatggtgccactgtactccagcctggaaaatagagtgggaccgtgtttcagaaaaaaaaaaaaaaggaaactagagcacagaaagcttaagtaacttgcctaaggtcacacagctaataagaggcagagcagagcttgctttgacatcaggaatctggatccaaaaatctaaatccttaatcgcacaattttaggtgtcattattatcaccattttactgatgaatcctctccgagggaggtggtaagccttggaaaactgtagaggtgacaaggccaccatttctccgagccccacaagaggaaggtcaggcggaggtcagtgaccctagaggaaggaaagtgggtcagaggaggaaggctgctgtctctccagtttctccactcctggctcagcctttgaggtgctagttgtgaggctcctcaagtcccatctggtctacaaaagtatttgtcaagctcagggtaggcccagccatctttttaaattttttttcttttttttttttttttgaggagttttgctctcgtcacccaggctggagtgcagtggcgcaatctcggctcactgcaaccttcgcctcccgggttcaggtgattctcctgcctcagcctcccaagtagctgggattacaggcatgagccaccatgcctggctaattttagtatttttggtagagatggggtttcaccacgttggccaggctggtctggaactcctgacctcaagcaatccacccacctcggcctccccaagtgctgggattacaggtgatgagccaccgcgcctggcctgccatcttaagttatttgagaaatggaggaaggataaacattttcagcattgagggcatggtggatggttcatagaagtaaggtgcctactgctagtctggccttgagctgtgagagagggcagcatggcgatcaggtcattagctgtgtggcttcctgctccactgtcctccctctgggccttccacctgcagactcttcttcccctgtctcctccaggttcaaattctcctgtcttctgggttgagcttttctgtgagaactgtcatggcactctcttattttatcctttttttttttttttgagatggagcctggctttgtcacccaggctggggtacagtggtgcgaccttggctcactgcaacctctgcctcccgggttcaaacgattctcctgcttcagcctcacaaatagctgggactactggtgtgtgccaccacacctggctaatttttgtattttaaatagagatggggttttgctacgttagccaagctagtcacgaactcttgacctcaagtgatccgcccaccttggcctcccaaagtgctgggattacaggtgtgagccaccgtgcctggtatattttatctttatatcctgacacctgtgtaacactcagcagatgtctatccattgaacacatgtgctgctcctacggctccaaccacttcctggattgcagtatatttccatgaactatccactggaccatagtctctctgagaacaaggcaggctctgggtctgatgtttcatgagaaaacctacaatagcaagctcaggacctgaaacccactgggccctcagccaaagcattttattttattttatttttatttttttattttttatttttattttattgtatgttttttgagagggagtctcgctgtgtcgcccaggctggagtgcagtggcacgatcttggttcactgcaagctccgcctcctgggttcacgccattctcctccctcagcctcccgagtagctgggactacaggtgcccgccaccacgccctgctaattttttttttttttttttggtatttttagtagagacggggtttcaccgtattagccaggatggtcttgatctcctgactcatgatccgctcaccttggcctcccaaagtgctgggattacaggcctgagccaccgtgccctgccagtcaaagcattttaattggatgaacaatgaatgatgaacaggtttatttgctttgcccttaataatgtatacgtagttagaaatagtgtatggatcctgctaaaaatggacaatataattagcttttactgtatgcctggatcatgccaggcatttaaggatcccttttaccaggatgagacaaaggcttggagaaattaagaaacttctctaagataagagggccagtaagtggtagaattggaatttgagtcattatttgtttgactccatttggggtatgagtgtgtgtgtgtgtgtgtaagtgctatgtaaaccccagccattcagctccatggtgggagagtaagacctgtctgaggttccccaaagctgctgaagatcagctgattgttttgagtcagcagagccttggtggcctgtcgatgacccccagaaagagaggaaacgtgtagtgtggagcagtgtggtggggcctgccaggggagcagggaggtagggactcagcagcaatttcccccagacaggcagaccctatccaaagcaggctgtgccatgtggcccacatattcccttttcctttgagccctgtggggctgccaacctggagtaccctgtggccagagtggctggtgggtctgagctacctctgtgtcccttctttctagcctgtcctttctacactttctgccatggtgggccgcagtaggatgatttgggctgctttccgagggtcgctgtggctctgggaatgatagaggagccagagctggatgggagtggggagggcaggcttggcctgtgaacttggctgtgagtccaaaaatgtgagcatcacaagggagccaagcacattcccagctctgggcagaagctgctctaagaacaaggggggccaggcacggcggctcacgcctgtaatcccagcatttggggaggccgaggtgggcgggtcacctgaggtcaggagttcaagaccaccctggccaacacggtgaaaccctatctctactaaaaatataaaaattagccaggcgtggtggcaggcacctgtaatcccagctactcggcaggctgaggcaggagaatcacttgaacccgggaggcgcaggttgcagtgggctgagattgcaccactggactccagcctgggtgacagagcgagactccgtctcaaaaaaaaaaaaccaaagaacaagtggggactgaacttcccaacctcctccttgctgtcttccctctctgctcagagctcctggcatgcgtcatcttacccttggtcatgtcttcccatctctgtactcctggcatatttgacagtctgagggtcctcaaacttttccactccccttcctagccccaaactgtagttactgcctgacttcttgcctcaccacattcccccggccaaactacatgctccgtgaccacattccacacccttcatgcctcacatcattgtcctccagcacccactctccacatagacccacattacctctgttattatataggaaagaatgtgaaatacagtggaaagagtatggattttggagtcaagcctggggtgaaattccagctctgacatctaccagtcctgtgaccttggacaagttaactgaatacatctcagtttccttattcatgaaatgaagatcatagtctgcccactgaggctgatgtgaagattataggttctaactataggaagataaggtggtgtaatggtaagaatgcagatgttagagtcaggctaaccaggattcaaatttcagcagtttaggagaattactgaacctattgagcctagtttccccattgtacctgctgccttatagcattgttgtattaaatgaaattatataagtaaagtgtttagcatagtgcttggcccataatactcatttatgctcaataaatgacagcaattttttttttttttttgagacagggtcttgctctgtcacccaggctggagtgcagtggcacaatgatagctcactgcagccttgaactcctaggctcaagcgatcgtcccacctcagccttccaagtagctgggaccacaggcatacgctaccacgctcggctaatttttgtatttgttttgttttgtagagccggcacctcgctatgttgaccaggcaggtctcaaaactcctggcctcaagcgatcctcctgccttggcctcccaaagtgctgagattaccagcgtgagaaagagcaattattactgttaattatcataatggcatgtggaaaatgttcagtaaatgccttctccccttctctttttctttttcttttctttttttttttttttttgacacggagtctcactctgttgcccaggctggagcacagtggcgtgatctcagctcactgcaacctccacctgcccgattcaagtgattcgcctgccttagcctcccaagtagctgggatcacaggactggtagatgtcagagctggaatttcaccccaggcttgactccaaaatccatactctttccactgtatttcacattctttcctatataataacagaggtaacgtgggtctatgtggagagtgggtgctggaggacaatgatgtgaggcatgaagggtgtggaatgtggtcacggggcatgtagtttggccgggggaatgtggtgaggcaagaagtcaggcagtaactacagtttggggctaggaaggggagtggaaaagtttgaggaccctcagactgtcaaatatgccaggagtacagagatgggaagacacccaagtagatgggtgcacaccaccacacccggctaatttttgtatttttagtagagatggggttttgccatgttagccaggctggtctcgtactcctgacctcagggtgatctgcctgcctcagcctctcaaagttctgggattacaggtgtgagctatcacgcctggcctccccttctcttttctaattttcttaaattctttgtccatacctcccacaacaatgttaggattcccacttaagaaaggaaggacagttataattgtatgcttttttccaattagggatcagagggaaagagaaagtctagcccaggagagtcatgttggggatgggtagagcactttagagattttagggagtggcatgggggacagtgatgtgtcagttgtaatttgcaatcacctgatgactgagaggatgccccgggaaggtatctggcctaggcagggctggtgtcttcctggtggtgccaaagagctgtctctgggtctccccaacctctgctttcatttgaacagtcttgtgctggtggtttgattcccagtttaggatggaggagcccctgagagttgggatttgaggatcctccatttgcaccctagaaggttctctgtgacatccccctttctctgcagagtggtgaaggaggagatctcggatgacaatgccaagctaccatgcttcaatggccgggtggtgtcctgggtaaggagccctcagccttccatccacctgcatccctgtgctgggctggacgagggaaaggcatcactgagattgtagctggtggttttaagcttcagtatctgaatctttctttagttttgcaaatgaactgcttctcaccccagattctgtaacctttgatgaaaagtgagaaattagtgggaagggggaagagggagagacggaaacacacagtggagacagtaacgtttcctatgccgttcagacacttgcctcagatttccttctgccatctgctcatctctgccttagacctctgagccttgttctttgtccccattccacttcaccaccccatgccttccaacaaccccgtcaatagcaggaagtggcagaggggccactgttcatctcagccaccctcgcacagccctgtcttttctccctcgatatttcctgcttccttcctcttaggccttcatgccttgctggaagtgaactatccccttctccttgatgctcctgtaacatactactcactcagtttctccctttcagctggtgtcagctgagggctcacacccagacccagcccccttctgtgctgataacccatcggagctgccaccacctatggagcgcacgggaggcatcggggactcccgacccccatccttccagtgagtgtgacctgagggtggggagggccgcatcagttcagcccagggctgggggagggagcccccagcctgccccctcccccatcaagtctcttccctgcagccctcatgctggtgggggcagccaggagaacctggacaatgacacagagacggactctttggtgtctgcccagcgagagcggccacgccggagggatggcccagagcatggtatatcttcctgaacacggacactgtccgcacctcacaccctcccctcactttccacccagctacccaccttcttgccctacttcccgagctcaggatatgcctggccccagtgcagcccctggcttgcctctctccctccttcacccctgcactgggcactgtgtaaacccaactgcttccatcccctgcagcaacccggctaaatggaactgcgaagggggaacggcggcgagaaccagggggttatgatagctcatccacccttatgagcagtgagctggagaccaccagcttctttgactcagatgaggatgactccaccagcaggtggggcttgagtttcatgggtattgtggggcaggtgaccctggaggagccctaaaccctgaggatgcggggcccctgggaggcttatgggctttgtgttggggacccaggccctgcagtgcctcccctcatgggggcagggctgggccagcctggtggggaacgactgtgggccccacaggttcagcagctccacagaacagagcagtgcctcacgcctgatgagaagacacaagcggcggcggcggaagcagaaggtttctcggattgagcgggtatggggtctgggaggctagggatgggtggaggcagattgtgagcccttcctacgcagggccaaggcttgttcttccttagatcccatccccctagtgcagtgttgagaaccttggggctgggggctgcaccggggactcaccttgaggaggagtcaggtgggagtgaattcctgccacctccacctgctgctcagggcctctgtctattccagtcctcgtccttcagcagcatcacggactccaccatgtcactcaacatcatcacggtcactctcaacatgggtgagtctgaggaaacagcactctcaagcacctgctatatgccagacactgggcagacttgagttcagagagcgtagaatatgttccctgccctcaaggagctctctttcgtaaacatcagctgatacataaactgatcattttagtatctcaccatcagggctatgacagagataagcacagagagctgtggaagcagaaaatggtatcagggaaggcttcctggaggaagtgatttctgagtgcccactccttcacatctctcagccattgcatccttgctctccgatttctgccctaggtactctctttatgagacagctggatatagtaaaaggagcccaactatgggatttaaatctgagtttgattcctggctctgccacttactggcttagaaaagtcatcttctaagttcactgaacctcagttgcctgctctgtaaaatgggactgagtccctaccttatagccagcaagggttccatggaagcatgtttgagcatgctgagtgcagtgcctgattcaggatcagcaaatgtcagttcagttcctgtccctttccattttctaatgggctgggaatgcgggtaggaaccttgctcccccttaaggtcttaaattactctctatagaaaaatataacttcttgggcatctccattgtgggccaaagcaacgagcgtggtgacggcggcatctacattggctctatcatgaagggtggggccgtggctgctgatggacgcatcgagccaggagatatgttgttacaggtatcagtgcccatcctaggcggtggtgtggatagagggcagggaggtgtcctaccatctgtaccctgctccttcagaggccccttcttggttgggggaagactccctgacctaccaagttgagttcccttttcatcctccccagcacagctgtttatcccactcctggtcctttcccaggtaaacgagatcaactttgagaacatgagtaatgacgatgcagtccgggtactgcgggagattgtgcacaaaccggggtatggatggaatggggcactgggcaaggggcttggtctggcctatacgcatcctgccttcactaggacacccttgttttcaggcccatcaccctgactgtagccaagtgctgggacccaagtccacgtggttgcttcacattgcccaggagtaagtggatgggagactcagtcctaaagctggtgcttacatacatgagcactgtctctcctttcttctctcacccagaacccccatatctatcctgttgggcccagcagtgggtggggtgggtagcccatgactcctcatcctccctgcaggcgagcccatccggcccattgaccctgcggcctgggtctcccacactgcagccatgaccggcaccttccctgcatacggcatgagcccctccctgagcaccatcacctccaccagctcctccatcaccagttccatccctgacacagagcgtgagtgtcccaccctgtctcctgggcccagcagacagggccaggtggggggactgatgagggtccatgtggagactcttgcttgagcatcagagagggctggagatggggctcggctcattccagcaaccccacactgcaactcccccacagcgggcactccaaccctcactaaacagtgtttgcttctgaacttgtatgagcacccagggcgcctcagtttcctcttacaaaatgggactcacgatataaactttaccaggttcctgtgggtttaatgagaggatataagtgaagcaccattgcgatgtgtggtgtaaagtaagcattcagtaaacggcagccatttcgattatcatcacatgcacatcgtacactggccaagcacctgcatttacattatttaatcctttattcaaatagccttgtaaagtagatattaaaatccccattttttacagaaggggaaactgagtgtccaagaaatcagtaattttcccagcattgatcccataattactagatggtagagctagaatgcaaactcttgtttacctaactccaaagcccctttctgcctcaccattctgcctcccacccccaggcctagacgacttccacttgtccatccacagtgacatggctgccatcgtaaaagccatggcctcccctgaatcagggttggaggtccgtgaccgcatgtggctcaagattaccatccctaatgctttcatcggtgagagagccccatggtgggatgcagggtgggtggggagtgatggggcagggcaggccggagggcccaggacttgccttggacccttcctttgatctggagccagccccagcctcatagcttctgtgaggccagatgagtccaagtcagatgggcctccccatcaactggcagccttgtccccaggctcagatgtggtggactggctgtaccacaatgtggaaggcttcacggaccggagggaggcccgcaagtatgccagcaacctgctgaaagctggcttcatccgccataccgtcaacaagatcaccttctccgagcagtgctactacatcttcggtgacctctgcggcagtatgtgcctccctcatcttcttgccctgtctcctggctgggagtggggaggtagccagggaagtggcagcagactctggggaacccaaactgggggacagcagagccaggggcccaattcaaggcctgagagttctatggtggaagaagagtccagtttagcctcttcacctggcccacatctccctcttgggcctggcattttctaagtgcctgctctgcctggtaccatgttggttgttcctaaagcatcatcttactcaatattcacaacctcccagaggcccagctcaggaggatactgccagaataggccttttccttctcactcgtcaaggtctcagctagggtgttgtaggcttaaagggaagaactggaggcctaggtagccccgaggagcacacagtcattccctcaaaacaaacagcctggaggctcacgtcatcaccagctctgggcaacagctgacagaccactgctttcctccaccaccactccccatgctggctgctggcctcttgacaggttgatggcttggctgcaggctccacaggcagcctcagagccctgtctcctgacttctctcttggaaggctggggctggctcttcttagggctgggaggaatgtctcatcttaatagggccggtggcctcaagggcagttgtagctctcttggagctctgggacctggtaccgatagtgtgtgagcagagggtgtcccaggcaggtattcagtcctggtggccccttatattctcttcaatgtagttccaacattggtgggagtagccttgccattaaggaatgtataatttccccgggggcgccaggatcgtgagatgagtaatgttggtggagtgagacagtgctatgaagagctaggcctggctgggaacggggtggagagcagtgggggaggcacctaagttgttctttccttctggccccttcccaccctactcaccctgcccagcagcactgggaaagtataatcagggccaagtaccttctatatagggaatctctggaaggccctgcactcattctaggcttttagtgggtatttagttctaggtgaaggggtgggtaacactttacctaaatttcccaaactgctccttgtcctaattaatgacctcatctgagaaggtaaggagaaagtaagctactcttcgcgtctgttctgattagtttaggctgagctgaaggtagtgttcgctattgtgcctcatgaacttcaggtgcgacatacctggtggctgtctagtatttcagccttccaaattctccagtcttgcaccagctgagtgaacggaagagaaaatggccacataagagttttgcaggccgggcgcagtggctcgcgcctgtaatcccagccttttgggaggctgaggcgggcagaccacctgaggttaggagttggagaccagcctggctaacgtggcaaaaccctgtatctactaaacatacaaaaaaaaaaattagccaggtgtggtggtgcaaccctgtcaggaggctgaggcaggagaatcgcttaaaccagggaggaagaggttgcagggagctgaaactgtaccactgcactccagccttggccacagagcaagactccgtctcaaagagttttgccgcttctagcccactgaggccagcagagaaagtgcaaaagcttggccagggccttcaagggattgggaggtacagctttggctgagaacctagaatgatgactcagggttgtcctgagaagggtctccccggggctggctctggtggtggcaaagggggtctgcagaaggggggagctctctgggctgtgcctcctctcattctagccagaaactaccacggtctctctcatccagagcccacctgacctaggctagggacctctctccggaaagacctagctccatccggccctccccttcacagacatggccaacctgtctctccacgatcacgatggctccagtggcgcctctgaccaggacacactggcccctttgccgcacccgggggccgccccttggcccatggctttcccgtaccagtacccgccacccccgcacccatacaacccgcacccgggcttcccggagctgggctacagctacggcgggggcagcgccagcagtcagcacagcgaaggtaaggtagaggggccgtggaggaaggctataggtgggccccaggcttcccccgcccgctcagcctgccccaccccggccctgtttgcctcctacaggcagtcggagcagtggctccaaccgtagcggcagcgatcggaggaaggagaaggacccgaaggccggggactccaagtccgggggcagcggcagcgaatcggaccacaccacacgcagcagcctgcgggggccgcgggagcgggcgcccagcgagcgctcagggccggcggccagcgagcacagccaccgcagccaccattccctggccagcagccttcgcagccaccacacacacccgagctacggtcctcccggagtgccccctctctacggcccccccatgctgatgatgcccccgccgcccgcggccatggggcccccaggagcccctccgggccgcgacctggcctcagtgcccccggaactgaccgccagcagacagtccttccgcatggccatgggaaaccccagtgagttctttgtggatgtgatgtgagcagggcccctcccccagctccattccgctcccaccccagccggctgcgttcctctctccatccgtccgtcttttttactttgtctggtacctgaaagggaaataaaaggaactaaatccaggtgcgctaactgctcgcagggtgctgcgagggtggggtgcacctaccgattggctctgcagccccctaacctgcctctggccccagttcgtttcctctgcccactaatccctgcgcaggacttcccaggaccccttttgtctctgggaccagacttgttggtgctaccccttactcccctctgcaacccccattttgggagttgaccccagcaatgaccttggtggcacgctcactccctcattctctcgtttcccctttagctccctttcaccatttattcagctacatcatccctctattaaccccaccccatcaggcacgtgtgcaaacctcttgactttaccccacattactgaaaccaaaatatatttgcttcatctgcccctactaaccatccccctgcctgctgcctcagtcctgcaacctaaagctgtagtcgcctccaatagccatccatgccatccctgcctgtgcctagatcagaggcccagagggccccctcagttgcctgagcagctggtggcttccagggagcatctctgctctacccctgccccatgcctgccctgcgtgctggttccttcagacccctaaccctactaaccagcaggctcatctcacctccaggcctgaaacatttcttttctttcttttttcctcccccaatttaccctgggcctggagcagccaagaatttcgggctgtttgactttctgtgagcccccagcgaggggaggcccagcctccgaggagaccaggaaccctgcttcagcagcccctcagggcttcccaaggatgtccagcccccacacccacacgttaacataatgagtcactaggcttctggggagggcccaacttcacccatgcatgagagactctcctcctttccagagagaatcggatcgcaccacgtgtggcagcctgcggcggggggaggggggcctctttagctctctttatctttctctctcactcatgtatgcatacatgcacagagatgcatacacaggtgcctatgcaagttcatttaagcctcagggctggtccctgcccaaagggctggaccctcctaatcctctcctaggttgtggggctggtcccctgacacccttctccccttcctggtagaccttaaacctcgcacacatgtccccagcattttctcacctggataaagcccataagctgggtctcaggctgggctcagcaaaggactcgccttgcaaccgacaggccattcccacccccacacacaacctcccctgttttcacattcaccatggcatcccagagcaaggacacaggagcccacaggccagttgaggttgggcaaggagacttccaggacttccagacagagtaccaggttttatttttcaccttattctctactttaaacaaatcataactttctctttaagcctctgctataaattctcctggctctcctgggcttccatattttgggggctggggtgtcaaaagtgagatgaagttcttagctccaggttttggggtaaaccaaggtaggaacattttggcatttatttcaattaacaatacttccttggacgggtgcggtggctcacgtctgtaatcccagcactttgggaggctgagacaggtggatcacttgaggtcgggagttcgagaccagcctggccaacatagcaaaaccctgtctctactaaaaatacaaaaattagatgggtgttttggcacctgcctgtaatctcagctactcaggaggctgaggcacaagaatcgcttgaatccaggaagcaagcggaggttgcagtgagttgagatcgcactccagcctgggtgacagagtgagattctgtctcaaaagcaaactaacaaagaaaaacaatacttcctggggttttggtgtgcagagggctttgttggaagtgtgactcaatcttgcctgccttctgggagctctagaattgttcccaacccagtccatggcttctagccaccactacagggctgtttcatgtacttctctctctgactctgtcttgtccgactctcttgagaatttctcaacgattgctcatgcctgtcagtatcagtgcttccatcgttccatctttgattcacttctctttcctttctatttactcccaaaatggagtcattcatcctgatgtcctcaattgctgctgatatgctggtgattcccaaatacatagctccaacccccaacttcccccagactttagatctgtattggtattacctactggacatctctatggacagttccgtatagactcaactcatctgcccaaccaagtatgttcctcctgaattcctctcctggttacttcatcacaatctacataggctcaccagctagaaacatttatgagcttacattccttcttcccatatcttatcagcatatcatatccatttcactccaacactctgtcttgaatttggccctccctctcccctctctactttaattcattggagcatgggatttggagttaggtggttttgggtttgaattccagctctactatttttggttgtgtgatagagttatttaacctctctgagcctcagttccctcgtatgtaaaatgatgataataatacctacctcacagggttgttgtgaggatttaaattagatattgtacgaaaagtgcctagcacagtgcctggcacacagtagagtaggtgctcaataaatggtagctattattattattattttatcattattattatttactctaaattggtagcagtttagggtatttttggaagataaagcttttgcaaaggtagaagtgaagccttgagtgctggttcaaaaattagaagtgcctgtattcagtcacttaatgacttcaggccgtgactatgatgtgagagaggtcagatcttcatcctgccacatcgtggcttctggctggaggctgggaaggactgtaacatttgcaaccagatctgtcctttcttgcccttccttcctcccatgacaggcgtagtcctgcccaaggaaggcagcagtttatctctgcctacagaaagagaagagccaacagattttcttaagactctgcaagaaccaagcaggcctttcatgtgtgagggttgggtctgtctcctcagcttggatgtaaagattctgtttatcaaagaggggatttcaaatcccatgtcaaactaaattcaactcttcgaacgtcttctaagcaacatatatgcctgtcactagaaggcatacacagtcgcataggtatagctaaggagaacatcggctcgttcatgaaaagctgtagctgacctccgggaagagtgtacagtcatggacttatttgtgaaaaggtttagtttcttccaagtagtcgcctccttcctccccgctcctctccttgggtcttgatcccttggaaaaagctcatgtccggaacaaatatatgagaaaagcttgagagaatcagaggtagtgttagaaagcagtaaattcagcacaaacacttctactgcccagttgtatttatttgtgtgtaaagtgaggacagccagtcctgggactctggagacagaaaaggcctacagcaatccaaggcttaacagatgtgcttccacaaatggcattaatatcccaaagctctccagaacacaaataggaacaggaggaagtgcagggactacaattcccagagcgctcagtgaaaaaaaaaaaaaaaaaaaaaaaaaaaaaaaaaatgaggcgggtggagcggtgtatgctggaatgtgtatttctggtagggccgactaaggccacgcctaccccttcctgaggcgggggcggtttctcgaaggcagtcggtagttgtagttttgctaaacctagagcgcttcaaattgcaagcaaggaggccgcgaggcctgacgggatttgtagtcggcgctagacgccggcgcgcacgcgcagccggggccggggcggggcggcggcactgcggtgaaagccgaggcagcgggcagacgagcagggggcgggcggacatcttgggatccggagagtggccgggccggcagagcagggggccgaggacaccaggtgagccggggatctggccttatggcgtggaggaggacgctgcgggtcgtctgcctcgccgcgcagctttgtcctgccctgcactgagctggcggaaagctgcccacacccgggagtggcttcagccttcggacccgggagctagctgacggtggggcgggggcgcccggggcgcgattgcagggctggcggggagcggtgccctccacctgacccgcctggcgcctcccatgagagggataccgcttggaatcctcccagagcaggaacgctgcgcagcgccccctccctaggatcgtgccaaccccctacccctccgcgcaaggacaatttccccgtctcgtaggacagtgacacccctttgtgccgccgccttgcaccgtgacaggtctcacgccatgcggcaccccctcctcttagttcagtggcaccccgcggctcttcttccttagacctgtgacagcccccgcacccccatggcaccatcttttcccacaatgtcctccccaaggcgaaaagcctaccaccctctcattactctgcacctgaaccccaagcaggctctgtctccccagctttcccttattcaccactgtcagttcccccggccggtttttccttcttaaagccttgaccttttccatactggaaacccttacctttacgttcactccaccagcccagtttgctgctgtgggctcacctgaggacgctgcctggctttcactgaaggtctttccccttaactaaatgttccattcttgcccaaggcccccctctggttctcgggtgcccttcgctacctaccactcgatacctgtggacttggtgctttgccccaggctctacctccattttgcatctcctctcccagcctgtttgggactgagggatgggatgagtccaccaccttgagagaccgctcacccctctggaagaccttgacagccacaggaaaaggctttattttccagtttagaaaagtcctctaaagtactccctgtgaaattaataccagggctaatccaggaaatctaaaaccaaattaatgccttttctcaaacagtctaaattaatttgacccaaataatttggataattcaggcatcctgacatccctgcttcttgcttataggcacccaggccagaaatgagttacttcatgggcctggaatcacgatttcagatggaaggatttcttaattttatgagcctgcgccacccccaccccccagtccttatttttattgcattccagagctttttgaaaggggggtggtaatcagaaataactgtaataagcagcttgggtgatggaagtgtagtctgccagccctaggaccttcctcctgtgccctttgcctgcttattccactgcctggaagaggttaagccacactcccgggtccacattagggcctaagggctcccttctcttctccttataccctttcctggaatgtttgaattctgtgaattagagtgccggaagttcaggccctgcgaccttctctgaagggtagtggagcccaagagactggatgctctaaaggttatgcctgggggccccaggcctgaaccaactggagtaatgcctaccgccattcctgcagccgcaggcaggcaggcaagccttagtgagtcactggcgggagcccgagagtctgcacaggagggggccgaaaaggatcattcctgagctcagtgctggggagagggggcgggggttactgatgctcagccccaggaaagggagggtcaaaatggccttagaatcctgggcctaatctctctctgtttctttctcccatctagtgtggaataaacaggaactggagcctggctgaggggaggggcatgtctgggagggctgcagggtcacttactaaagggttgagtcaggaaagaagctccagtgacctgcacagctccacaggggatgttggcagcgattctgaggtcttcttttaccctgcccccgcctgtcctaggtctgttctcagagcgatgggccgcggagactgatctgccgccatgattggaggcttattcatctataatcacaagggggaggtgctcatctcccgagtctaccgagatgacatcgggtgagtcccctggcggagccagctgtgccccaccactccagccccccagccccagcatacaggattaggtcttttcccaccattggcttgacttgggccaccctgacccctggctgcaccctggaagctcagctagtgtagcctggctcccattaggtctggtggtattggcccggcagccagcctgccagcccctaggtgggacctgtggaatggcatggtcccacagctttaggaactccttcccttcctgcatcctgtttctctagttacagtgcctttgcccaggctggtgaattccttctttgaggaggaggaggagaaatgtctccagtgggtggggttagtggccacgctggaggcactaatccatctaagccttgctctcagaagcccttcccatatcaaacgccttcactggattctgttgaaagcccctccaggctgcccaatcctctcctgctccctttctcaggagtcgtcaggctgctgactcagctgtcttcagttcctctggcccattccctggggagtggctggaagcgtgaggcactctctgggtcactgtgggagggcagggaagccatgctaccctctcagtagacccagagcagctccatatcctgggccttcacacagagccacagcctgccttctcattctgcgcccccttgcacgcccttgttctttgcgactgaagggacctatcctagcctccgaggcgctaaagagtaggctcctctggttcctgctgcctgtttttcttcctcagagagcttgagataaagtcacagaatgggcctgtggcagtgctcttcatttggctccctggctgatgggctggcttggcccttgcgggcgtttgtccattggctggtggtgtggcatgagctagagctgcagctgtggcaaggcctggcctgtctgaacctggctggctacaccccccaccccagaccccctcctgccttggatggactgggcaagccaaggccaggtcacacgccgccttgcctgtcttgtctgcttctgcctcacggtgtgtgccgccctcccggtgtgttgtgtgtctaaccctctctctcgttgctatcactctcctcttcttgctggcgtcatttctctcatcccatctcattggctgccgtagcaataggtaagcggcctctcaagctgctgcccaggtacaggtgggtgggggcctgcccccatcgttttcctgcatcctttttcattccctcaacttgctctggagttggatcctgggcaagaatgggtagcacaattccatggccccttggtacttctccctcctttgtgacttctgaagccatgctggctttgtctaacatctggaggagtcggccctccccactggtgggatcactagcgggaggactgaagaagcagtgtctctttctgtcctggacctgggagcttacagggaagctagataaagctgggaaattagggccagccctgggagtaaggaatatctgtctctaaacctgatgaacctcactttattaaggttacatcagccttaatagttgacttccctatttcttgtggcctttagacactagcccagctcaggcactcttcccatgcctccacagggagtcataagaagggaaccactccagtggtttaggcattggctttctttggagtgtgtgtgtcagacttctgcagaaaggagggtggggctgttagcagctgtggttgatccttatggggtaaggttcacctgggtgctgagcaggccctatgcactcttttccctcaggaggaacgcagtggatgcctttcgggtcaatgttatccatgcccggcagcaggtgcgcagccccgtcaccaacattgctcgcaccagcttcttccacgttaagcggtccaacatttggctggcagcagtcaccaagcagaatgtcaacgctgccatggtcttcgaattcctctataagatgtgtgacgtgatggctgcctactttggcaagatcagcgaggaaaacatcaagaacaattttgtgctcatatatgagctgctggatggtgaggctggcgggctggcacggcagcgggcgtagggtgggaaaaaaccaggctgggcctggcctgaaggtgggtgtaggtccgaggctctggtacactctgaactttctttcctgagtatttggtctcttgggctaggatctctatgcccctcagaaggccagttcacatccagacctgaaggctggtctgaagtagaacacagaaataggccagcaggtgatcttccaaggggctaggaacctgactcaggtttggtggctgaacctcctgtattcatcctctttcctttgtggcttggaccttagttcactaactgtccacccagttttccatctcagcagctgcttcagagcctgggggagagtgagatattacaagcctcttggggtgcactgttatctctgttcctctgtagagtgtgatctaagagaaggtgaatacttccaccttcccaatgtctattttctggagaaaacagctcaaagcttcttgacttgccacccactggccatgtgactcttctattgatttcttttcttttttttttttttttgagacagggtcttgctcttgtcacctatgctgagtgcagtggtgcaattgcagcttactgaagcctcgacctcctaggctcaagcaatcctccagccttagcctcctgagtagctgggaccataggcacatgccaccatgcttggctcatttttactactttttgtagagctgggtctcgctatgttgcccaggctggtcttgaactcctgggctcaagtgattctcccaccttggcctcccgaagtgttgggattacaggcatgagccactgcacctggccttgatttctctatttgaaaaaaatcaaacatttgaattgttttcctgtaaagcacaaatcacagaataaatgctacaaagctagaagactttcttgcggatgatcccacatgggctttgggagctgtgccggtcagatgtgtaggcccaagtaggggctggaatgaagaagctctgtccaggggctgatggttcccttctttttgcagagattctagactttggctacccacagaattccgagacaggcgcgctgaaaaccttcatcacgcagcagggcatcaagagtcaggtacttgaattgtgcagactatagtcagggtggagtccaatctcccttcatctcagctggcccctgagccttgtctgagctgactcatgagccctcccatgacaggaagtgctggcctgagcctcctgccatgattgcaggccgattttgctctgtgtggtcctcccactgcaggagcagccaattcagcatctctattaccaggaatacagctcaagcagtttccttttgcactgaggggtgggggaggaggcctggtcttgaggcctggtattcctcaggaggagcgagcttgggccctctcctctaggatccaagcctcatagctttctcctccttttctgcctcccttgctgcttcatgtgggcacctcgttggccctgcggcctccagcatcaggtaagctcttccctcagcttccacccttgcagctttgctttgtttctccaggccctgccctttggggcttataggggaaaatggattacaggtggggactagaagggatggggaatgagggtggagtggggatagagacaggatgattaaagggacagaggagtgaggccattgctgtttgtttctgccctcatgtagacaaaagaagagcagtcacagatcaccagccaggtaactgggcagattggctggcggcgagagggtatcaagtatcgtcggaatgagctcttcctggatgtgctggagagtgtgaacctgctcatgtccccacaaggtgaggtccctctcacgacaaagttggagggggcccagggcaggatcctgggcctgcctgcctgactccgctgctccccatttatctgttccatcaccagggcaggtgctgagtgcccatgtgtcgggccgggtggtgatgaagagctacctgagtggcatgcctgaatgcaagtttgggatgaatgacaagattgttattgaaaagcagggcaaaggcacagctgatgaaacaagcaagaggtgcctgaggcaggagagctggtgggagagggtgtcccttggagggctcagtggggtctagtgaaccacaagtttcttctggatttcattcccactgtaattgcaaactctgttcctgacggtaagcctggctgttcgctcttgacattagtgctacgagagatgaggggatcgtcctcagagagcaagcccctttgtttggtccctaggaccaaggccttttctgtacatactgacagcctctgcccagtgtgcctgaaacacccaggtccctagcagaaggagccccaagagatgagcttgcaaggcttccctctcatcccaagctctggggcagacctccgagtcacaaagctgcattctagcagcttttcatagtctctggtgccagcctggggtggagtggtctcccagcatgacagctgtcattctcctgtaccaatgagacctcttctgcccctgcttgcagcgggaagcaatcaattgccattgatgactgcaccttccaccagtgtgtgcgactcagcaagtttgactctgaacgcagcatcagctttatcccgccagatggagagtttgagcttatgaggtgccattggggtgtgaggaggcagctagtgctgctggcagactggggagaggaagtgggtcagctctttggtaaccttgcttcccatcccttaaggtatcgcacaaccaaggacatcatccttcccttccgggtgatcccgctagtgcgagaagtgggacgcaccaaactggaggtcaaggtggtcatcaagtccaactttaaaccctcactgctggctcagaagatcgaggtgaggacagggggctcaaggaggaggaagaacttgtccctaggaataaaggtagctgatgtcacagcttgacagagctccctgacaggtgtgtcacttctaggtgaggatcccaaccccactgaacacaagcggggtgcaggtgatctgcatgaaggggaaggccaagtacaaggccagcgagaatgccatcgtgtggaagtgagtctttccttcattaggccacagcagggctcaagatcccagtataccctcttgttttcagctttgatccttctgaatgaggggcaggggagtgtgcctgtttgcttttctaggagcctctgcttgtactgtcagtctttatacctccatgtgagtatgtacacgcctgcatttgggttcatgcacgtgcttattttttaagatgctttggcatttccctttgtaatgtatacattacaaagggaatacattgcctttgtaatgtatctgtgaagcagacaaagcaaacgatagcatgtccaagtgtctaggcagaaactgcatcctgttgttctaaagaagtagacccaagtttccatagcaagtggttagcagggtcctgaccacttctccttgttctggcacctcctgcaagctcctgggctctctccttgcttgaaatgggcaactgcccttgaaactcctccaagccccaatgggctgcccattgtccctgtgttcccaggatcaagcgcatggcaggcatgaaggaatcgcagatcagcgcagagattgagcttctgcctaccaacgacaagaagaaatgggctcgaccccccatttccatgaactttgaggtatggcagaggaggggcctagagtcatgccagggtatgctggaagacctcttagagatcattccgataaactgctgcaccttagaggtgaggaaactgaggcctagaaagaagaactggctttaattcatagatccattcttcccctttcaagcctcttagtagaaattactatttgtgatgaggcaaatcttttacttctctcggcttgtcctaacacagttctttcaaaaaacttagattgtttaaatgccaggtaagacacaaagtttacttacagacaggataatgggctgactttgctttgcgcatgttagacataattttctccaccttatttttaagttcataatattgagcaggataagtatgttctaaagcagttctttggttgctgtctcctgctgattaaaggaactgattcaaggtgtcacaggtagggctttcttctttagtcacctcttagaaggtcccacgccgccccagcttctttcaggaccccagccatacaaacacctgtagtagcgatgaagtagggcagggcaacgggacttcccagaggagagcggctgtaagaggaaggccacatttctaactagctctccttgcccaggtgccattcgcgccctctggcctcaaggtgcgctacttgaaggtgtttgaaccgaagctgaactacagcgaccatgatgtcatcaaatgggtgcgctacattggccgcagtggcatttatgaaactcgctgctagctgccactaggcagctagcccacctccccagccaccctcctccacaggtccaggtgccgctccctcccccaccacacatcagtgtctcctccctcctgctttgctgccttccctttgcaccagcccgagtctaggtctgggccaagcacattacaagtgggaccggtggagcagcccctgggctccctgggcaggggagttctgaggctcctgctctcccatccacctgtctgtcctggcctaatgccaggctctgagttctgtgaccaaagccaggtgggttccctttccttcccacccctgtggccacagctctggagtgggagggttggttgcccctcacctcagagctcccccaaaggccagtaatggatccccggcctcagtccctactctgctttgggatagtgtgagcttcattttgtacacgtgtgacttcgtccagttacaaacccaataaactctgtagagtggagttgctggcttagtgttgatgtgggagctacatggggagggaactggtgttgctctccgtgcagttttctgtactgaatactctaaaggctctttccttgtcttgtcccagttaggcccctcctgggccatccaagcccttatccttgtgggttctgggcccaggtttcctggctcctcttagaaagcctcaagggcatgcagccgcagcgggccccagtaccctggggatagattctttccctagctcctttttattccccctggtcctcggactcctaggctcaagagatcttacctgccccagcctctggagtagctgggatcacaagcacgcaccaccacagcacccagctctttctctaattcttaggcagatgttttctaattagattaagcataaattaagtgtgaagtttacatttggtcttgtagccatcctaagaaattgaccttttaattccatcatttacccaagcttcccaaatcttgctgactgggtggtaggaggaaagatttgcaaggagaataacataatggactgggcgcggtggctcacactgtaatcccagcactctgggaggccgagacgggtggatcacccgaggtccggaattcgagaccagcctgaccaacatggggaaacctcgtctctactaaaattacaaaattagccgggcgtggtggtgcatgccggtaatcccagctattcgggggctgaggcaggagaatcgctcgaacccaggaggtggaggctgcggtgagccaagatcacgccactgtactccagcctgggcaacaagagcgaaactccttctcaaattaaaaaaaaaaaaaaaaagaatataatgaatctccatgtctcatcacccagcttcaactatgatcaatgcgtggccagttccttaatatcacatccagtttgtgttcacttaaccaggtgtcttatcaaatttttccagataaggtccattgtggttggttaatgctcctcaaattttaaaaattgatgtttcccttcaggtcttgcaattttgtggaagaaaccagagttctgtagtttaccacatcagaatttgcctgttgtccccatgaagtcacttaacatattcctctttacctgtatttcctgtaaaatggttcaatatcgggattgatgcctcatgatggcaatgtttaatccaaagggatgaatgggtaataatgtaattttcggtgccacttttagagaccaattggaggaatattcacgttaaatataaagcagtagcatcattttggaggaaattcctaacttcccgagggaatcggtgaaaggaaatagccttttattggcatttattgagtgcagagaagtctgctcagggtgtaggtagggaataatttatacaggccacgttgtcctggttttcttgccctttggcggtggatttggtcgtgccctggggtggtggaagaactgaatgggcttaattcacaaaggtcggctgaattacacagtgaaaaggcggtcgcggcggggaggcgggtggcgctggccaccaggctgagaagcccgtagggtctggggacccgcgaaagcaaagcactgagcagggggcttctgagagtcagggaccggggtgagtcagcaaagctctgggcaggctccaaaatgggcctgactgggtacgcaccagcagcagacgcgcctcgagggagcgcataaaacctggcaaagccaaagtgctttatcagccgcctgcctcttgggaggctcccacccgccagaccacgggtgcctcgcggccccgataaaccttgagctcccagcctttgccccacccctcgctcccggaactccacctcccagaaggcagcgagaaccgcacatgtggctaatctttcagcggaaaaggtgtcgcgcacgcgcagagagcgcggctccggcgcagactcggcgcctctcctcaaggccccgctcgccccgcccaccgggctctgcgcactccgctcctttcctgcgtcaccgctacacatgcgccttgcaaggaagggcgagatttcgggggcagggcggggggcgggcctaggccggggtctcacagcgactgcgcggacgggttcctgagtggaacatggcgacttgcgccgaaatcctgcggagcgagttccccgaaattgacggacaagtcttcgactacgtgaccggtaagcagaactgaatcggccggctggggagaccgaagtggaggccgggggaaagtctaagcgagcgtcgtgcccgggactgttgccaggcctctcctctgcatgacctcttgtcccgggggctggttgggtctggagcctggactggggcctctgtctggggtctgaaactgcttgtgtgtccaccctacccgataccttcctcgttctaccacgccctgcccaggcgtcttgcacagcggcagcgcggacttcgagtctgtggatgacctggtggaagctgtaggggaactattgcaagaggtgtccggggacagcaaggatgacgcgggcatcagggccgtgtgccagcgcatgtacaacactctgcgtctgtatgtgccagggagtaggggttgatgggggcgaagggacggcgaacggtccggagacaagaggtgggggaggaagatctgatggccatagagcttttccctcaactcctaactctgcgctttctatccctacccacatagggctgagccacaaagccagggaaatagccaggtgctactggacgcccctatccagttgtcaaagataacggagaactacggtgagagtgaggggaggttgaactaactgcccccctgtgcttttctccgcccccaaccatctgctgcctgcagcttagggctcctacgtcttttccacaggacaaggttgtaggagctagttgatgtctttaccgagggcagaagagcccatgatgggggtggggaggaggttggagggttctccctccaagctcttgggtaggataggaagcataagagcctggagctggacagacttgctttcacccccagttttgcaacttgctaaccagctgcatgatcttgtaagagttggttatctgtccccagccttgtctatgcctctgtatccttctacgtgagttttgttttgttttgttttgttttgtttttagtgcagggaagataatagccatctatctgcagtattataaggttttgtagaaaacatctgtgtctgtgcctggttcctattagtcactcaaaatgttagtttcccttccctcagggagaaggtgactgcttttcttatcgcttacagactgtggaaccaaacttccaggactgctaaagagggaacagtcctcggtgaggaggaggaagcaagggaggggactgtctgtgatggggttgggagttgactgtctaattggagtatcttttggggggatttctgactatgtcttttcctgagcctttgagtctgttcatcatgggtaagttaagagggtttactcgagatgttctctcttggggttcctttctgagcctacacccgagagtgaagtcgatgtgtttggacccttagacagtgaatgcaaagaagttagagaaggccgaggctcgacttaaggcaaagcaggagaagcgctcagagaaggacacgctcaagaccagcaaccctctgtgagtgggggaagcatggctcagaagagagcagagcagcttttgcctggacagaaggtggtggggagcactaagagctgtccatttctccctttaaagagtcttagaagaggcatcagccagccaggcaggcagcagaaaggagagtcggttggaatcatctggcaagaacaaatcctatgatgtgcgaattgagaactttgatgtgtcttttggcgataggtgagggaatagtggtggcaggggttggctttctttttctaattagaggacaatttggagaggtgaaacggggctataaacaatgttaggtttgtcattaaacttgctgtgcacctatttctagagcatctttggtctcctttctccactcctgcagagtactgctggctggagcggatgtgaacctggcatggggccgccgttacgggctggtggggcggaatgggttggggaagacaacgttactgaagatgctggccacccggagtctgcgggttccagcccacatttccctgctgcacgttgagcaagaggttgctggagatgacactcctgccctgcagagtgtgctggagagtgacagtgtgcgagaggatttgctacggagggagcgggagctcactgcccagattgctgctggcaggtgaggactcccggctagggagtaactagcagccgctgtcgcttacagagcgcctgccgtcctggaacaatccataatttgcatgtacatcctagtaatcagcagagcttagaacttggcactctgggactcagaagcccttgttctttccacagtgcccattgccctttcttgttctttccacagtgcccatttccatagtgcccaaggtaatgagcactgtgcaaacccttcctgtattctcttcctcttccagccacaaggtagccaatggcctttccaacggtatagggtgcaggacatcctcctagactgcccctgcttaggccaattgctgtttctcctccctccagggcggagggctctgaagctgcagagctggcagaaatctatgccaaactggaggagattgaggctgacaaggcacctgccaggtatttaaagctccccctccctccttcagatttcctttcccttctgtggactgttccaactgagttcttcgatttcttctctactagggcatcagtcattctcgctgggcttggctttacccctaaaatgcagcagcagcccacccggtgagtgacccttgccattcttggctttgaaccctgttgtctcagccccttcctgccctgatgaacacccacccataatgtgactccatcattctttagggagttctcaggtggctggaggatgaggctggccctggcccgggccctctttgctaggtgagtctcctgggccagtgtatgaagccctatggaagattggtcttagctcttgggaggtggcatgagttgctgacctaaaacctcaggccatgtattgtttttcataggccagatcttctgctgttagatggtgagtttgaaatggggcaccctgactttaggatgggcaggggtggtagcatccaagttcctagttctccagcccttcaatcccaagtgtgtgctcccctgcttctccagaacctacaaacatgctggatgtcagggccatcctgtggctggagaattacctgcaggtgagtgcctgtgggtgctggagtgtgttggggaaaggcggcctccaagatacctgggggcctgagaactgactgccctcccaaaccgggcctgctgtcctgtgacccctcagacgtggccctccaccatcctagtcgtctcccacgaccgcaacttcttgaatgccatcgccacagacatcatccacctgcacagccagcggctagatggttaccggggagactttgagaccttcatcaagagtaagcaggagcggctgctcaaccagcagcgtgaatatgaggcgcagcagcagtatcgccagcacatccaggtgtggggcctggcagggctgggggtcccatcccaggggttccagagtgggggatagtgggggaatttgaccaatgcctacactcctccacctgcaggttttcattgaccggtttcgctacaatgccaacagggcctctcaagtgcagagtaaactcaagatgctggagaagctgtgagtacagcatccttggccagggcctgactcctgttctcttcgtctccttccgcatttgcacgccacccttgccctaccattctaggtctccccttcgctagaagccaactgtgacttcctcctctgctgggaagcagagtattccacactgttcttggagggctaatcttgactagcacatggcaaccactaatttactttctgtttctgcttctacgtatctgcttattctgggcatttcatataaatggaatcatacaatatgacctttgtgcctggtgtcttttacctggcgtcatgtgtgaggctcatccatattgtagcgtgcgtcagagcttcatttcttttcgtggctggataatattctgttgtgtggatatacagcattttgtttattgagtcatgaggggccatttgggttgtttccattttggttattatgaataatgttgctgtgaacattggtgtacaaatttttgtgtggacatatgttttcagcttgcttgggtgtatacctaggcgcagaattgctgggttacctggtaattccaaattaatgttttgaggaactgtcaaactgttttctaaagcaacaacatcattttacattcctaccaacaagggatgagagttccaatttctccatgtctttggcagcactgttattgacttttttttttttagttttagccatcctagtggctgtgaagtgatagctcattgtggttttgatttgcattgccttaataactaatgataatgtgcattgggagtttaattttgaagtgccctttctataagtgctggcaggaagcttaaaatcataaagcttagatgtttgcgacgtggaaacatatcacaatatagtaactggggataaaaagtcacaaaaagcctaattctattttttagcatacagtaaatgagaagaatggactctaaagtaatgatacctgagtggtaggagtacaagccctttctaagttttctctgaacatatattactcgtgtaggaagttatttttttaagtaataaatctagtctacctcatctcttctcccaggcctgagctgaagcctgtggacaaggaatcagaggtcgtaatgaagtaagtgctgggccagtggggctggtggggaattgcttgcttccagctgcccccacatcctcacccctacctcctgcaggttccctgatgggtttgagaagttctcgccgccaattctgcagctagatgaggtggatttctactacgatccgaagcacgtcatcttcagtcgcctctctgtgtctgctgatctcgagtctcgcatctgtgtggtaaggctgctgtttctctgtgctgcgagctgggactctcctgtctaagtgtgtggtgtggattggcccagatcctcaggctgtaaagggacgaggtctgtggaacaggagtgagggcccgggctaaggattttgcaggacttacactagccctgtcctctggccgcacagcgctgctcttcagggaggaagagcctagtgtatagtgttttaaaaatacttaaaaatacttaaagcagtgctttaccttattggtctcggttctgagttttctaaacctggagacattgaggagagagcatgggcttcagggtcagacttcggatcttgactatgccatttcctagcttggttaccaagcagcttcctaactcttaagatggcgctgacatctacctcacttggttcttgggaaaagtaagtccccagcacttagcaaatactcaagtattgctcaccttagtatatgcatttttctgtagagttagagttccttttttttttttttcggagacagagtcctgccctgttgccccggctggagtgcaatggcacaatcttggctcaccgcagctttcgcctcccgggttcaaacagttctccctcagccccacaagtagctgagattacaggcacccgccaccatgcccagctaattttttgcatttttagtagagatggggttttaccatattggccaggctggtctcaaactcctgacctcaaatgatctgcctgcctcagcctcccaaagtgctgggaatacaggcctgagccaccgtgcccggctagagtccttaaaaatatttttttggttgttgaaggagtcatcgggactggggactgcctgggaccccttctaatttccttctcctctgtgttacacacagcggtgctctttttattgatacataattgtacatatttatggggtacagagtgatacttccatgcatgtatacaatgtgtaatgatcaaatcagggtaattagcatattcatcataaacatttatcactttatgttgggaacattcagaatcttctagctttttgaaaatgtacagtctatcattgtgaactgtagcgtccctgcagtgctgtagaaccctagaacttattcctccattcctcctatctaactgcaattttgtttcagttaaccaacctctcccgaacccctctctcaattcccctcctccccccttatccttcccagcctctagtaaccacaactctgctctctacttctatgtgctcaacactttttagtgcccacatatgaatgagaacataccgtatttatttttctggcacacactgtatgacattttcatgtttcttaaggttggagagaatggggctgggaagtctaccatgctgaagctgcttttgggggacctggcacctgttcggggcatcagacacgctcacaggtcaggcccacccgcacccctgcccccatgagcacatttgcaggcacccatgctgcctgcgctccttcgtggccattgcctttgtctgtttttccacctcggcttctgcctgcaggaatctgaagattggctatttcagccagcaccatgtggagcagctggacctaaacgtcagtgctgtggaactgctggcacgcaagtttcctggtgagttagggatttgagtcgggggaagagtttgagtagggaagagggctgaggctgaccccggcagctaggcctgccttggggtgcgtgcagagcagccccgccaagcctagatggaaggacatggggacttggaggtgtggctggagggcacagggagggtgttgggccaagaagccacctgatctggggagtccttttccagggcggcctgaggaggagtaccgtcaccagctgggtcggtatggcatctccggagaactggccatgcgtcctcttgccagcctgtctgggggccagaagagccgagtggcctttgctcagatgactatgccctggtgaggcctcattttccagagctcttcccctcccatttccccttcttgcccagtagaaaactgtatcagaaggctttattttctctcaccgcaccccttcactgcccaccttcctggttctgccttccagccccaacttctacattctggatgaacccacaaaccacctggacatggagaccattgaggctctgggccgtgccctcaacaatttcagggtgagtgtgccttcaccctgaccactcctcccaggcctcggtgcctcttgtgtccccctgagcacctcctgccctcctgtctttcagggtggtgtgattctggtgtcccacgatgagcgctttatcaggctggtgtgccgggagttgtgggtatgcgaaggaggcggcgtcacccgtgtggaaggaggatttgaccagtaccgcgccctcctccaggaacagttccgccgcgaaggcttcctctagggccaccaggctgaggactcgcccaggacatggactggtctctcagacccctgggccaccatgtaggccaccactccaggccgtggacttcccccaacttggggacagccttattcccaaatgtctctatccttttgactggagcatcttctgcacaaccttgggagcccatccaagggttggtgaggactggtctcccgggggtgggggtctggggggtaccctctggggttatagattcccccactgccccagctctgactggaccccaagtggctgctatgtaaattaaatctctccccgcgtctcctttgcctcatgtctgctgctccctgggcagtggttgcctcctactgagggctgtggactctcggattggcgttttcctatggcacttgtatccctcacgtgtaggaagcaatagcagcaccagccttgcctctagaagagacattgtcaagctactggggcatggaggtcatctgcctgcctgaccttggggtgggctgagccagtggaatgaagggcagtgtattggcatcattgcggtgctgttagccctagcctgggctcagcctcagctgaaggggtcttgggttctgtcgtcacagcccccactgatgggcagttgaactgattgtgtaacctggcctcacacgtggccagctgctttctccagtcatatctggctccggcttgccctgcttctctgctctctagactcagcactgaagagaaaccatctttgtcctcactttgcttgggtgattgcatgttctttatatttcctctaaccatataggaggggcctgggaaatagggaatttaggacagggtctaacaggaaggcatagaacactttcttttcaaatgaagcaatctttaagaggggagagatgttgaacacaggtagtatcatttataaatattatttcttgaggagttagctgttatatgtcattgttatgcagaggacgttaaaatagagacatttgagctgagcacagtggtacgcacctgtagtcccagctgttggggaggccaaggtgggaggattgcttgagcccaggggtttgcggccagcctgggaaacttagcaagaccacttctctcaaaagaaaaaaataaaacagacatattgcgttgctctcagtgacaacaaagtcagcagaaagaacttgccgccttcatgcagattgtagtcaaaaagctcgaccaggccaggagcagtggctcacgcctgtaatcccagcactttaggaggccaaggtgggcaggtcacctgaggtcaggagttcaagaccagccaggccaacatagggaggccccgtctctactaaaaatacaaaaattagccaggtgtggtggcacatgcctgtagtcccagctactcaagaggctgaggcaggagaatagcttgaacctgggaggcggaagttgcagtaagctgagatcgtgccattgcactcagcctgggcgacagagcgagacttcttctcaagaaaaaaaaaaaaaaagcttgaccaaagaatcttaactctgagctgctgagggtagcatggtatgggtcgccggggagagagccctgtttcgggggttaaagaagataaagacagcaaggctctgtggactggtgaagctggcagaaggacgactaatgtgcctgcctccttggcatccttcctcccatgtctgtggccatgggcacccttagctcagcactccagagagcttgctcacagccctcataattctcttccaacttcagacctgcaggtgggtgtatcagggagccatccgttataggatcatgcctgcctacttgccaggcttccagcctctgagcccctcaccaatagtgaaccctagaggagttctctcaactccttagagtccttgggaatgcatctggagggttctgtgatgccaaatctgcttttgtgcttcaagagcactggagttggagtcgaatatcagatctcagctctgttgctggtagcagaaataaccacagctggtagcagaaggtagccacagcaaattcctcaacctttctgagcaccttcttggtttctttataggattgttatgaggatttgctgacaagaacaatgtatcagcactcaaaaaagtgactcttgtgtgaccatctgatttgaaggactatcatatgggaaaagaagtgatatttcaatcagtgactccagagatagatcagtttgggctcaaaggaaggaaagtgactagctcaggctgtcttctgagagttcccagtcagtgggactgttcggccctgacaggctgtagagaagggccctccctgaggtaggaggcagcactagatgggcctccggggtggcttccaattttatgattccatgaaagtcgtgtgagcagcctgcatgtatggcaatacgggccggtgctgcaggacttcagagaggcgggatcaaggaactggagcccctgagaaaggcctagcttttggaggtgagaggggagtcagcagaagatagttggtttgaaggatggaaaacgtggtgtcagccagctccatttcggaaagcacaggacagagaagggagagagaggaacctggcgtggaagagtgggaggtcactcctgctcactctggactgcgcatcacggcagcctcctcttcactcccaaaccccacttagctggggggctgtctttccacagctgctgactctggagctgctctgctgacattaggcctcagtccacagattcttcagtgaaatcctgggctccctgtttctcctggccagaccacactcaccaacaccttcgtgggcaacctggctggtccccagtagggcctggactccctcaattccagcccctccaaccaggcttcattgcactttgtgctaaccccagcgagctgcatgagatcgcagttcccacttggccttgacattcttgaaggccagactgtggcttagtcatctctgcatctgctgtgcctgtcacaggttgggttccttgggaagcggcttggagaggccaacatgcagggcatttattgtggttgctcctgggatcaacacccaggaaagcaggcccaggtgacagactggagcagagggagaggttgagcagcaatgcaagcccagtgtgcgcctccgccagcttagcccggcagagttgttctaagtcagggcaggtggtcaggcttccattctgctcaagtgctcagcctttgggtgccagctgccaccaggagcatggccttgggagaggactttttttgtttgttttttgagacggagtctcactctgtcacccagagtggagtgcagtggcgcgatctcagttcactgcaacctctgtctcccaggttcaagagattctcccacctcaacctcctgagtagctgggattacaggcacctgccaccacgcctggctaatttttgtatttttagtagagacagagtttcaccatgttggccaggctggtctcaaactcctgacctcaggtgatctgcccgccttggcctcccaaagtgctgggattacaggtgtcagccaccgcgcccaaccttaaaagagcctttttcttttgagacaggatctgactctgtggctctggctggagtgtggtggcaaaattctagctcactgcagcctcagactctccagtagctgggaccacaggcacgcaccatcacgccctgctaatttttaaatttttttgtagagacaggttctcgctatgttgcctaggctggtcttgaaatcctagcctcgagtgatccgcttgccttgtcctcccatggtgctggaaataccagtgtgagccaccatgctcggccagggactttttttttgttttgttttaacttccccttgtttcaagacaatgctaaggaactttaaaattgtagcagttcatatttgctgggctcttactgtgtagtggcagggttgtaattgcgttacctatattaactcagtcaatccttacaacagccctatatgactggcataattatacccttgttttgtgcatgaggaaatacagggaattgacatactggatggcagggctgggactcaaggacagtctgactctggagcacagctcttttgtttttctttttttcttttttctttgtgtttgtgtgtgtgtgtgtgtgtgtgtgtgtgtgtgtgtgtgtgtgtaggagagagagacagagtctcgctgttgcctaggctggaggtgcagtagctcaatcttggctcactgcaacctccacctcccaggttcaagggattctcctgcctcaccctccccagtagttgggattacaggcgtgtgccaccacccccagctgactttttgtgtgtgtatgtgtatgtttttttttttttttttgagacggagtctcgctttgttgcccaggctggagtgcagtggcgcgatctctgctcactgcaagctctgcctcacgggttcatgccattctcctgcctcagcctcccaagtagctgggactacaggcgcccaccaccacgcctggctaattttttgtatttttagtagagatgaggtttcatcgtgttagccaggattgtctcgatctcctgacctcgtgatccacccacctcggcctcccaaagtgctgggattacaggcgtgaaccactgcgcccggccgactttttttttttttttttttttctcaagacagagtctcactgtgttgcccaggctggagtgcaatggtgagatctcggctcactgcaacctccacctcctgggttcaagcgattctccttccttagccccccgagtagctgggactacaggcgtgtgccaccacacccagctaatttttgtatttttagtagagacagggattcaccatattggctaggctgatctcgaactcctgacctcaggtgatccgcttgccttggcttcccagagtgctgggattacaggcatgagccactgcggccggccgaggagcacagctcttaactgccacactgtgctgccacctgccttttaatgtgcagtagagtcgtggcttgttaattccatcacttaaaactcatccttagtggcaggggcaggggccttgaacacacttctctcaggagagcaagccggtgagtagaagttcctgggacagtggctgacacatgctaggtggtcagtgagtagttagttgttcgtgaaataaatggggctgggcacggtggctcacacctgtaatcccagcactttggaaggccaagatgagcagatcacttgagcccaggagttcaaaaccagcctgggcaacatggcaaaacctcgtctctaaaaaaaatacaaaaattagccagatgtggtggtgtgtgcatgtagtcccagttacttgtggggctgaggtgggaggatcacttcagcccaggtggttgaggctgcagtgagctgtgatcatgccactgtactacagcctgggggacagagcaagaccctctctcaataaataaataattaacacacaattcatggaagagtcatgcactgggattagcccagctctacagctgatggtcttaggcaagtgcatctctcttggagtaaatcattctaacccataaaatgggtgtaacagtttgtcttgcctgcttcttttggtaattggaaggattgaatgagacaaggtcctgtgtaaacagaataaaaatttttgtaaagtcttatggatctaagaggtgttatttcataaggagagagctggctctggggtcagcagcctggagcctccttgagacacatgcttacacacatgcacataaatattccaggccatcctcacgatgatcaccccaagacagcccccatagcctccatgtctgctgaaccaggcatcagaaagcatgcgcgtagctggatgtggtggtgcagaactgcagtcccagctattcaagaggcaggggcaggaggaccacttgagcccaaggctgcagtgagctatgatctcatcacctcatccagcctgggcaacagagcaagtctgtctctaaaaaataaggccaggctcacgcctgtaatctcagcactttgggaggccgaggcgggcagatcacttgaggttaggagttcgagaccagcctggccaacatggtgaaactatgtctctattaaaaatataaaaaattaactgggcatggtggcgggcacctataatcccagctactcaggaggctgaggcaggagaatcgcttgaacccgggagaccgaggttgcagtgagccaagatcgtgccactgctctccagcctgggtgacaagagcgaaactctgtctcaaaaaataaaaataaaaatagtaagcatgcactctggctgctcagatgtgagggaaaaaaaaaagcgtgcacatagaagtgccacatgaggctctgcctggcacccactgattcccatggcgtgaggcagaaatcaccatgcaattgaagcctgttctaataatatgtatagatcatgccctgtcagtaattctaggtttcttttttctttatgttaaataaatacgtagtttggaagtgatttctgttttactgtatatagagaaacctgtgaaaccctaaattagaataaatattcatcagcccatactacagcatttttaacactggggaatgctttcccaaattttttttttttttttaagacagtctcattatgttgctcaggctggctggagtatagtggctcgatctcagctcactgcaaccttcatctcctggattcaagcgattctcatgcctcagcctcccaggtagctgggactataggtgtgcaccaccacacctggctttttttaatttttagtggagacgggatttcgctatgttggctaggctggtctcaaactcctttgcttaagtgatccacctgcctcagcttcccaaagtgctgggattacaggcgtgagccaccacgcccggcctctgaaccttttcttttggtcctctcaaaagccaggcgtggcggcgggcgcctgtaatctcagctacttgggaggctgaggcatgagaatcgcttgaacctgggaggcagaggtttcagtgagccaagatcgcaccactgcactccagctttggtgacagagcgagactccatctcaaaatacaacaacaagaggagtttggggcagaaagatgttgttttgcttggtttaaatacctgtgtgcacagagatggggcaagaacccaagtatctgggtcccagcctttttacatccaggtcaactggtctcaaatttgttttgagccccctgtggggctattcatgcaatgggtgacattctcatgtccctcatgcctttgagcacacccaggggcatgcccatctgtccttttaaggaagtattttgaacccagaatgagggatagtgaatctgatttaatttgtttttaacttgtaaattagggagcccactctggagtcaggaagaactgcatttgagtctggattctattatgtattggttgtgtgaccttggcaaattaagcctctctgcacttcagtttcctgttctataaaatgggaatgataatagaccctgcactgaagaattacggtgaatattaaataagacaatacaagcaggccaggcacagtggctcacgcctgtaatcccagcactttgggaggctgaggcaggcagattgcttgagcccaggagttcaggacaagcctgggcaacatggcgagaccctgtcgtctctatttgaaagaaagaaaaataatttttttaaaaaaagataatgcaagcaaaattctcattatggtttctagcagttcaataagtattagccattatgatgactattagtatttgttgagcccctcactactttgttgatttttagtgagatattgattgtaatgttctgtggctgagaaccactgtagggtcagacctccatatccataaatttcacatccatggattcaaccaaccatggatagaaaatattccagaaaaagtctgggcgaggtggctcacacctgtaatcccagcactttgggaggccaaggcagacagatcacaaggtcgagagttcgagaccagcctggccaacatggggaaaccctgtctctactaaaaatacaaaaattaaccaggcatggtggtgtatacctgtaatcccagcgactcgggaggctgagacaggagaatcgcttgaacccaggaggcggaggttgcagtgagccgagatcacaccattatgcttcagcccgggtgacagtgcgagactcagtctcaaaaaaacaaaacaaaacgaatatatatatatatgtgtgtgtgtgtgtgtgtatatacacatatatatgttccaaaaaaagaggcatctgtactgaacatgtacagacttttttcttgttattccctaaatgatacagtataacaactatttactaacatttacaatttgaacaatctaggtattacttaggtattataagtaatctagagatgatttaaagtatacgagggggaggaagtgcgtaggttatatgcaaatgctataccattttatatcagggacttgagcatccacaaattttgatacctgcaagaggtcctagaaccaatcccccatggttaccgaggcatggccatatttagtcatagtgcctcagcaaaaatgaaaaggtatcctcgcctccaactttgtttccttgggcccagaagaaacccctccttggttgcccccactgcacacacatgcacacacacacacatacacgtacttctgcttctttctatcttgttccaggttggtaactctccatcagtgtagggtccaggtgtttcttgactgttaaggacccttgaatgtggtcattcttttatttttatttttatttttttgagacagagtctcgctctcttgcccaggctggagtgcagtgatgcaatctcagctcactgcaacctccacctcccaggttcaagcaattctcctgcctcagcctcccaaatagctgggattataggtgtgcaccaccgcgactggctaatttttgtgcttttagtagagacgggtttcaccatgttggccaggatgatctcaaactcctgacctcgggtgatccacccatcttagcctcccaaagtgctgggattacaggcatgagccaccgcaaccagcccaagtgtggtcattctgaacctccttcccaccaaagatccagtactcttcttccaccatgaactctgcagtgagaacacaggtatagcatacccagaacttgggagtagagttatattagagtaaaactagtgagaacctacagatagtggttgagatgtagaagtcattcaagatattgtaaacagtggtttggtggtgtcaggttaggggcatatttaagaaccatcaggttggccgggcgtggtggctcacgcctgtaatcccagcacttcgggaggccgaggcgggtgcatcacgaggtcaggagatcgagaccatcctggctaacatggtgaaacgccgtctctactaaaaaatacaaaaaattagccgggcatggtggtgggcacctgtagtcccagctactcaggaggctgaggcaggagaatggtgtgaacctggaaggtggagcttgcagtgagctgagatcgcaccactgcactccagcctgggcgacagagcgagactccatctcaaaaaaaaaacaaacaaagaaacatcaggttgactagggcacaataagccaaagaagaacacagtgattggaagaacacgtgaggtatgatcggatcctgcaacggggaagggtgtgacggagcgagctgtggtcacgggatccccagccctgccttggaggaggcagaccctatctagtgactgtcctgcgagcaggactgggcaaggccctgggtgcctcagttcatcagagcttgacaccaccggcccctgagctccttctcgttccctaactgcattccactctcgcgtagctcctttggtgtatgactcggcttctggtgtaacttctcacccacagaggatgtgctgacttaggaagacggactttcaggccacctgtcagctgcgtttctaatgatgaattaataaactggcatctagcttacatatcagtctctaagtttcaccagtataagatagaaccccttagcttgatccaataataacacaagcattctgtacaaagcattgttctaagcatttaacatgaattaactcatttaatccttacaacaagccaatgaggtatgatttacaccccatcctttttttttgagacaaagtctcactttctctaccaggctggagtgcagtggcgcaatcttggctcactgaatagccttaacctctctgattcaagcaatcctcccacctcagcctgccaagtagctgggaccacaggcacacaccaccacgcccggctaacttttgtattttttgaaaagacggggttttgccatgttgcccaggctggtttcaaactcctgatctctagcgatcctcctgcctcggcctcccaaagtgctggggttacaggcatgagccaccacacctggccttatccccattttataaatgagaaaatggagacccagaaaagttacataaatgaatgtttgctcaggtctgcccagctagtaagactctgtgttgggccttgaactaaggtcaccttgggcccaaagcttaagcatgccgacttagcacagcgagacaccccaaccacggacactggggacatgaggtagagggacctggtgctctgtgctgtggtgaccgctgaaggtcatatctgaacagccttcctggggcataccacatttcaaaagactttatctatgaaacaaacctaatttgttaaataacaattattttccataaaaatttcatcaactaatactaatcatggtttctgatcagccttaaataatcacagttgtcaactcaagttatctaatatcagcttcaagaaaataaatgtgggctgggtgcagtggctcatgcctgtagttccagcactttgggaggccaaggcgggtggatcacctgaggtcaggagtttgagaccagcctggccaacgtggtgaaaccctatctctactaaaaatacaaaaattagctggtcatggtggtacacacctgtaaccccagctacttgggaggctgaggcaggaggatcgcttgaacctggtgggtggaggttgcagtgagccaagattgtgccactgcactccagcctgggtgatagaacgagactctgttaaaaaaaaaaaaaaaaaaagaaagaaagaaagaaaagaaaagagaaaagagaaggaaaagaaaagaaatgtggccgggtgtggtggctcacacctgtaatcccagcaccttaggtgactggggtgggagaattgcttaagcccaagagttcaagaccaccctaggcaacacagtgagactcccatctcaaaacattctcattcacactttttttttttttttttgagacagagtctcgctctgtcacctaggctggaatgtagtggcatgatcttggctcctcattcacacttcttaaaaactgtcttgaggccgagtatggtggctcacacctgtaatcccagcactttgggaggtcaaggtgggtggatcatttgaggtcaggaattcgagaccagcctggccaacatggtaaaatcatgtctctagtaaaaatacaaaatttagctgggcgtggtggcgcacacctgtaatcccagctactggggaggctgaggcaggagaattgcttgaacttgggagatggagattgcagtgagccaagatcctgccactgcactctagcctgggccacagagtgggactctgtctcaagaaaggaaacaaataaaaaccttcctgaacttttttgctcattatatacagtagctttatttttctgcagtatcttagaaatctcgtttagggaaattatcatgctaggaattgtgagatcatctctctttctcccccttccccctagtccatctttatctctgtctctgtctctctctttctctctctctctcatggcgttgttttccctgaagcttgttgagcaccagagatcctatgtttctgagacagtgaacacatagacaagttttgtgcagcaaaatacattcagccccatagaaaaggcgaaattagggttggcgtggtagctcacacctgtaatcccagcactttgggaggccaaggtgggagaattgcttgaggccaggaatttgagaccagcctgggcaatacagaaagaccccatctctaaaaaaattaaaacccgcaaaaaaagaaaccccttcctcctgagtagtctctcccgctcctcctctggcttcctatggcactttggttccacccctcttggtgaactggttacttgcggccttaaaggaccatcctctgcatacaagttgcaagacaagaggccctgtctgattcatctttgaatcccttgtggggccagcattgagccaggaacacaatggcaatactcaaaagtatgtggaaaggaatattcttaggtctccatagctgcacttctctagccttatgggtctatatcccagcaagtccatggaagtatttgtacaattaacagtgctgtgtatggttccttgcgttggaacagctggtgcagctcctttgaaagaaagactatggcaagcacttatttagcatcctccctccctccctccttctctctctctctctcaatctctcagattgctgtcacccaggttgccactgaagatattagttgtgcatttctgctactgcctaatttcaggtaaagctttctactgattttgtttttggtttgtttttttttataaaagcaattagcacactggttggatttttgaaaattaaaaaagtcctgcttcttcttcttcattcttccccttcccttcctgagtaattcagtcctgatgccattaggtggagaagaatggggttaggtatctgcactagggttgggggctcccttggtatttcagagcaggatgtccgaccctgaggagggcatctgtgtaggaaggttgcccagtgtgagtgtcagagcctgagcaaggtgaggacatccatgtatggcctggtaccagagcgtcagagactcaacagcgtgaacctgcagcaatggggtgggagtgaagcccggtgtggagagtcagagcccaggaagggcccaaggagggcattgctgaggaaggaagggccagggcagggtgtctggcaaggctgggatgcagagggcattcatcatttatcgtaggtgatggggaaagcaacccagtgcaacccaagactgaacaaagtgagaagggcactgagtgtggaagcgggagcagtgacaggagactgatctagaggtaaacgtgtgaaggaaaatgagagccaagattctcacgggtggagaaaaaattacaaatatagaaagaagaaaactagaatgaactctgtggtgctggatcaaaaatgtagatactggtgtgaactcacgattttcaatacaaagaggcagatatagaaataaatacagatttaagtgtgtatgtaagctctgtcccagctctgtccattgagagggacttggagaagtgacacccacgcccctctcaatgagcacacccagcgtccagatcttgggttcctttttttgagacgaagtctcactctgtcacccaggctggagtgcagtggcaaacatctgtctcctgggttcaagcaattcacctgcttcagcctcctgagtagctgagattacaggcgtctgccaccacgcccagctaattttttgtatttttagtagagacagggtttcaccatttgtccgggctggtctcaaactcctgaccttgtgatctgcccgcctcgacctcccaaagtgttgggattacaggcgtgagccaccacacccggccccagatcttggctaaataccattctctactataaggtaccagggctccctggtgaaaagcctgagacagaaattacaggatgagtctaggactcttatactagaaagcaaagaagcactgaaacaatgatggagacatctaaaaaggatacagggctggcacagtggctcttgcctataatcccagcaccttgggaggcgaaggtgggcagatctcttgagcccaagagtttgagacccctgtctctgcaaaaaatacaaaaattagctggtgggctgggtgcagtggctcacgcctgtaatcccagcactttgggaggctgaggcaggtgaatcacctgaggtcgggagttcgagaccaggctgaacaacatgaagaaaccccgtctctactaaaaacacaaaattagccaggcatggtggtgcatgcctgtaatcccagctactcaggaggctgaggcgggagaatagcttgaacctgggaggcggaggttgcagtgagccaagatcgcaccattgcactccagcctggggaacaagagtgaaactgtcaccaaaaaaaaaaaaaaaaaaaaaaaaaaaaaaatagctgctgtggtggtgtgcacctatagtcctggctactcaggagactgaggtaggaggatcaattgagcctgggagctcgaggcagcaatgagctctgattgggccaccgcactccctgtctcaaaaaaaaaaaaaaagaaaagaaaagaaaagaaaaaaagacaaaaaagtcagctcgaggtgctcccacttcaaattagggactgtttgagcatcagcataaataatgataagtctgagggtagtggctcatgcctataatccctgcactttgggaggacgaggtgggcggatcacttgaagtcaggagtttgagaccagcctggccgacatggtgaaaccccgtctctactaaaaatacaaaaattagccaggcgtggtggtgtgcaccagtagtcccagctacttgagtggctaaggcaggagaactatttgaccctgggaggcggagtttgcagtgagccaagatggggccactgcactccagcccaggcaacagagtgaagctctgtctcaaaaaaaaaaaaaaaaaaaaaaaaaatatatatatatatatatgtatgtatatatatatgtatgtgtatatatatgtatgtatatatatgtgtgtatatatgtatgtgtatatatatgtgtgtatatatatacatatatgtgtatatatgtatgtatatatacaatatatgtatatatgtaagtatatatacatatatatgtgtatatatgtatatatacgtatatatgtgtatatatgtatatatacacatatatgtatgtgtatataatgatagcaatgaattataacccctgaataaagtagaaaaccacaggttcatactgatatatataaatacattaatacagtaaaaatttaatgagaaatgagatacatatgttgaacatatctccaccccaaacattaattcactatgggggcggggaagagtcactttgcaatgaaggagcctggcagacaccgctttaatcaagtaatcgagtgaacatcatgaataacgggataaatcagcatcttgtgccacccgataggaggcagtcagaagaacacagcattgcttctgtgatattcttgccaaagttgcataacctgaatctaagcccaaactgagggacggtctacaaaataaacatcctgtactctttcaaaatgtcaaggtcaagaaaagacagataaattgttctggagtgaagaagagattaaagaaatataacaaaatgtagcatgtaatctacactggctttttttgttttttaagagacagggtctcactctgttgccctggctggagttcagtcatgaaattatagctcactgcagcctcaaacttttgggctgaagcaatcctcccagctcagcctcccaaatagctagggctactggcactcaccactgtgctgggctaattttatttttgtaggcatggtgggaggtcatggtttgctgtgcaggctggtcgtgaacttctggcttcaagcgatcctcccactttggcctcagagcgctgggattacaggcgagagatacaatgcccagccaggaatttttttttttttttaagacagagtctcactctgtcacccaggctgaagtgcaatcgtgagatctcagctcattgcaacctccacctcccaggttcaagcaccaccatgctcagctaatttttgcatttttagtagagacagggtttcaccatgttggccaggctggtcttgaactcctgacctcaggtgatccgccagcctccgcctctcaaagtgtaaagtgttgggattataggagtgtaatcccaggcccagccaatttgttttgttttgttttgttttgttttgttttttagtctcgctctgtcgtcaggctgaagtggagtggtgcgatctcagctcactgcaacctccgactcccaggctcaagtgattctcctgcctcagcctcccaagtagctgggactacaggcacccgccaccatgcccagctaatttttgtatttttagtagagatggggtttcatcatgttggccaggatggtctcaatctcttgacctcgtgatctgcccacctcggcctcccaaagtactggaattacaggcatgagccactgcgcccagccaatttttttaaatttaatttattgagacactaaacaaaactggaatgaagtttgaggatttgatggtagagatatatctaggttaatgtcttgattttgatggttgtgctgtggttatgtaggagaatgtttgcatgaaatatactgaagtattcaagagtgacagggcatcagattggctacttacttgtaaatggttcatggggtaaaaaagctattggttctgggactacaggcgcctgccaccacgcccagctacttgggaggctgaggcaggagaatggcatgaacccaggaggcggaacttgcagtgagccaagatcatgccactgcactccagcctgggtgacagaaggagactctgtctcaaaaaaaaaaagaaagaataaaaaaagctatttgttctgtacttccatttttctgtatgctcaagattgattatagctcattgcagccttgaacttctggactcaagcaatcctcccatctcagcctttcaaagtgctgggattataggcatgagccactgtatccagcccaattttctttatagaaaaatacaaacagctgggcgcggtggctcacgcctgtaatcccagcacttcaggaggccaaggcaggcggatcacctgagatcaggagtttgagaccaacctggccaacatgatgaaactcagtctctactaaaaatacaaaaattagctgggcgtagtggcacacacctgtattcctagctactcgggaggcagaatcacttgaactggggagacggagattgcagtgagcccagatcccgccactgcactggggcctaggggatagaatgagcctggggcctggtggatagaatgagactcttgtctcaaaacaaacaaacaaacaaaacaaaaaaacaaaaaacaatgtttttttgattcaggatccaattcaggatcccatattgcatttagtcgttacatctatttaggcgtccttttatttggaacaattctttagtctttatctttcatgaccttgacattttggaagagtgcagggcatttattaatttgggctagtctggtgttttctcatgattagattggggctatgcatttttggcaggaacaccacggaaatgatgctgttccttctcagtgcatcttatcaggaggcatgtgatgccaatttgtcccattactgctgatgttaacttcgattacttggttaaggtggtgtctgccaggtttctatgctgtaaatcactatttttccctttgtaattaacaagtttcctgtagagaagaaatatgtaatttttatctaatacaaattatcgatgttttgcaagaataatttgttcttttgaagctttgagtccttgagattttctacaccattgttttctattgatagtatcattttatttttatttaggtctttaatccatccagaattcaccctgtacgtactgttgtataggaacatgcttttcatttctctccatagaatgagctaatttttccaacattacctatgaaacagtctgtcctctcttcagtgatggtgatgccacatttacgcacatgatgttctcatttatattacattgtgggtcaggttctgttttggtctctttgttcttacacccgtaccatactgttttgattactgtagattagaatcttttttttttttttttaagacagagtttcactcgtctcccaggctggagtgcagtgacacgatctcagctcacagcaacctctgcctcccaggttcaagcaattctcctgcctcagcctcctgagtagctgggatacaggtaagcgccaccaaactcggctaaatttttttgcattttttagtagagatggggtttcactatgttagctaggctggtcttgaacccctgacctcaagcaatccgcccaccttggcatcccaaaatgctgggattacaggtctgagtcactgcgcacggactgattactgtagtctttagtcttgtagtatgtcttgatatctggtagagcaagcctcattctttttttttttttttttttttttttggagttggagtcttactctgttgcccaggctgcagcgcagtggcacaatctgggctcactgcaacctctgcctcccagattcaagtgatcctcctgcctcagccttctgagtagctgggactacaggcacatgctgcctgtgccaccacgctcggctaattttttgtatttttagtatagatggggtttcaccatgttggccaggctggtcttgaactcctgacctcaggtgatccacccacctcggcctcccaaagtgctgggattacaggtgtgagccactacaccctgcccaagccccactctttactcttctttttatatattgactttgctaattttgaaaatgaacttctgcaaataaatactaaagtaagtttaagtttttcagaaaattcccatggattttaagtggaattgcattgaatacacacattaactggggagaacactaatatcatttgttattaagccattctgtccaagataatgaaatatctctctattttatttggatcatcttctgtgccctttgagtttttttcccccataacacttctattggactttgagttttaatgttttcttcagagtttgctgtgttttgttttgcttgagatggagtcttggctctgttgcccaggctggagtgcagcggtgtgatctcggctcactgcagcctccgcctcccgggttcaagcaattctcagcctcccaagtagctgggattacaggcaccaccagcacacctgactagtttttgtagttttcagtacagatggggtttcaccatattggtcaggctggtttcgaactcctaacctcaggtgatccacccgccttggcctcccgaagtgctgggattacagacatgagccaccacgcctggctatagaggtcttatattaattaagttcctagatactttatagtttttgtcattattgtgaatggcttctttgattgtcattttctagttggttacacctggtatagagatatgctattgaggccgggcgcagtggctcacacctgtaatcccagcactttggaagaccaaggcgggtggattacttgaggccaggagtccaagaccagcctgactaacatcgtgaaactctgtctctactaaaaatacaaaaattagcaaggtctgctggcaggcgtctataatcccagctatttgggagactgagacaggagaattgcttgaacccaggaggcagaggttgcagtaagccaagatcagaccactgcactccagcctgggcaagagagcaagactccatctcaaaaaaaaaaaaatagatacgctattgatttttgtagatcttctatctggctaccttggtgaattctcttactaattacaacagcttcttgactctattggtattttgaagtataccacataaataattatggtgttatgtatatgaatacatacctataaatatttttacatgtggctatctatatctacagtaagctacacatggattcatactgatgactccaactccaatccattactgcatggatcattctgacctttcccccttgctcacctatatgttctcattcttcttttttttttttttttttttgagatggagtcttgctctgccacccaggctggagtgcagtgagacgatcttggctcactgcaagctctgccttccggattcatgccattctcctgcctcagtctcctgagtagctgggactacaggcgcccgccaccatgcctggctaattttttgtatttttagtagagacgggggtttcaccgtgttagccaggatggtctcgatctcctgacctcgtgatccgcccacctcagcctccgaaaggctgggattagaggcgtgaaccactgcgcccagcctatgctctcattctaacagcaaaaacctgcctcttggctaggcacagtggctcatgcctgtaatcacagcactttgagaggccaaggagagcagatcacttgaggtcaggagatcgagaccatcctggctaacatggtgaaaccccgtctctactaaaaatacaaaaaattagccaggcatggtggcgggtgcctgtagtcccagctattcgggaggctgaggcaggagaatcacttgaaaccaggaggtggaggttgcaatgagctgagacctcatcactgcactccagcctgggtgacagagcaagactccgtctcaaaaaaaaaaaaaaaaaaaaaaaaaatctacctcccaccatgcaccactggaacttaattgttcaaatccaggatacacgtggagtgatctcaacaattgttaacctatttcctcaaggaaacagctgtatccacaagagtacagtacttgtgtacagttcattttacctttagtcttacagactctacacatttccagtcgacttaggtcagcaccattctccccactactcttcttcagtgaagttatttcatatgtttgtaatacaggtagattcttttattccattcttcactccatccttggatctctcaatctcctaaatgattttttaaaatttgcatacatgatgttttactctttgagctgtaagggtctatgggtttccacaaacacatagtgtcacgtatctataatcacagtatcatacagaaaagcttcaatgcccccctccgaaatttcctgtgtttcctcatttaaccctcactgccccctccctcccaaaccctggcaaccactaatttgtttgttatttctatagtttttcctattccagaatgtcatataagttacattatacactcggtagccttttcagactgacttctttcgcttagcaccgtgcattgaaaattcatctatgtatttgtgtggtttgatagctcattgctttttattgctgaatagtatttcattgtagagatgtatcacagtttgtttacccattcacctattgaaagatattttggttgcttctacttttcagcaattttgaataaaaatgccataaacatttatgtgctagttcgctagtttttgtgtgaacacaagtttcgcatcagctgggtaaatacctaagagtgtgattgctggattgtgggtaaaactatgtttggtaaaactatgtttggctttgtaagaaactgccaaactatcttccaaagtggctgcatcgggccaggtgcactggctgacgcctataatcccagcactttgggaggccgaggctggcggatcacctgaggtcaggaggtcaagaccagcctgaccaacatggcgaaaccctgtctctactaaaaatacaaaaattagccgggcatggtggtgggcacctgtaatcccaactactcaggaggctgaggcaggagaatcgcttgaacccaggaggcagaggttgcagtgagccaagatagcgccattgcactccagcctgggcaacagagcgagactgtctcaaaaacaacaacaacaaaaaccgaagtggctgtatcattttacattcccgccagcaatgaatgagcattcctgtgtcttcacctccttgtcagcaattggtattgtcagttttctgatttttgccattctaaaagatgtgtagcagttatttatggtattttcaaagtgttctttttgttatttatttttagttgtactgcataatggttagggaacatagtctatgtgacactgatgtggatctaatggtggaatgaattttggtctttctttgtgacctaatgcatggcttatttttgtaaatcttctgagtgtacatgaaaagagtatttcctgtttgtgcaatccagcagaacacaggagttcagagcataagctttggagtcagcctgcgtagtttcccaccctgctctaaggttagtaacaatatgagctcaggcaagctttattccctatgcttcagatcctttaataaatggaaataataacaatagtatctaccttttagagttatcgtaaggattaaaacagctagtatttgtaaagtacctagaacggtgcctggcactgtagtaagtatgatataaatgtttgtaaaataaactaatgtatctaaacttattgtatattttaagtcttttactattttatttctatttatttatttatttatttatttttgagacagagtctcgctctgtcacccaggctggagtgcagtggtgcaatctcagctcacggcaacttccgccttccaggttcaagcgattcttttgcctcagcctcccgagtagctgggattacaggtgtgtgccaccacgcccagctaatttttgtatttttagtggaagtagggtttcaccatgttggccagctggtctcgaactcctgacctcaagtgatccacccgccttggcctcccaaagtgctgggattacaggtgtgagccaccgcgcccagcctgtttttatttttttagggagagggtctcactctgtcacctaggcttgagtttagtggcacgatcatagctcactgcagcctcgaactcctggtcccaagtcatcctcccgtctcagcctccttagtagctaagactacaggcgtgcaccaccacatccagcaaatttttatttatttattttatttcttacagacaggggtcttgctatgttgcctaagctagtctcaacctcttggcctcaagtgatcctcctgtctcagcctcccaaagtgcttgaattacaggtgtgagccacttcacctggcctatgtttttgatttttcctttttttttttttttttttgagacagagcttcaatcttgtcactcaggctggagtgcaatggcacaatctcggctcaccgcaacctccacctcccaggttcaagcaattctcttgcctcagcctccccagtagctgggattacaggcgtgcgccaccatgccaggctaatttttgtatttttaggagagacggggtttcaccatgttggtcaggctggtcttgaactcctgacctcaagtgatctgcccaccttggcctcccaaagttctgggtttacaggcatgggcaaacatgcccggccttaactgcagttttcatatctaagaggtccacaatcatttactgaaaatccatgggtccgggcccagtggctcatgcttgtaatcccagcaccttgggaggccaaggcgggtggatcacctgaggtcaggagttcgagaccagcctggtcaatatggtgcaaccccgtctctactaaaaaaaaaatacaaaaattagctgggcgtggtggcatgcgcttgtaatcccagctactcgggaggctgaggcaggagaattgcttgagcttgggaggtgaaggttgcagtgagctgagattgtgctattgcactccagcctgagtgacagagtgagactctgtctaaaaaaagaaagaagaaaaaaagaaaaaatccataggaacacatatttttcagaattcagaatatttcaaattttagaaagttaatacaataatactttaacacaggagtcctcaacccctgggctgcacatcagtaccctattagggtggcctattaggaaccggccgaacagcaggaggtaagccacgggccaggaagcattatcacctgagctcagatcagccccgcattagattctcataggagcgcaaaccctattgtaaattgtgtgtgcgagggatctaggttgcctgctcctcatgagaatctaactaatgcctaatgatctgaggcagagcagtttcaaccggaaacagtcccctgcatccgtggaaaaactgtcttctaagaaactggtccctggtgccaaatagattggggaccatcgtctaattcaatactgcgtgttaggtaacatccccagtggggtctggaatggtactctgtaatcagacacattcttacttctgaagcaaaacatgaatattcaccctgaatgggataactactattattatataaacagccccttgttggttcagattttgctacccagtgagtattgtcctcaaaattattattattgttgttgttgttattttgagacggagtctcactctgttgcccaggctggagtgcaatggtgtgatctcggctcactgcaacctccgcctcccgggttcgagcaattctcctgcttcagcctcccgagtagctggggttacaggtgtgagccaccacatccggctaatttttgcatttttagtggagacagtgtttcaccacgttgttcaggctggtctcaaattcctgtcctcaagtgatccgcccacctcggcctccctaaattctgggattataggcatgagccaccatgcccggctaataaaacttcactttagaatgtacatgttgttcagtttgttgtccttcacctggactccctaagtgtgtgatgattttggcctgggagcttatattccgctggggggtctcagccattccatctggtagagggtgttgggaaagctctgaaggctatatcacccagtctatggtagtcctggtgagttccaggaaagaaccctacggcagagagcagcacactacacgactaatcactcccatttgctgccacccaccaagacatttaagccctttaaactcatagggagaagcaggtggggaggaggtaatctcccagccctggggttttagaaagaggaaatggcagagtggtgccaaggtgattcagtccccttctgttctcatcagatcctctcatggcaggacttctgcactctcctgatattagaggtagtgataatttttttttttataaaacaggtcataaaagtgataaacgtgatctagaagacattgacaattatttgtttttataaaaatggaatcatactataaaatcattctgcactcagctttttaaaattttatcgatatacataaatagaacccattctttttttttttttttttttttgagatggagtctccctctgttgcccgggctggagtgcaatggcatgatcttggctcactgcaacctccgcctcccgggttcaagcaattctcctgcctcagcctcctgattggctgggattacaggtgcccaccactacacccggctaattttttgtatttttagtagagatggggtttaactatgtttgccaggctggtctcgaactcctgacctggtgatccacctgtctcagccttccaaagtgctgggattacaggggtgggcaatcacgcccggccagaacccattctttttaacagcggcacaaaactgcacaatattttctggtatggatgcaccatcatgtattcaatggttctctctttggtgaacattcaagttgttgccctctttttttgccccttcagacaggtttgtatctgtgactatattcccttacccaatagtgtgctcatttctgtaagacagcttcccagtgtattatggaaggataataagagataccgatagcactaattacttctaggagtgggacagagaagggaaaggggggtactttttactttctactgaatacccattaagactttatatctggaatgtgaactaattttacaatattaaaaataattaaagcacaacaatgtgaatgtacttagtgccacagaggtgtatttaaaaatggtgagaacagtacattttatgtcatgtatattttaccatttaaaaatataaatatggccaggtgcagtggcttatgcctgtagtcccagcactttgggaggctgaggtgggtggatcacttgaacgcaggagttcgagaccagcctagacaacatggcaaaaccaaaaaaaaaaaaaaaaaaaaaaaagaaatacaagaaagctgggcatggtggcgcacacctgtagtcccagctactcaggagactgaggcaggaagatgtcttgagccctggaggttgaggctacagcaagcagaggtcatgccactgcactctagcctgggcaatagagcaagactctgtctcaaaaaaaaaaaaaaaatatatatatatatatatatacaaacacacaaacacacacacatatatatacacacacaggtgcacacctgtagttcccagctactcaggagactgaggcaggaggatcacttgaacccaggagttcgaggttgcagtgtgctgtgattgcgccagcttgggtgacagagtgagggtctgtctaaaaaaacaaaacaaaacaaaacaaaaataaccctccactagtttccaaacaagtttgaaagtccttatcaaggttccaaggccctgagtaatccagcacctcctgacttctccagactgtctggcctcactctccgcttgctttcacaagagcttcccttcatcccctgttaggctccaagctttctctcaactcatggcttctgcacacacaggtccttgtgcctgaaaacttatccttcatcttatttgctttactaattttttttttttttttttttttgagacggagtctcgctctgtcgcccaggctggagtgcagtggcgcaatctcggctcactgcaagctccgcctcccgggttcacgccattctcctgcctcagcctcccgagtagctgggactacaggcgcccgccaccacgcccggctaattttttgtatttttggtagagacggggtttcaccgtcttagccaggatggtctcgatctcctgacctcgtgatccgcccaccttagcctcccaaagtgctgggattacagacatgagccaccgcgcccggccattttttatttttttattttttatttatttttgagacaggatctcactctgttgcccaagctggagtgcagtggcatgatcatggctcactgaagcctcaacttcccaggctcaagcaatcctgccacttcagtgtgcaccaccacacccagctgatttttgtattttttgtagagatggggtttcaccatgttgcccaggccggcctcaaactcctggcctcaagtaatctgcccacctcagcctcccaaaatgctgggattataggcatgagccaccacacctggccagctcactaattttccttttttaattattgtgggtaaacagcaggtgtatatatttacggggcacatgagatgtttttatataccatgttgcccaggctggtctcaaacttctggtctcaagcattcctcctgcctcggcctctcaaagtgctgaaattacaggtgtgagccaccatgcctggccttttgttttcttttttttgagacagaattccgctcttgttgcccagactggagtccaatagcgcaatctcagctcaccacaacctctgtctcctgggttcaagcgattctcccgcctcagcctcccgagtagctgggattacaggcatgcgccaccacgcccagctaattttgtatttttagtagagatggggtttctccatgttggtcaggctggtctcgaactcccgacctcaggtggtccgccctcctcggcctcccaaagtgctgggattacaggagtgagccaccgtgcccttgtcttttcaacaagtggtgctggagctattggatatccacagacaaaactaacaaacaaaaacttgacctaaacctcataccttatacagaagttatttcaaatgggtcgaagatttaaatgtaaaactataaaacttttataagctaactagaagaaaatatctgggatgcagggcttagtgaaaagctattagacatgataccaaaagtatgatctataaaagaacaaaacaataaaccgaggttttggccgggtgcggtggctcacacctgtaatcccagcatttggaaaggctgaggcaggcggatcacctgaggtcgggagttcgagacctgtctggccaacgtggtgaaaccctgtctctactaaaaatacaaaagtagccaggcatggtgacaggcacctgtaatcccggctcctcgggaggctgaggtgggagagaatcacttgaacccgggaggcagaggctgaagtgagctgagatcacgccattgccctccagcgtcggcaaaaagaacgaaactccatctcaaaaaataaataaataaataaataaactgaggtttggatttgtgttggtgaggctgtggggaaatagaaacccttacacattgctgatggaaatgtaaaattgtccaactggtgtggaaaacttcagcaagttaaacacaaaattattctctgacctagcaattctattcctgggtgtacacccaaaataactgaaaacagttgttcaaacaaaaacttacataccagtgttcatagcaacattattcacaatagccaaaaggtggaaacaacccaaacttctatttacagatagatggatagataaaatgtgggatatccatacaatggactattatttagccataaaaaggaatgaactggccaggcgtggtgactcatgtctgtcattccagcaatttgggaggcaaaggtgggcggatcacctgaggtcgggagtttgagactagcctgaccaacatggagaaaccctgtctctactaaaaatacaaaaaaattaggtgggtgtggtgatgcatgcctgtaatcccagctactcgggaggctgaggtaggtgaattgcttgaacccgggaggcagaggttgcagtgagccgagatcatgccactgcattccaacttgggcaacaagaatgaaactccgtctcaaaaaaaaaaaaaaaaaggaataaactgattaatactacaatgtggatgaatgttgaaaacactatactaaatgaaagaaaccagacacaaaaagtcatatattataggattccatttatatgaaatatacagaataggcaaagctacagagacagccatattggtggtttttagagactgggaagaggggaaatagagagtgactgcttaatggatacaaggcttccttttggggtgagaaaaatgttctggagctagatagaggtgaatgagtgcacaatattgtgaatggagccaggaggggtggctcacacctgtaatcccagcactttgggaggccgaagcaggcaggttgcctgagctcaggtgtttgagaccagcctggctaacatggtgaaaccccatttctaataaaaatacaaaattagccaggtgtggtggtgggcgcctgtaatcccagctacttgggaggctgaggctggagaattgcttgaacccaggaggcagaggttacagtgagcccggaaggctccattgcactccagcctgggccacagagactccatttccaaaaaaaaaaaaaaaaaatcaatcaatcactattgcaaatgtgctaaatatcactaatggcaaattttatgttatgtatattttaccacaataaaaaatagtgcattttactacatgtaaattatacctcaataaaactgatgtaaaatattatttaggtaattaatggatgctaaaactggtgggtgaaactttgatgacgattggaatagttacatacaatcaaattgtctccctacaaatgtacttatttaattatgaaaagaaaaatagtagcattatagtggagaaatctggcaagcaacacccgtgatggttaattttatgtgtcaacttgaagtgtttttgaatgagattaacactgaaattggtgaattttgagtaagcacattgccctccagaatatgggtgggtgtatgagtcacagttctccagacagacagaaccaataggggatagatgatggatgaatggttggatggatggatggatggatggatggatggatggacagacagataaatagataaatggatgagaggggatttattaggcgaattagctcacatgactatggatgctgagaaatcccacaaccagccctctgcaagctggagaccctgggatgtggcagtccaagtccaagtccaaatccaaaggcctagagccagggaagccaatggcgtaactctcagtttgaggccatcgacaacctgagaacctgggaggcctctggtataagtctcaaggccagagagcctagagttctgatgtccaagggcaggaaaaggagtgtcccagctccaggagaaggagacagaggaaattcttttctctccttttttgttctatgtgggccaccagcagattggatggtgccctcccacaatgagggcagatcttccctactcagtccacttactcacatgccaatctcttctagaaacaccctcacagatgcacccgaaggaatgttttaccgcttctctagtcttcttttttttttccagactatagtcaggcttctttttttttttgagttggagtttcattctgtcacccaggctggagtgcagtggcgtgatctcagctcacagcaacctccgcctcccagactcaagcaattctcccacctcagctgggattacagttgtccaccaccacacctggctaatttttgcatttttaatagagacagggttttgccatgtttgccaggctggtctcaaactcctgacctcaggtgatctgcccacctcggcctcccaaagtgctgggattatagacgtgagccaccgcgcctggccccggcttctgaataggtcttccttaatttagtcaagctaagacccagagttaaccttcacaatgttcctcatctaatcacttgaggcctgaacagaacaaaaagatggacctccatgagaaagaggaaattctccagcaggctgcctccaaatttcatctgcaccatccggtctccagggtctttagcccgccagcccgcactggacttgcctgtacaagcacacgagccaattccttattttatatatacgtattctctctctctctctctctctctctctctcaatctctgttggttctgttttctctggagaaccctaacacaccaccttattgaaaggatcaaagttaaaatcgccagtaactgtaactgacatgtacatcctcccaatgagatatagtgagaagggtacaacgtcacttatgtggtgttcctatgggaagtgcatatcctgaatctaattatgaggaaacaacagacaaactcaaactgacggacattctacaaaacaactggccagtactcttcaaatgtgtcagtatcacaaaagacaaaaaggagaaactactcccagtagaagactcttaaaggctgggagcagtggctcacacctataatcccaacactttgggaggctgaggcaggcagatcacttgaggtcaggagtttgagaccagcctgaccaacttggtgaaaccccatctctactaaaaatacaaaaattagctgggcatggtggtgggtgcctgtattctcagctactcgggaggctgaggcaggagaatcgcttgaactgggaggtggaggtcacagtgagctgagattgcacacgcaccactgcactctagcctggactacggagtgagattccatctcaaaaaataaaaataaaaacaaaaacacaaaaattagccaggcattctggcgtgcacatgtagtcccagctactctggaggttgaggcatgagaatcacttgaacccgggaggcggaggttgcagtgagctgagattgagccattgcactccagcctaggcaaaacagtgagactgtgtttcaaaacaaacaaacaaacaaacaaataaaaaaaactacccccccccacaccaactggctgggcatggtggctcacacctgtaaccccagtactttgggaagccaaggaggaaggatcctttgagctcaagagttcaagactgcagtgagctatgattgtgccactccactccagcctgggtgacagagtgagaccctgtctctgaaaaaaaaaaaaaaaagaaaagaaaagacaaaccgaagtgtttaggggtaaagaggtcggatgtgtaaaacttaatttgaaatggttcagaaaaaaatgctttatttgcaacttttgtagaagttttgaagttattttgaaatacaaaatttaaaaattaattgtttaattgacgtctttcgtgaggggaggggctaccactgtcttgttttctgctgtagttccagctctagcacaccgcaggcttcaacaagaaatatttcttgagtgaacaaatgaattaatgaactaaaccatcttccaatttgggtttcaggcaggggctgggattttggaagtcaagctttagacagcaagaggcaaaattcctctttttctctaggtatatctcttctggagctccaatctgagagggtagatcatctatagtttggggaaataagacctctgccctccaaaggccgacaggcagcccacaagcaggagataattgagttgtgctttgcaacaagaagacctggctgagtgccattttctaagtcagttccctaaggttcaccctattccccacatcaccaccacccttggttaagatttgttttttaatttttaattgttatggagatagggtctccctatgttgtccaggctggtctcaaactcctggcctcaagggattctcctgccttaggctcctgaagtgctggcattacaggtgtgagccaccgccagccagttaaaagcttttataatatccattactattactcttgtaatgcagcacttatctcaagctactgtaactgtatatttgtctgcccttttcactaaagtgtgagactctcctaggcagaagctaagtcttttcagctcaatatcctcctatgggccaggcgcagtggctcatgcctataatcctagcactttgggaggctgaggcaggcagattgcctgagctcaggagttcaagaccagcctggacaacatggtgaaaccctgtctctactaaaaatccaaaaaattacccaggcatgctggtgctcgcctgtaatcccagcttctcaggaggctgaggcaggagaatcacttgaacctgggaggcagatgttgcatgcagtgagccgagatcgctccactacactccagcctggacgacagggcgaaactctgtctcaaaaaatatatctatatatctatatctatatgtatatcatctatatcatctattctcctatgactaccacgtagcccaccccatgctatccctcagcccggcctcagatctggaatctggttcctgtgctgtccccttctgcccttggctgtcatgctgctgcctcaccaccagagggccttccagctgggcctcagagacccttcttactgccccacccaaggtgccaggcagccagcactggctccccaccccctgcccctcatcctgcagggtgccctatgctttttgtggagccattcacctgtctctccctccatttgcctcagctaaggagaccttcctagcaagatctcagggttggtccagctttgcagcaaagtttgacttctgccagtgtgtgtgtctggtctctgatagggatgctatcttcctgggaggctgtcttacatctaagctctcctcaggaccaaacagaaggacctctttttccatttccatgtgtcggagacctccctaatgactgctatttgcaacctcatgtttgtccaagggctacatgtagctcttggttcatttgtagaaggggcagagcacaaggtgcttgtggaaaggtggccactgcctggacctttgtgaggccctcagggccagggctggtcctacctgaggccctggatcacctggagggaccatcagcccatccactgtttctccctaggcctgaaagagggaccctcgttcaggatgaagctgagaacagactcagtagagaaagggggagagaggtgaatggaaccatgacccaggtagtatggaaagagggctaggacccagctggagctccctgtgtgttgggtacgtgtgactgtgtctgtgctccctgtatcattcctgtgcatttccacccatgaaattccctgggaaaaggtcaagctctctccaccatgctaagtagggtgagcaaaggagatggttggggttgagggctcagatactcaaggaggcagggatcccccggggggatgatccctggtgatagtgattgaaatcagaaggagagagttaatgcggaggagtgagaaccatgggcccgactcgaaagctcacttcctactggctgtcctccatccccagctctcctcaagctctctctgcagaatctcagtatggcatctgccaaaaagcttacatggatgatccccaaacatggtcatctcctctcacttccccagggctctcagactcttccttgggggacctgggagaggttttccggaccttcctactttttgacagcataacactgtcaagcacatgcaaagtctgccaataacaaggggccctcctgacaagcagagatgttttctcttcagggctgcggtgatgggtgggggtcactgctatgaggggacggtctgcagccataagaaggctcttcaggctagaaggcttcactcccaaggcccgcacagctgaagagaccaaggggttataggctgagggcgctattgtgcacaccctcccaccccagcagaagtggttggcactgcagcgatgccaaggccggctgcttgggggtgggaggaggtcgctgcagtgatgaggaatccctgcttggagtgagtggtcactgaagtggctgcatgaactaaaagtacctgcagggatgggggaggttttctgcagtgatgaagagcactttgcaaaggaaaggggccagcttcttgggggaagagtcctgcggtgacggtgatggggggctggggggttcgctgcagtcaggagggagggtctctgcagcgatgggaagcaacccagggcagggggtggggtgggctggggaatgggatgccgtcgtggtaatgggatagctggggtcgcggcagtgtcggtggcacttgcaggacgcctgattcctgaagaatggaaagggtggggtctctgaggcctcggtcctgcagtgacggggatccgtgcggcggcggggacgcggtccctgcactgcggtgcccagtctggctcgggctgccgcggctggcgcggaggcggtaccgcgcccgaaggaggggggagcgccagccccgccgcagcagcagcaggcgtggccagggcaggctggaggggcggcctctcggaacgggggcgggaccaccgccggcagggcccgcgcccctgccgggactcagagccgctgcagccacagtcacgaactggcggccggcaggtgccgggaccgagggccacccggagcgcagaggcggcaccacccacacggatcccgtgggcacctagaactccgcggagggcgcgacggtgaggctgagactgccacagggagcggggcgatccccagagccagcccgcggcatcccctgcgcgggccgcggccactgcaggtgccccctcctcccacatcagctctgccggggtagggagcggtaacctggcggctcccacggactctccctggcccgacacctctcccgggcttgcctcccaaagaccccctcttttcgctttcccagctcgttcttcccacccttaacccctccactccggccagcacccccgtcggatgaggcaccagggagagaaagaccaaggccctttcggcgccccatccaccctgcccccgcgatccctcgcagggccgggggcctccggggggattcgggccctttaaacctccgccttcccggagcatcttccatctccacccgcgccgcttccgacagctggcggccgcggggggccccggggggccggcaggtacgggggtggctgcgaggttgggagtgggcggtggaacagctgtgaccgcccccacccccgggggagccgcggcgggactgctgggcgccgaagcgcgcgttaatcattaaccctccgcggcccggctgcccaggtaacgcgtgaggatgccctcctcgccaccacgcctgccgcccccttatctcccccgccacctgtcgccctcaggagctcccgctcggcctcgcgccccggcaggccccgtccgggtgctggagtgagactctcgcgctggcctctggagcgcggggtgggcgtcccgtcaccctgcgcccagcttccccggcccgttcccgcagggccggcctcccggcgccatgcccggcctgtactgcccctccagctggacgccgctgccgctcacggactcctgggtccgggcctgcgccaacggcccctgcctcagcgtgcgggcccggctcacctaccgcaacccgcagccgcagccggtggacggtgaggcccgggtggggcgcgggcgcggcggggggtgcgccgggcagggtccgacgccgcctcccgccgccctccccaggcgtgttcgtgtacccgctggccgaggccgaggtggtgtccggcttcgaggccgaggccgccggacggcgcgtctccttccagctgcagagccggcgccgctcgcaggccgcctgctgccgcgctctgggcccggggctggggaccccgacgccccgccgctgcgcgcagggtgagttccgcgcgcccgcacccgcgctcctgaaagccgggcgcagctcaggctcccgcatccgctcggcctccgcccgtcccccgccttcctccgggcactgccttgtgcattcattggctcatcctggtatttagcagtcgtgggctgggcacctgacctgcgccaggtgctgggagaacatggcccggaggttcacagcctgggagacagacacagcaggcagcacagggcttgcgggggcgccagcaacccttacagcccaggagaccggtctctctagggggctgcaaagggagccttctcccctggtggtcccctccggccccttactattttaggctgcacacctcaatccggccccgcgtgggccagtgaatcaagtgtagactcctgtgcctagcagccaaggccctcgctctcaccccattccatccctctcccagcgaccccatacaccaggtaccgctgccgctggccacactgactgacaggtcctttcccaactctctgctctgtctttccatcttctattgagcaaattcctacttgtcctttaagatccactaaacgtcattcctagggaaaccctccctgactctcccacaaatagctgcactgtttcctggctccccagccttttgtgccccctcgttatggcacttacagggggagtcattgtcacagatctgcctgtctgtctccccgctggagcatctccaaatcccagcacctcacacagaacctggcactatgaggcccagcgagtgcccggggaagggacagaagcccagccctgtgctgtgtgctgtgcttgcacctggttctttcattgattcattcatacatggctttgattcctgcccaggggatttgcaatccaggtaagaagaagaggaacagaatccagtggtgttgagagctggcataagcccagcacgttaggggcttgtggttagaggctagagtgagctctgggctgaggccccaggaatgttccagaaggaggtagagccagcatttgactgcaagaaagggtaggactcagttaagtggaaggtaggggcaacagtataagcaaatgcttataagtaggttacagtgggtaatgacaataaaatatctcatgtttatagtgatttacagtttacaatcgctagtatcacctcatttgaatcccaagtagtgggtaatgcaggcttcttcctgttatgggggatggaagggggataatcccccttcctcctgttatgggggatgaaagtcatagcaggggtcactgacttatatgttgggtgctttgcatacattgcctcatttgttcctcaccacaatcacagagttattatgatccccactttatggatgaggaaacaggctcctcagaacaagagagctgccaaaggactcaattagaggtcaccgagctgatatttaaaacttgatgctgtgctgtctccactgtgtcggttggctgggatggaagcccctttctttctttccttccatctttttcttcccttcagttattcagcaagtatttattgaaaggatgaacaattggtcattgtgaggaagtgaggtacagtagggctgtgaacgtgggctggggccagaccacgtcggtggtgtacacagctgccactgtacatggctggtcattattcctttagcagccccaccagtccccaaacaaacctaggagctaaataaaacagtgtgtgcagtgtgcaaatggagctttatgtcctccagcctgcttcctgcttctctattcctcctgcccgggaggagtagagaattctggagccaccttagtgggcaatgggggagctcctgatggttcaggagcaggaaatttatgagcagagtggggtcccaggccacagggagatgtctatccacaagggatggtggccaagggttgaatggaaagaggcaggcagggggagaggggcagagggtgtgggtattcccagggccttgagagtggacatggccccttctcctcagccttccattagcaaggatgtcactgctgctcttgcctgatgacagccagatctgttcacagttagtctgcctctcctgccatcattcatctcatgcctccatcctgcgtcaccaatgcattagcctagtgccaacacgcaaagtcccccttgcccaggctccctgacccaatgcctgcttccacatctagcttcctccctctcctctgcttccagcatgctctgaccccatttctcacccatcataggtcatcttgtcttggatctggcccaggcccggtccacgttggtgctgcccacaggcattatcgccgcggctggcaccatgacggtgaccctgcacagcagccgggagctgccctcaaggcctgacggggtgctgcatgtggccctgcccactgtgctcaccccgctggccccgccaggcccgccggggccccccaggcctccggggctctgtgacgacaggttgggcctatggtgattctcttcgtccctccctcggcttctctgggtctagtgcgggtgagggggcactggcagggtacccagggatgggaagggtgaggaagggctggggccagtcagccggagggtttaggggccttcacagtggcccagtgaccctcctcatgctcccttccagccccaccagctgcttcggggtgggcagccttcaggaggaagggctggcctgggaggagctggctgcccctcgggacgtgttctcaggccctgcccgctgccctgccccatataccttctccttcgagatgctggtgactgggccatgcctgcttgcaggtgggtgcatctggctggcctgccctcttttcagatgcccactccacccagtgtagtgactggaagggaaataaggctcagggataggagggacacaggacaaaaagacagggaccccagcctccggaacatctgggttagtggtgggagcatcccctggtcacctctacccaacacacacaccccaattttatcaaggtaatttatttatatctcatcccacccagcagtgggaagagagatacttacaatgggactagtacctgtgatgaagtaggttttccttacacagaaggtggggggtgaatgctaaatcagcacctggctgatgcatgactcttcgaccagccagaaaccctgctggaatctacttcccagcccatgaaagcaggcacatcctccctcgtccatctgaccccatatagatcagactctgagagctgactgaatcagccatgacccctgccaacatttgctgtccctgggaaggtgttatggctacatctccccttcctgcctctatgtccctcaggcctggagagcccctctcatgctctgcgggcagatgccccccctcatgccagctctgcagccaccatctgtgtcacactggcagagggccaccactgtgaccgggccttggagatcctgctgcaccccagtggtgagagactgggacacaccgtgggccggctctgacctgcttctacatgaatgggggaagcatttcttaagtgcaggtttctgggccccagccagatggactgagtcatctgtgagggcagagcctgtggtgcaggaaggctggacctgcaggctcctcctggacagtgaaactgggcacttggggtccagaggcagggccttccttgacagaattgtgtcctctcctctcagagccccatcagccacacctgatgctggagggcggcagcctgagctcagcagaatatgaggcccgggtgagggcccgccgagattttcagaggctacagcgaagggacagtgatggggaccggcaggtaccgccataggagcctggcctggcccctggccttggctgcatttgtgcacaaggagcaggcaagcaggcttacattggaatgggtgcggggaggcctcttttctcggtaagatctctccacagctgccaccaaccatcacagaggacagatgagtattgtcattggagggccgatgtgaatctctctggggtgtgtctcagaggatggaggctaggtctgatataaacagaagacagccacctgcctttgctcctgcctttattcgaattactacaaaaagatgtcccctctgggtggatcagacagaaaaaggccccagagccagtcccactgcccaccctcaacaaagtagcactaagccttgcccaggctgacttgggactcccccgctcaggtgtggttcctgcagcgacgcttccacaaggacatcctgctgaaccccgtgctggcgctgagcttctgcccagacctgagctccaagcccggacacctggggacagctactcgggagctactcttccttttggatagcagcagcgtggcacacaaggcccgtgggggtgtggtgtgggcaggcctgggggttgggtggggcagtgggtctgaggagggctgggggcagcctcttgaagccaggagttaccttgttgcttcaaacaccatcttccaaagaggaagcagatggcaactcctcaggggattcccttagacagcagccctgctccaaccgccaaacagacactgtcacgctctcttgctcatattcacgcacacacatctctccaggattccaagagcctctcacacatagactcgcactcagtcacagggagtcactccaatcacagggacactcaagtttcatgtgtacctccagagtcccacacacagccatgtgtacctccagagtcccacacacagccatgtgtacctccagagtcccacacacagccatgtgtacctccagagtcccacacacagccatgtgtacctccagagtcccacacacagccatgtacacctccagagtcccacacacagtcatgtgtacttccagagtcccacacagtcaggtatacctccagagtcccacacacagtcatgtacacctccagagtcccacacacagtcatgtatacctccagagtcccacacagtcatgtatacctccagagtcccacacacagtcatgtgtacctccagagtcccacacagtctctcacacacacttgggggctcactggcacactttccctcacacccagggcctctcccaggttaccacagcctctcacttgaatcacagcctggataacgcagtgatctggcttcccttgctctgtatcagggcccatggggccggcctcacgccgccctccctggccctccacaggatgccattgttttggctgtgaagtccctcccgccccagacgcttatcaacctggccgtgtttgggacgttggtgcagccactcttcccagagagccggccttgcagtgatgtgagtgtggtccagggatctgggggccttacagagaggtttcagcccagtgcgtcccagcctgtgccttctcgctccaggatgctgtgcagctgatctgcgagagcattgagaccctgcaggttccgagtgggcccccagacgtgctggctgctctggactgggccgtggggcagccccagcacagggcctaccctcggcagctgttcctgctcactgctgcctcacccatggccgccactacccaccgaaccctggagctcatgaggtggcacagggggacagccaggtatgggatgggcagaaccagatgcgtaagactgagcccccacaaggggctcctgaagatcacagctgcttcctttccttcatcagatgcttctcctttgggctggggcccacctgccaccagctgctccagggtttatctgccctcagcagaggccaggcctacttcctgaggcctgggcagaggctgcagcccatggtgagcttgagcctgggccctgttccctacacctggaagtttttctcccaagttacacatcaagtctgaaacagaactcaggcaggccatgggggctcctggcgccctcaccaggccttctccccactccaatcaggggaagagctgttggtgctgtgaaggccaaaggtgtcaggacactgtctctgaccaccctctgaatcccatttagtcctggaacggagcctcgtcctcacagtcttgccccatccatgtggcaaagctcaggccaggagacagaccaaatcctgagggctgagcactcagccccctgcttgctcctaccctcattccttctcctgaccccagcctggccctgtgccccatcagcttaggggctgggcagatggcatcaggggaagggcagccttcctgctctgtctggccgtatgacacctctttccttcccatgtcttccctgtggccactccccacagctggtacaggctctgcggaaggcactggagcctgctttgagtgacatctctgtggactggtttgtgcccgacactgtggaggcactgctgaccccccgggagatcccagcactctaccctggggaccagctgctcggttactgctcactcttcagggtggatggcttccggtcccgcccaccaggggtaagcttgggctggggtgtggtaggggggctagggtgaggtaggggggcctgggatggctgaagtccccgcatctcttccaaaccctttttccattctctgtgcctctctctaccaagcttctctactatcccctaggactccacagagatcacactgggccccctaagatgaccacaccctgtccccttcatggagtcttccactgagttgtcctgcaaagtgttacccctcagtttttacccaaggtcactaaagcacacagccacagaaaacagcacctgcatttgctatgaggtttccgtcaaggcttgctcatggcttcacatagttccctatagaaagcaccagccagcgtattttctgggacacgcagtgatggatgagcataacctaggcacaatctctaatcccagctctgtcacttaccagccatttgatttgagcaagtcacttcacctcactgacccatttcctcatatggaaatgaggtttttcacaggtggttgtcatcaggggtcataaagtgagtactcctggcagaacacttgacacagtaggagctggggacatggtagttattttttaatgaaaagctttatctctttagaagaactctgcacgcttcctcctttttgatcatgagagctgcataacagacttttttttttgcctggctgccagggagctcagggccaaacttaaagctcagcttcccagcagctctattaacccttacagtgaacatgtctgcttcctccttctttagtactggtcttttgtttctggtttattagctttgttgcctcttgctgtgagccatctaaaaatgtttggaaagaggtagcacataactgcagttaatttttttcccaataatattctctctagggccaagagcctggctggcagagctcgggtgggtccgtgtttccatccccagaagaggccccgtctgctgccagccctggcactgagcccactggcacctcagagccactgggaacaggcactgtctcagcagaactgtccagcccatgggctgccagggactcggagcagagtgagtgcccaggtgtatgtgtgtggctgtattggagtgggcgctgggaggggtcagggctagggcccattctactgcctcccagcaggtactgatgctctgacagacccagtcacggatcctggacccaacccctctgacacagccatatggcgccgcatctttcagtcctcgtacattcgggagcagtatgtgctcacccactgctctgccagccccgagccaggcccaggctccacaggcagcagtgagtccccaggctcacagggccctggctcccccgaaggtagtgctcccttggagcccccttctcagcagggctgccgcagtctggcctggggagaacctgcaggctcccgctcctgtcccctgcctgcacccacaccagctccattcaaggtgagatccaacccacattcattcgccttgtatccagcaaatatttatttaccacctgctgtgcaccagatattatgtagagtttactattaagtctagctagagagaaaggtgggtaaatccccaacgataccatgtaacaaccagtgatgagcacaaggacatgtattaagggggcttaaagtcagggtgactaattctgcctgagagagtcaggaaagtcagagccatatctggaagaataagcacgagttagccatgcagagagggagaagacataaacgaaaatacagagacaagcaacaaccacaagtgggaaatagggagtggagtgggatgatgctgggaaggggccaaggccagaggtcactgtaggccataaggaacttggccttcctcctcaagctggtgagcggccacccagggtttcagaaaaggggcatgggccagctgtgcacccatgtatgatggtcaagggttctgcattccttgaccagtggcccccatatctcacatgcaggtgggggccttgagtactgaggtgctgggccgtcagcacagagcggctctggctggccgaagcctctcatcccctccaggccgggcaaaccaagtccccggccgaccccggaaaccctctttgggtgcaatactagatggcccaagtcctgagccaggccaacagttgggacaaggcctggatgactcaggtaagtgttggatggggagctggtttccctgacaccaaagaggccttggggaggtaaagcccagaggaccactctgcccatgcccctgctgtcttgcctccccaggaaacctgctctccccagcccctatggactgggacatgctgatggaaccacccttcttattcacggctgtgcctcctagtggggagttggcccctccagcagtgcctccccaggctccacgctgccatgtggtgatccggggcctgtgtggggagcagcccatgtgctgggaggtgggtgttgggctggagacactgtggggacctggagatggctcacagcctccctcacctcctgtaagagaagctgcttgggaccaagcactccatcggctgacagcagcctctgtggtccgggacaatgagcagctggccctccgaggaggggcagagaccacagctgaccggggtgagttgctcatgggtccagtcaggacccaaaggcatgggctaaaaacagcaaaggtagaggtctgtgtgtttgatcactctctatacctcgctttgatcacaaaggatttgaggctcatcacagacaagataaaaaattaagcgggacaatgggaaaaagtaaaaataaaaggaaactgagaatgaggttatattaaaggtgcatgctgtgaggttatatactcttgcaaggatcagatccagaactgacaagcttcctagcagccagcacagagggcaacgtgatcctgtcatgattcacagcacccacaacgtaaaaacaaatctttgtcatttaggaaaatacttaaagttcatttcctcagttgcactaaccacagctgaagtactcaatagtcaaatgtgactagtggctaccacattggatcatgaagagagagaacatttccaagttttattagtgcagaagcaggtggaggaaaatgtgccagctaatgcttcctctgggtgttgtccagagtgctgaatttctgggcagccagggggctcttgctctgctatgggttgaagattcagcctgatcacttcttgtcaaagttggggagtctgagctggttctgggcctagcaaggcaatctactctgttaaagtcgatagagggagaagctggggagaacactgcaattttttctatgagccctctgtagagggtgggtggtgggggctccacagactgctccttggttccacaggccatgcccggaggtgctggcttcgagcccttcagacaagtaaggtcagctctgccccctcctgcttcacttgccctgtagctgtggatgctactactagggaggtcctgcctggggccctgcaggtgtgcagctcaggtaggggcctcttctggtgacctctcaggtgcagctctcacctcactggccactctcctggacaaacctgactcctgtcccatgtgcccctgcagagcccgctgagcccccaggaacccctcctgcctctcacagccatctagatgcagctcctctgcccactgttgtctactctaaaggtaacacccaaaggtagggaaagggtaggggcacttgggcttagagaccgccccctggcactgatgatccccactgcaggacttcagagaggctctccagcaggcgcctgggactcggaccaaaatggcaactccaagcgtgctttgggggaccctgccactcccacggaaggtcctcgccgcccacctccccgtcctccctgtcggctcagcatgggccgccgtcacaaactctgtagccctgacccgggccaggccaacaacagtgaaggcagcgaccatgactacctgcccttggtgaggactcgggaggtggagggtggtgccgccggggccgggcgctgtttcagctcgcttctccccccacctcctctctcctcaggtgcggctgcaggaggcaccaggctccttccgcctggacgcgcccttctgcgccgctgtgcgcatctcgcaggagcgcctctgccgtgcctcgccctttgccgtgcaccgcgccagcctcagccccacctcggcctcattgccctgggcacttctgggccctggtgttggccagggtgacagtgccacggcctcctgcagcccgtcccccagctcgggctctgaggggccaggccaggtggacagtgggcggggctcagacaccgaggcctccgagggggcggaagggctgggcggcaccgacctgcggggccggacctgggccactgccgtagcactcgcctggctggagcaccgatgcgccgctgccttcgacgagtgggaactgacagcggccaaggctgattgctggctgcgggcccagcacttgcctgacggccttgacctggccgccctcaaggccgcagcccgagggctcttcctgctactgcgccactgggaccaaaacctgcagctacacctgctgtgctacagcccagcgaacgtgtgaaggctgccccctgctgcttgggctggcgccccacccaacacactcaagtcactgccgcccagggctggcctcttggtgctgggaaagtgtaggctggtgccagcctgtcccccactgcttcttactccctccctagagccctcttgcccccacaaaaagtgcctgcctgtgctctctccctctcctcccaccccactcacactcccctccatcctctgagctccctgcaacacagtggaagggtagagagccacagtccccaaatcctatgcaataaagtgcctcttaggactgcttgagtgaattctttatctgctccatacgtgtccctcacagcctggaccaggcatcggctgcccccacctccatgtaggttgcacagagttggacttagcaaggtttatttggaagggcagagtccaaccaaccccaggtcctgagggtagactcaggtcctgagggaaaggggtggacttcagtgggctttcttgctgtgttgggtgctcttggggaaaggctgcgggcccagccagagctgcagcaggatgacggcatggcatatgtgcagggcagcagagctgcaggatgtggaagggtatgtgttccaggagagctcgatgagccccagcaccaacaacctggagatgagaaacaggttccacgtttcatccagttgcaaggcctgcagacctgcagctcctcatgccctagacataaacccccaacaggaactccctatcccttcccactcccccaggttgtcccagctggtacctgagcaggtgtgtgagccagcgtgcaggcatggcccacaggaggtagggcagtgtgtggaaataccagacgtagaactggtagtggagggagcggctgaagcagatgccaatgaagttggaggtgaagagggtagaaacgatctgtatgcggtggtcaaggccaagggcaggagtgtgtgtgggggggactatcccaaaacagaggggcaatagtttttaggtcacatagccctctggctctgccattccttgatgcatgcctttgggcaagtttattaacctctctggacctgctcctcaaccaaatatggaatatggagagagtaatacctagggccataaggtcttgtgggtttgaacccctaacttactggctgtgtgaccttggtaagttacttaacctcatgaagtcttaatttttccatctgtaaaatgagaatagtaaatgtaagtgtacctccctgtctcggggtctcttgtgagctttcaatattagaacatatgtaaatctcttatgatagtaccagggagaagtactcataagagtagctcgtatttagaattaagaatcaaatatccttcaatatgtgaagtgctcagcacagtggtgcagaataggacttctatgattggggtcccctttcctcgcccaggtcaccagctgtcaagggatacctgaccaggactctgtcagcacctagagagggcaagacttaccttcccacaatttaaaggatatggttgggtgtaaggggctggggtggaaccttccttttggagggatccctcagcagcgacaagatactttcccctgtcctggagaaaagccattcagacagttatcaagccccttttgtgagtcaaactctagactcaccccatgagcttaactgacacttcccccaagcagcccctaaggcttaggcccttcactccttcccccaactctgcccatggcactactgccttttctcacctgtgccacctgcagagggcaaacagcaggagcagggtgaggtgggcagtcaacagggccaggtggaaggctcgatgcaggaagagcgcctctgggaggaagcgccagttcactgtccagtggaacagaaactggcggccaaggtcaaaggagcgggacaggtagccgctggggttctccagcaggaagggcagccccagcaccacctgaggattggtgtgatgtcagcagagctgccaaggctcattcccaatgaccagccttcatgctactcattgaggggtgtgggacggggatgtaggcctcagaggttccccaattcccactagaaatagcaggaaaaccacgttccccaccccccggcccaggccagtgcctggggccaaagaagctcaggaggcaggtcataacaatgctttaaggtgtggattcaccaagtcataactgggcagagcaaggaaggctctcagaagccaggcagggtggctcatgcccaaaatcctagcgctttgggaggccaaggcaggaggattgcttgagcccaggagtttgagaccagcctgggcaacccagcaagagcccatctcaaaacttaaaattaaaaaaagcaaaaaggctctcagagaccatcaaatttaataccctattttacagctatggaaactacagcctagcgatagtggctccctagctcagaatcaactccaaaaccctgtctcttggctttgagggagtctcagggatagagcccctcaatcaagacaagtggcttctccttgattagaaagaggaagggtgagatgggggtacctgaaggccagcacagattcccagcttggggagggccccacggaagccaaactgtgtgaggagaagaaacagtaacccaggggcgaagagcagcacattcatcttcacagagactgccaggctggggtgagcaggggagaggaagggtggagatcagctccagggccatgcacacaacacccaaagacataccccccaccatcaccacagcaacctcccccccgccgccacgccaacaaactccaagatgggacctacactcacaactgttggagggaagagcctggagtaggcaggaggcagatacatagtctctatgcctactagatgcgaatgagcatatactgagtatttagaatgtgaaggactaattccaacaaggaatgctgtctgggaggaagacaggatggaaagagggcatgtgtgtatgttgggggatggcagggcagaaactttctatagatcctggactcgctttgtggagccctgagtgacccatgctgtcttggctactcctttactccctctgctgcaggaaattgggaagagatggaaatgcagaaaacgagaggggaccagaaaggaagaggtgttgacctgaaaaagcagcaaccccagccccagcgctgggccagcaggaggttgatactgaggaagagcagcaccatggccactgggtcattgaagagccgcagcacaaagatggagtggacacggtaagaggcgcagcacatgaagaaaaagacgaagggaggtacctaaagggaaaacacagtaaggtacaaggtcagctcagcaagcctgagccatccccaccacccagccctcccaggctggggccctctagccctggtagcatggactcaccttgcaggtctggtgatagatcaagaagacaagcagcaaggtagccaggtagagcacagcaaagatgttctgggccatgcggatgtcagtgcctcggctggtggcatagtacaaccccataaagatgtacacgaaaccagctgggtacctggaagatgagagaaaatgtgagcctgggtcaggtcacacagactagtacctaaccagcccctcacatcctccctgaacttcctgtccccactcacacaagtggtccggtgtcaccctgcagttgggtatagtcataggtaccattgatgacgccttctacctcggccatgtaggccttccagtcaatctctgtgtctggaagaagacaagatgatctggttacttctgagtctagaacttgtctgccaccctccccatgcctccagaccatcaaaacacagactttcagccaattcccagggctttactacctcttaatctaactctttatctgacattctctgggtgagcccaggcatctcaaactcaacatttctataagtgaatttgtgatctttcttcccattccaatctactccttttcctgggttccgcaaatggcaccaccgacctcttagctaccaggtcacgaacctgagtaacatctttgatactccctcctctctcatttgcaacccttcgtcaacaagttctgcctgttcctcaccgtaaatatctctatctcatccttctctgctactacatactcaaatttgagcctaaagtaatctctagccccaatgagtatacaatagcctgctaattaggctcctgacttctactttcaccctgctacaatatattttccacctcgtacaccaaagagctcctcctaaaatacaaatcataacaggcctctgcttaaaacctctcaatgattccccaagacccttaagataaagaaaactctgtattattcccattttttgaaggggagcctaagaattaattaggttaagtgactggcttaagataattgagctaggatggtggagttgggattgaagcttgcagggtcccaagttcttaattatcatgctatcttcttaacaaagctttcaaattccttcatgatctggcctcagtttctgcattcccatctcttactactcccttcacttgatttctacactctagctctaaaaaaatcatttcagttcctcaaaggaaccaggctgtcttcttttttttttttttttgacagagtctcactctgtcacccagactggagtgcagtggtacgatctcagctcactgcaacctccgcctcccgggttcaagtgattctcctgcctcagtctcccgagtagctgggactacaggtgtgtgccaccatgcttggctaattttttaagttttgtatttttagtagagatggggtttcaccgtgttggccaggctggtttgtttgtttgtttttcttttgagacagggtctcgctcagccacccaggctggagtgcagtggtgcgatctcagctcactgcaaccaccatctccccggttcgagccattttcccatctcagcctcccaagtagctgggattacaggcacttgccatcatgcccagctaatttttctattttagtagagacagggtgtcaacatattggccaggctggtgttgaactcctgacctcaggtgatctgcccgcctcgggctcccaaagtgctagaattacaggcataagccaccgtgcccagccaggctggtctttaactcctgcccccaagtgatccgcccacctcagcctcccaaagtgctgggattacaggcatgagccaccgtgcccagtctaactgaattttttttttttttgacacggagcttgctctgtcacccaggctggagtacagtggcgcaatctcggctcactgcaacctccacctcccgggttcaagcaattctcctgtctcaacctcccgagtagctgggattacaggcatatgccaccacgcccagctaatttttgtatttttagtagagacaggatttcatcatgttggccaggctggtctcaaattcctgacctcaggagatccacccgcctaggcctaccaaagtgctgggattacaggcgtgtgccgctgcgcccagcctagctggagatttttaatagaggatcctctgtccacagcactccttcccctcacctttttcttctttccttaaatagctaattcctaccttccaagggtggctctatgaagcctttgctgactcctccaacctggtttaagtgacttcctatgccctttatggtatcctgtgttactactaccatgattatgatgcattataattgcctgctaacttactgtccaggcccgagttagaaatgcatcctttttctttttttttttttgagacggagtcttgctctgtcgcccaggctggagtgcagtggcgtgatctcggctcactgaaagctctgcctcccgggttcacgccattctcctgcctcagcctcccgagtagctgggactacaggcgcccgccaccatgcccggctaaattcttttttttttttttttttcagtagagacggggtttcaccgtgttagccaggatggcctcgatctcctgacctcgtgatccgcccgcctcggcctcccaaagtgctgggattacaggcgtgagccaccgcgcccggcagaaatgcatctcttattcaccactgtacctctctctggtaaccagcataatgctaggcatataataagcactaaataaatatttgttgaattaagagtctttagcaagaaagccaagtgccttaagcctagagtatagtttcagcctggaaaggagtagccaataatgcctaatggactcaagtggtcacaagatgccatcattgagaagggacgttcaaagatcacagaactgaacacatggaaaaagctgagatccaggaggagacctgaggtgtccaaagccacagagaaaagcagcagcagcagcagtacaacaattttggctcaaatctgacttctaagctggtttgcaggctgtaagttcagtgcagaaggccaatctctagggtatccacctctgccatgcgggcagattaagatccggttttctgtagagcaggcttggcgctcaggtaagggatatggatgggttcgcaattgacgagtgagtggatacagagtctggtttggagttccaggtctgagatccagtttgggtcgcgggttcaggtctccctccctcccctcccctccccctcggcgcactcacatgccaccctgtgaatgacccagaaggtgatgcccacctccgccaggcagaggcaggcggccaccagcagcgtgtagcgcggctcccgcagcagcaggcgccgctcttgccaggcgcgctgcagccattgcttgcagagtccctctgcctgggccgcggaaccggaccggccgcgtttccgcagcccagccgccatcttaacggtgcgccgcttgtgtgggcccaccacccccggaaacccgaaccttcgacacttaggttccgcttcccgtgcctggcgtcccaccaggctaagcgccgatccgagtagccagtcttcatttactccactaaaatgtaatttttctgcatttgtctcctctgatgcactccacgctccataggagcagggacaatgtcttactcctcagtttatacccagccctgggtacacaggcgctaatttagaacgaatgtccagaaaagcaacattcctgcctacctcccccacaaccgctgaagccagcattctccttcgcctgcgctgggaacatctgtgttcatgctgtctctccaggagggcaaagcccctgttcgcgcccctcctgcctgcccttcgagccttccggatgctgagaaaaatgaacctttcactaattttcagatttcctgataaaagtcattcatattgaaaatatgagaggacgcagtgatgagcccacgtgagtctgacaccttgagtgcggccctaggaaatgacttggcagtacagccggaggattcagggtctggacgatagttttcccagccggaggattcttcgaagagcgcttagtaaaggacggaagttccacgtgtttgtgttgagcaactgcaggtggtgggcggagacaccagcgccccgccttctgcatcctgccttccgtattggctgaagggccggcggctctggctgcccggcggttgagagcatggcctctccaggggcaggtagggcgcctccggagttaccggagcggaactgcgggtaccgcgaagtcgagtactgggatcagcgctaccaaggcgcagccgattctgccccctacgattggttcggggacttctcctccttccgtgccctcctagagccggagctgcggcccgaggaccgtatccttgtgctaggtgggtaatcccggcgcggccccgccaggtagagctggcaggaccggcgccgcatgggcttggcctggtccgctttcctcccgcctgtctatccctcttggaggacgcctgcgttgggacgcgagatccagctccttcagagtcccggctgtatttagtcaaggctaacaggagtaagagattgttggtcccggggccctctggagaaagacagtccctcagagtttgagcgttgggggtacccaagaccctgtccggaccctcgggaggcaggcagccttggggaccggattgctcagaggaccgagatcaagtcctagcgctaattgacttgtaaaacttaggacaagtcatgaacccgttctgagctttagattcagttctagaaatggtactgcgagttcacatcggaggcggcacgcgcaggcacctcgagaataatgcccagcgcttttctttttgcccctgggcactgggagccagagtcacctagagagagtcctgtctgaaacttggtcctatgccttagagagtgagaacagcaccctctaggggtggaggggagattgccgcccagggtgatacgattccccaaagggagacgtgctggaggaaaggtagggctctggggtgttcggctgacctcttgaggttctctcctagtgtcagccttggaggcgctagtaaagtttgaatgagcaacagattttcttccaattgtcgtttttactttgctctttgtaaaagcctttgtatgtttaagtgaagtctttaataaataaaaaaggtatatgtaatatatatgtaaggtataaataacaaatctaatgtgtgtgtctattccactcagtttgagaaatagaacattactagggatagaaaaaaaagtataatttagtggttaataacttggctgggcgcggtggctcacgccattaatcccagcactttgggaggccaaggcgggcggatcacctgaggtcgggagttcgagatcagcctgaccaacatggagaaaccccatctctactaaaaatacaaaaaattagtcgggtgtggtggcgcatgcctataatcccaactacttgggaggctgaggcaggaaaatcgcttgaaccagggaggcggaggttgtggtgagccaagatcatgccattgcactccagcctgtgcaagaagagcaaaactctgtctcaaaaaaaaaaaaaaaaaaagaaaagaacttggactctgggctggcctcatgattcatgctcataatcccagcactttgggaggccaaggtggaaggatcacttgatcgcaggagctcaagaccagcctgggcaacatagtgagatcccatctctacaaaaaatttaggccagagcagtggcttatgcttgtaatcacaacactttgggagaccaaggcgggtggatcatttgaggtcaggagttcaagacaagcctggccaacatggtgaaaccccgtctctactaaaaatacaaaaatcagccaggtgtggtggcacgtgcctgtaatcccaggtacttgggaggctgaggcaggagaatcacttgagcccaggaggtggaggttgcagtgagctgagattgcaccactccactccagcctgggtgacagagtaagaccctgtctcaaaaaaaaaaaaaattaaaacttagctgggcatggtggcctgtgcccatagtccgagttactcaagaggctgaggcaggaggatcgtttgagccaggagatccaggctgcagtgagctgtgatggctccaatgggctccagcctaggcgacagaatgagaccctgtctcaaaacaaagcaaaacaaaaaacaaacaaacaaaaaaccaccttggactccagaggcagtgaattatgttggaatcttggctcggcttatactggctgtgtaatcctggacaaaatacttgaatttctgtgcttccattttctcaaccttaaaaacataagcatatttattaattgggctttaagttgattaaatgagcatgaaggatacctagaacaatgcctggcaaaatgaaaagtatattcaaggttctctgtgtggtcctcctaaaaccccttctccccacaagtaaacactttcttgaatctgtgattttaaaccattgcacttatttatagatttaccttagatctgttttctcaagctttagtgtgtatcaaaattacctggggaactagactgcactgtgagattctaattccagggatggtctaatgtgggtctcaggaatctgtatgttcaacaagcttcacagcagattcttatgctggtgattggcagagtaacactgccttaaaatctgcttgactggtttttcaccaaactgatgctttaaaaaaaatctgcttaactgggaactatccttttctggataggaggggcaagaagtctaaaaatcaaaaggggaatttctagaatccccaagatgtaagaacaggacccacaacttgggaaatactctacgttacattccacctcaacagacttaagttgagtgcctgataagagccagagaatgtgctgggccctttctaacttacttaatccttatgacaacccctgaagacaagtcaaaagtactaagagacttactccaggttaggggtctgtaaactttgtttgaaaatggccaaacaagtaaattttttaggctttgcaggctacacagtctcttttacaatgacttggttccgctattgtagtggaaaagcagctacagacaatacaaaagtgaatgatggccgggcagggtggctcacgcctgtaatcccaccactttgggaggccgaggcgggcgggtcacctgaggtcaggagttcgagagcagcctggccagcatggtgaaaccccgtctctactaaaaacataaaaatcagccaggtgtggtggcaggcacctgtaatcccagctactccagaggctgaggcaagagaattaattgcttgaaccagggaggcggaggttgcagtgagccaagatttcaccactgcactccagcctgggtgacagggtgaaactccatctcaaaaaaaaaaaaaaaaaaaaaaaaagtgaatgagaatagccatgtttcaatataactttatctaacaaaataggtggcaagctgcatttggcaacccctgcactcattgtcttagattgagttccccagaagcaaatcctgagatgaggattcatgtccaagttacttgtcaagaatgtgctcccaggagaattggtaagagctagagggaacagagaaagggaagaagcaaagtttccctgaaggtagtttcagcctgaagagtcacagatgtacaccattagaagcaaacacacaccaaaacccagggatataaaaataaaaatcggtaaaaagactcccagggcatctggtcagaacactgacagtgtccactactgtcatgcagcaaggaagtggtaaagtaagggtgctttgtgacaccacacagatgggagtagggaggcatctggaactcttaaaactggtaaaatgactacattgtgaattatagcctaatggtcatatggatatagctaacaatggaatgtcacgactgaaggtgagtgggcctcttgaaaactgggaggcagttgaacacagtggtttaagagctctggctctggagcgatagaggcctgggtccaaattctggctcttccactgactatgtgaccttgagaaagtttcttaccactttcctcaattttcccatgtagaaaatgggaatagtaataatagtgtcttttttttttttttttttacatggaatctcgttctgttgtccaggctggagtgcagtggtgcaatctcagctcactgcaaactccacctcctgggttcaagcgattctcctgcctcagccttccgagtagctgggattacaggcgcccaccaccacacctggctaatttttgtatttttagtagagacggggtttcaccatgttggccaggctggtctccaattcctgacctcaagtgatctgcccgcctcggcctcccgaagtgctgggattacagacatgagccactgtgcccagccaatagtatcctttatatggctctaacatgaaagtaaactgaaataattcttataaatgcttaacatagtacttggtgttcaatgactgttagctattattatttttattgaaaatgggaatcagagaggcagtttatccaggactgttcagagaacagagtaccctgttggaagactcgtgtgtctggtccctatggctgagacatcctcatagcaaatgaatgtatatggatggctggccccactttgctgttattgagcttctccaatttgttatgcttgcttgacttcatgctctgtaggaatcttcttgtttttttagagacagggtattgctctgtccccaggctggagtgcagtggtgtgatcttggcccactgcagcctcttgaactcctatgcttaagcgattctttggaatcttttgatcataatcaaaaattaatttggaagcagccgggtgcggtggctcatgcctgtaatcccagcacttcgagaggcggaggcgggcagatcacaaggtcaggagatcgagaccatcctggctaacacggtgaaaccccgtctctactaaaaaaaaaaaaaaaaaaagaaattagccgggcgtggtggcgggcgcctgtagtcccagctactcgggaggctgaggcaggagaatggcgtgaacctgggaggcggagcttgcaatgagcggagatcaagactccgtctcaaaaaaaaaaaaacttaatttggaatcaatttgacttccaatttagatttcctataaagagaaaagggactggccagaggattcaactcctgttcccatgatggctatttttcttgttataaattagtaaattggcattctggcttatatttcaatctcttggtgttgagttaggatccactcagctctaggccctcatgtgatgtattcttggatatggatcaattctccaaggctctacttccctcaggctccactttggaaggcagtggctttcccaagccccttcttagttgctggccccaaatctctgagtcaacagaatcaaaagtcactgcttgtaaaaatgactgccccagtgaccagcttttgtttccccttcacctttggtaaagttatcttggaagatgccatcctgtactaaggagaacaaaggaaggaaatctggatttgtccacagtttggcagagctctacaggtatatgaggtcaggtgtgggggtaatgaagggattgtgggtcagcaaacccagtgggatttcaacctggaactaagtcaggttctgccacccttacccccatcccatgtgctgtatctatcatggctttttgtggcttcaactttgggtagcacatgttgggttttcctaggcaagatagttttccttgagccccagggcttgaagaggaacatgggaaggggcagctggggagcaagcagccagctgcctctgggtacattgtccaggtgccaaaccctgatagattagggctatcccaactgctgatcccatgatcctcttagggaggcaagtggggattaaaggaaatctaatcccaagagctgaagatccccagtggggctatcaagagctgtcacccagctccattgtcaagctgggactggccataggagggcctggaagaggccactggatcttctaaggaagtcatgcccattggactatagatccacatccactcctctcacctctatcccttctccatcctgaccctaccccctttgggactgctttccaggcacttcctaccagagtgttgggaagttgtcaagactctgttcttcaagactttgcttggttgtcagctccccggaaactcttggctgactcacctgaggtgaggtccagaccttcctgtgtgctctcacagcctgtctctattgaaacactcatcatgttttgcagcaactgtctgatgacacatttgttcctactggagcatgagctccttgagggcagggacttttattcatgggcagagcctaatatgtagtgctcaatacatacgttaagaattgcggccaggtgtggtggctcatgcctataattccagcactttgggaggccaaggcaggtggatcacctgaggtcaggaccagcctgaccaacatgatgaaaccccgtctctattaaaatacaaaattagctgggcatggtggtgcgtgcctgtagtcccagctacttgaggttgaggcaggagaattgtttgaacccagcaggcagaggttgcagtgagccgagatcgtgcctctgcactccagcctgggcaacaagagtgaaactccatctcaaaaaaaaaaaaaaaaaagaaaagaaaagaaaaaaagaattgcaaggaattagtcagctccactgtgtgtccccacctagtttccccttcacttgttaattctgttttggaaaacaaagtagaataacccctaacatgaggccttcccagggttgatatcttctaaggttttctaagaggttggggattaggataatactaatttatatcattattatgctactgataatattatggtcctaatgataccagtattatccccattttgaatttgaggaaactgaggctcaaagagttgaatgatttgccgtggctgtgtgactaggaatatcagacccaaatctctgaactcctaactttagagctccttcagctactctacagttcttaattctttttttttttttctttttttgagacggagtttcgctcttgtcacccaggctagagtgcaatggcacaatcttggctcaccgcaatctccgcctcccgggttcaagcaattctcctgcctcagcctcccaagtagctgggattacaggcatgtgccaccacgcctggctaattttgtatttttagtagagatggggtttctccatgttggtcaggctggtcttgaactcctgacctcaggtgacccgccctcctcggcctcccaaagtgctgggattacaggcgtgaaccaccgtgcctggcccctagctcttagttcttaagtttaatgcatcatatcctgtatatggcctacgtattattatcttcatttttctgaataggaaatccaagttttagccaggcgtggtggcacgcgcctgtaatcccagctcctcagaaggctgaggcaggagaatcacttaaagccgggaggcggaggttgcagtgagccgagattacaccactgtactccagcctgggcgaccgagtgagaattcatctcaaaaaaaaaaaaaaaaaaaaatccatgtttctagtatttaaacaacttgtcccagcccacacagctaggagtgatagagccagggtttgcacccaggcctgtgcgattccaaggcttgtgctttttctgcactctgccacctcctctcagtactagagggtttggattgagagaaaacggggccaagagtggatggatattcagggggaggtgagaaccaaaactaacgtagctcttttgctacccattccctcccaccccaggttgcgggaacagtgccctgagctacgagctgttcctcggaggcttccctaatgtgaccagtgtggactactcatcagtcgtggtggctgccatgcaggctcgccatgcccatgtgccgcagctgcgctgggagaccatggatgtgcggaagctggacttccccagtgcttcttttgatgtggtgctcgagaagggcacgctggatgccctgctggctggggaacgagatccctggaccgtgtcctctgaaggtgtccacactgtggaccaggtgttgagtgaggtgagggagcaacaagagaggaaagcagatcaataggtggggctgcggggttgaggtttcaggggactggaagaaatcagaagccagaagcatgttttggagcaagtagtgggtcgccctcaggagtgtggctctctgaagggagggaagggttaagcggggtcgagatttatagaggcggctggagtagtcaggctcacaaaggctgacatgtggttactgggttgccatagggatgaggtagcagccaggttcctgacaggtgacagagactgccaaggtgagcagttataggaaagtggtgcccctatacctgatatcactcctatacccttccctgaatagaatatagccctaatcccaaggaatggccaggggcagagaaagtggctcactctttgccatggaaagcctgagctacagatgtggggtggttcctgaggtttgactgggagagcatctggagcagtactgacctttgagaacctgaagatccacttctcaccaatggcttctctgtctgccttgcaggtgagccgcgtgcttgtccctggaggccggtttatctcaatgacttctgctgccccccactttcggaccagacactatgcccaagcctattatggctggtccctgaggcatgctacctatggcagcggtttccacttccatctctacctcatgcacaagggcgggaagctcagtgtggcccagctggctctgggggcccaaatcctctcaccccccagacctcccacctcaccttgcttccttcaggactcagatcatgaggacttccttagtgccattcagctctgaggccagagcatggtcctccacccttcctgccattctgccctgggctcctcaggtagttggaattcctgacttaggacttggggttgggtccaaggtgcttacatcccaggggcctcatgcctaagatagagggtgggagcgaacccacatgaaccaatacagcccagctccaactagatccagattccaggtttcttgcttctttcttgggttcctcagttctctcctgggttccccaacctcctctgccaccacaccaaaccaccagtgatgcatcccctggggcaaagctcatcataacccctctgcacaccagccagcctggagaccgttgttcctggggcctgttactgatcctcatctagccttgatttatccacaggagactgcaggctttgaacctagattgctttatgtttctcaccctagctccatccccaacactggtgaccagtcacgcctgggttgtatctctacccaaggaggccacatcataatgaggttcccaggccagcctggcctgtctgtcttacttggcaaccgtccctcaccagcaacatgcacctgagattcccaagtacctgccccccctcccattttggcctggctcctgagacctaagcagcggccacacacacacagagggggtctgtgtttattcacacactcctggtacagtgaggatggaggaacatttacgaagggcacccctgggttgagaacatctccggggccacagatgtcatccaaaggttcagagcagtccccatttgggttcccaggggcaagacgcaggggtccaaggtaaaatcggatctgggcccttggaaggtgatgataccttggggagaaggggtctgccagaaagcctcctggggtcaggcctgggcagactggccatgtggttggtaaccgtgtcgggggcttgtctcatcccagcctcaacacccatcctatctgccaggcgcagaagagcgtggccgagactgaggggagggcaggaaccatgagcagagccagtaaacaaagagtcggatataaaaatacaaatgtgctgaggaagtcccttagaaagaggctgaggctggggtcacgccagacaggggtgggggcgaggaacggcccggaggactgggctcaagtgggtggaaagctcatgcaagtacgcagccaaacatccctggccgcgcgcggtccgacaccggcggccgcccggtctgcagaccagactggccggaggggggcggggcaggggagccgtgcgggagggggcgggccgggggctgggggccgcgggtctccgtgtccgttccggtgtgcggggtggggctgcggcccgaggttttaaagtgcatgagcgcggcggcgggttccgggcgggtccgcgccgccgctaccgcggccgccgtggtgctgaagcggacagctccggagtgcctggcggcggcggcggcacggccctgcagcccccgcccgcgggcgcctgggccggggcgggggggcgccggcagccgcatcgccggcccgcgctcctggccgctgcgaggctgggcccggagcccgccgcccgagccggcgcgtctacactccggacggcggcttctcccccatccccttcagcacgtcgtctatccggtcatcctcgatcaccactgcgcagggagaaagcgcgtcagccgcgcggcctcggggggcggcggcgatgagaatgagccccgcgtcctagcttcccgcgcagctactgcccgtggcccagcgacgcccctcggaaccctgtgccgcggtgtcctccccgtccgaactcttctggagacccaacccgccgccaagcctagaccccctcccctcccgatggcggaacgcccctcttccaaaggctccagctattctccctcccagtgcgagccctcctgccacctgagccttcctccctctgagttgatcagaaacctcttgctcacggaatccccctcttcaacccgcacttcaacagatccccctgctcaaatggggctcaaaccgagtatccagctggtccagccctctcctcaacctgagccctctcgccgctggaacccctcttccgatcctggcaccaacagagctcccctccccatgcaaacaaccaagacaagcggacccccggcctcctgccctctcttgttagacgtccctctcgacccgaaggttcttcgtattgtccaccgactcagtatttgatcccaaagaatcagcccgttaccccgtgctcccacttccgtgcagccccaaatgccccgaccggcccctccccctcgcccgggtgccagggctctgcttccagaggtggcgagcatcgaatccggggcaccgtgttcccgggagaagggaagagggggacacacactgcagcggggacccccccctccagcccgggctggagagcggctggtgcgctggtctgcggcaagagctgcgggcactcggcggggaacggcagccggggggcgcccggcggagggtttctgggtcaggcggcgactccgggcccgggccgcgtacctcgcttggctcggccgatctggcccagcttggggggtcgcttggcctggttgcccgcgaagaaggagttggtgtcctgcaggcggcagctgaaggagaggtcggagccctcggggtctgcgccgaagcggcccatcttgtcttcgctgtagggcaggatctcggacatggcgggcgcggggtgggcgcggggcgggagcgggactgcggcggggcgcgggcggcgggcttgctgccggaccggccctacctcagcaggggagccggcggaaggatgaagtcatgcagcatccggggctgaggagccaagcggggcctcctcccccgcgcctccgcctcccgggccgctgggcaggcggcggcggcggcggtggcggggaccgggcgggggcgggggcggggggcgggggtggcggcggcggcggcaagagcggaatgacgatgagcgcccgactgcggcagagcacggcgggcggggcgcggtggaggcggggcgggcactggccaggggaaagaggcggggccgggggcaggagcgcgcccagctaccccgggaacagaggcagctggagtgggaggttcccgcactgtggcggggaatggccagcacgtgggtcttggggaatagtaccagccaacccggccgggacctcgcggggaggggcgggaccgaaggggggtgggatcgagcctggtactggaggagcttggaggagggtctgacccctaggctgggagaggcgtgcaagggggactgggagcaggagggcaaaagctggccgggcgcgttggggcgggaaggcggccgcagggctggcaatggaaagcggggagcgggaaatgcgcggggaggagactcgggtacagggtgactggggaaggcacgaacccacagcgcgggaagagctcgggccagtgggatggtgcccttgccgctgacgcgctcttgtactagttgctctgctggtcttaagtagatcgtcagggtccgtgcgcctctgagtgccggtctgtgtctctgtctccgcctttgtgtgtgtcagtccatctctaagtgtctgtatctctctgtctctgtgccccgtatctctttcgctgtgttatggcctttgtctatgcctgtcccttaagtgtctgcctttctctatctatctccattcttgactcctgtatctctgtgccagtgtctccgtctcctgaatctgggtatttcagtctctcctaggaggggtctatagaaactgggccgacgcgcgcgcaccagggcagacacccccagccctagtccggtggctgtagccccccgcggctctggagtggtgcgctcgcagtgtaggaggaatgaatggcggcgtcgcggggggcgccctgggctgcgggtgacgcggggaagctcggagcacctgaggacgcggagcgcgccagtgtgtgccccgagggagtgcggtagagatggagggtgccccccgccctcgttgctttggaccacgggtgagttctcgcctcaccgatgggaacatgccctcttctccccttgcctcccgcccccacaacccccgccctggctggccgtcacccgcggcgtcacctgcttgccagcgcgcaggagctctggcgcaatcactggccttggggaggagggggtgtctcacatgcggcgacagtgacggcagcgctgaaaacggtaatgatcaccctgtacgttcattccacactccaggcgaacgcgctttccttccttaatctggccaaattaccaaatcacacagctggtgaggctgccttgtagtgggtctccttccaacactttctcgccaggtgttaataccggagacacagggacaaacgcaatggtggctgcccagggaactggatggggggggcggtatgccacaggataccttgatgccagcctcactcaagggcccaggcctgggggcccatcactatgaagccctcctctgctctgtcctagtctccgggatgagggccacagctggaggtggaggcccagcctggagtgagaggagccctgaaactggaaggacaataaaggcggaagactggggtcactggaagagagtccagaaaattccacatacactggaagttgtccagtaatgggttccaatcctgactcccactttctcagtgaccttgaactgaaggacccataatcatggttttaaaaaattaattcgtttgtacttaaaacattttaggaggccgggctcagtggctcacgcctgcaataccagcactttgggaggccgaggtgggtggatcacctgaggtcaggagtttgagaccagcctgatcaacatggcaaaaccctgtctctactaaaaatacaaaaaaaattagccaggtgtggcacacacctgcagtcccagctacttgggaggctgaggcacaagaaccgcttgacctagggtggcaaaggtggcagttggcggacattgggccattgcactccagcctgggtgacaaagcgaggcgagactccgtctcaataaaagaaagagagagagagagagagagagagagagagagagagagagagagagagaaaggaaggaaggaaggaaaaaaattttaggaaaattaagaaaatcacataacatctttttttttttttttttttttgacacggagtcttgctccgttgcccaggctggagtgcaatggcgcgatcttggctcaccataacctctacctcccaggttcaagcgattctcctgcctcagcctcccgagtagctgggactacaggcacacgccaccatgcccagcttttttttttttttttttttttttttttttttgagatggagtctcactctgtcgccaggctggagtgcaatggcgccatctcagctcactgcaacctccccctcctgtgttcaagtgattctcatgcctcagcctcctgggtagctgggactacaagtgtgtgccaccactcccagctaatttttgtatttttagtagagacagggtttcaccatgttggccaggatggtctcaatctcttgacctcgtgatccgcccactcggcctcccaaagtattgagattacaggtgtgagccactgcgccctgccagtctttgtattttttgtagagatgaggtttcactatgttggccaggctggtcttgaactcctgacctcgcgatccgcccgccttggcctcccaaagtgctgggattataggcatgagctaccacacccggccttataactatatatatatatatatatccttctagtcttttcaccatgtgtctgcatgatatgatacctctgtaagccccatgttctagtctgaagcatggggatgataaaacctacttattaaggaacgttttgctgggcaacattcatggctcacacctatgaattccgccactcagaaggctgaagcagaaggatcgcttgaagccaggagttggagaccaggctggacaacataactaggccccatctctaaataaataagtaaataaataagcaagccgggtatggtggtacacacctgtggtcccagctacttgcaaggctgtggtagaaggatcacctgggcacaggagtttgaggctgcagtgagccataatggtgccactgcactctggcctgggtgacagagcaagaccctgactcaaaaaagaaagaaaaggacagttttgtagatgaaactgtcctggggtaaagtgggttgtctcgggaggtagtgagctgcccctcacctaaaatgccaaagaagaggcatgagggttcttgccaaggatgagataagagtattgtgtgaggaattgaaacaattctcctttctctctgcacaatgagggagattggaaaaatgacagtttaatccagaattcacttggttacctccttcttaaataattatattcccgtcccggccgtgcctgctggatcatggttaaagcaaaagtcctaagtacaaacctgtggactattatgatatataagcttcagctatgttgtaaaaatgtggggatttctttaaattctgctcctctctttaaaattctgatattctgcttccttcccatgagaggaaaatacattttcactaaaatgaaataaagcttgtatagagttgcgtgacagtgcattgagtctctcaattggaagtccctcaaacctagtatacttgtccacgtgctctacacagataacatgccttttgacaattgagtattagtgacacttttagtcaagtggaaactgtagacccctgtagtggattgaatagggactcccacaacaattcaatgttcacctgtaacctcaaagtgtgacccagggccaggtgcagtggctcatgcctgtaatcccagcactttgggaggccaaggcgggaggatgacttgagcctaggagttcaaaaccagcctgggcaatatagtgagacgccatctctactaaaaaaaaaaaaattagttaggcatggtggtgcatgcctgtagtcccagctacttgggaggctgaggtaggaggataacttgagcacagaagctagttgacagtgagctatgactgtaccgcactgcactgtagcctgggtggcagagcaagaccctgtctaaaaaaaaaaaaagtgtgaccttatttggaaatagggcttttgcagatacaattagttaagataaggtacagtcaggctaggtggctaatgcctgtaatcccagcactttgggaggcccaggcgggtggatcacctgaggtcaggagttcaagaccagcctggccaagatggagaaaccccatctctactaaaaatagcccagattgtgccactgcactccagcctctgtgacagagtgagatcctgtctcaaaaaataaaataaaataaaataaaaaaatataggccgggtgtggtggctcatgcctgtaatcctagcactttgggaggccaaggcaggaagatcccatgagcccaggagttgaagaccagcctgggcaacatagggagaccctgtcttatatagaaagaaaaaaataaaaaataaattaagatggggttatactggattatggtgggccctaaatcccatcaccaatgtgtttataagaagagaacagacacacagggaaaaaggccacatgaaagacgcagagataggagtgagggaactacaaggtaaggaaaaccaagaattgttgggagccaccagcagctgaaagaggcaaggaagaattctttactagagtcttccaaaggagcttaaccctaccaacaccttgattttggacttctggcctccaaaactgtgagagaataagtttctgttgttttaagccctcagtttgtggtaccttgttacagcggccctaagaaacaaatacaagctgttagaaatattttggggtaagctgggtgtggtggctcacacttgtaatcccagcactctgggaggctgaggcgggtggatcacctgaggtcaggagttcaagaccagcctggccaacatggcaaaaccccatctctactaaaagtacaaaaattagctgggcatggtggtgggcgcctgtaatcctagctactggggaggctgaggcaggaggattgcttgaacccgggaggcagaggtagcagtgagccaagattggccactgcactccagcctgggtggcaaaacaagactccatctcaaaaaatataggccgggtgtggtggcttacacctgtaatcccagcactttgggaggccgaggcgggcggatcatgaggtcaggagattgagaccatcctggctaacacggtgaaatcccgtctccactaaaaatacaaaaaattagccgggcgtggtggcgggcgcctgtagtcccagctacttgggaggctgaggcaggagaatggtgtgaacttgggaggcagagcttgcagtgagctgagattgcgccactgcactccagcctgggtgacagagtgagattccatctcaaaaaaaaaaaaaaaaatacatatgtatatattttttgggggggtagtatttttactatcatatctcatgatcatgtttctccttccttagactttctctgggccttttgatcctaccctatccacctgatggaagcccacaccatgagggtatttctagggcccattctatttaaaagaaactgataaattactgtatcagtctgttttcacactgctgataaatacatacctgagactggataatctatacaggaaaaagagtttaatggacttacagttccacatgactggggaggcctcacaatcatggcagagggcaaggaggagcaagtcatgtcttacacggatggcagcaggcaaagtgagagagcttgtgcagggaaattttctcttatagaaccatcagatctcatgagacccacccactatcacaagaacagcacaggaaagacctgcccccatgattcaatcacctcccaccaggtccctcccacaacacatgggaagtcaagatgagatttgggtggggacacagccaaactatatcaattacaaaaaaaagaatgagaaagatctatgtgaacagacatggtaaaatcctcaagacctgccaaaatgtcatcaaataacaagtttagagtagaattttacatatgtgggaaaagtacacatacacacatatgtatacacacttacattcacatatatacatacagtatatgtaggaacataaatgcacataaaagaaagatctgggcaggctcagtagctcacacctttaatcccagcactttgggaggctgaggcaggtagattgcttgggctcaggagtttgagaccagcctgggcaacatggcaaaaccccatctttattaaaaatacaaaaattagccaagcatggtggtgagcacatatattttcagatgctcaggaggcaggaggattgcttaagcccaggaggtagacgttgcagtgagctgagattgtgccactgcactctagcctgggtgacagagtgagaacatgtctcaaaaaaaaaaagaaagaaagaaagaaagaaagatttggaaagatacataccaaaacgcaaatgatagttatctctgaggatggtaccaggatcccaacagaatgaatttcatcttttattcaatataattctggagtatattacatttgcaataaaaacgtttaaatatattttacattttattatttaattttctttattattattattatttttgagacaacgtctcagttccatcacccaagttggagtgcagtagcatgatcttggttcaccacagcctcaacttccatggcttaggtgatcctctaccacatctggctaatctttgtgtatttttagtagagacggggtttcaccatgttgccgaggctggtcctaaactcctgggctcaagcaaacctccagtcttggcctcccaaaatgctaggattacaggcatgagccactgagaccagccttaatatatattttttaagggcttaaaaccagtgatatagcacatttatcaaacattatactctagccccagacaaattagttgcctttgaaaggaaaatagtgggctgggtgcagtggctcacacctgtaatcccagcactttggaaggctgaggctggtggatcacctgaggtcaggagttcaagaccagcctggccaacatggtgaaaccccatctctactaaaaatacaaaaattatccaggtgtggtggtgggcacttgtaatcccagctattctggaggctgaggcagaagaatcgcttgagcccaagaggcagaggttgtagtaagccaagattgtgccattgcactccagcctgggtgacaagagtgaaactccatctcaaaaaaaaaaggaaaatagtgtagcagttaagaacatgaagcttagattcaaatccaggctctgccctctacctgcttgtaactttggacaagttattaagcttctctgtgtcttaggttcctcatctctaaaatatggacaatgatattggtagaacccatcttataggctatcgcaaggattaaataagttaacatatatataaactgcttaggtaaatgttggactatagaaatgttattattatacagaaaaacataaagaaaaaataatgccatcactagatatatttataattaatattttgttgtatgtactcctaatcttttttgctttttttgtttggttggtttgtttttcttgttttcttttttttttttaaggcagagtctcgctctgtcgcccaggctggagtacagtggcgtgatcttggctcactgcaacctctgccttccgggttcacgccattctcctgcctcagcctcccgagtagctaggattacaggtgcctggctaattttttgtatttttagtagagacggggtttcactatgtgggccaggctggtctcgagctcctgacctcgtgatctgcccgcctcggcctcccaaagtgctgggattacaggcatgagacaccacgcccggccttgtttgatttttgagatagggtctcactctgccatcccttctggagtgcagtggcacaatcatagctcactgcaccctcaattttccaggctaaagtgatcctccctcctcagccccctgagtagctgggactacaggtgcataccatcatgcccagctaattttttttaaaaatttttaatagagatgaggtctcactatgttgcccaggtctcgagctcctgagctcaagcaatcctcctgccttggcctcccaaagtgctggtattacaggcatgagccactgtgcctggcaattccaattttttttttaacctatgcttttataccttctgcttaacaaaaatgagattttgtaaccctttttctcctccgcttaactgtatgtggggaacattttcccacagcataaactcttcttgtctatcatttgtaaatgttgcatagcatctcatcatatggatgtttaattcaacaagccctctactcttgaacattgaattccctcctaattttttgtttacgattataaatagtgctgtgatgaacaaatgtcgtaggaaaaaaatggccacattattttgtacctcctccaatcaagaagtagcatctatttctccagccctgaatgggcttgatcatgtgacttgctttgcccaatgtggacgttggtaaatgtgttgcaagcagaggcttgaaaaaagtgtttatggccaggcactttggctcacccctgtaatcccagcactttaggaggccaaggcgggtggatcacctgaggtcaggagttcgagaccagcctggccaacatggacaaactctgtctctactaaaaatacaaaattaggaatggtagcacatgcctgtaatcccagctactcgggaggctgacacaggacaatcacctgaacccggaggcagaggttgcggtgagccaagatcgcaccattgcactccagcctgggcaacaagagcgaaactctgtgtcaaaaaaaaaaaagtgtttatggccgggcgcagtggctcacgcttgtaatcccagcactttgggaggccaaggctggtggatcacgaggtcagaagatcgagaccatcctggctaacatggtgaaaccccgtctctactaaaaatacaaaaaattagccgggcgtggtggcgggcgcctgtagtcctagctactccagaggctgaggcaggagaatggtgtgaacccaggaggcggagcttgcagtgagccgaggtcgcgccactgcactccagcctgggcgacagagcaagactccatctcaaaaaaaaaaaaaaaagtgtttatgtactggggcttgccccttctttgttgctgagaatcttaaggccaccatatgaagaagcctgggcaagcctactggaagaggagataatacacagagacactgttcaggcatcccagctgaagcccaaaaatgtaaatgaagccattctagaccatgctaaaccatccagctcctgctgagctggccaatcccaaaaaatcacagaacatgagaaataatcaatgtttgttattttaatccagtttgagatgatttgttacacaacaaaagctaattgataaaactatcccatggataatgattatttcctggaacaatttcctagaagtaaattttctgggtcaaagagtatgcacactttcataccttttgattcatattgccaaaaaggttgtatcaacttctaagctaccagcaatgtatgagtgttcatatcttccatctttatctatactggactttgatgtttcttttgtttttgagatggagtcttgctctatcgcccaggctgctgtgcagtggcgccatcttagctcactgcaacctccatctcccagattcaagcaattctcctgcctcagcctctggcgtagctgggattacaggcacccgtcaccacgcccggctaatttttgtatttttagtagagactaggtttcaccatgttggccaggttggtctcaaactcctgacctcaggtgatccgctcaccttagcctcccaaagtgctgggattacaggcatgagcaccacactgggcctcatcgatgtttcttgttatcttcatgactacattgtgtttgtaaatttaacacacaagccattgtccattccctctcaattcacaatcaatttagaccaaaaaaaaaaaaaaaaaaagattatccatgtaggaaaaaagaccaaaaaaaagattatctatgtaggaaaaaagatcaaaaaaagattatccatgtaggaaaggaagagtagaaaagagagagagaaaataggagaataagagagaaacagagtcaaagatgaaaaatacagagaaagaaaatagaaatataaaacagagcaacctccaagactcttatacatagggtatttaacatgtagtcggaaatagttatggggggctgggcgtggtggctcaggcctacagtactttgggaggccaatgcaggaggattacttgagctcaggagtttgagaccaaattgggcaacatagtgagacctcatctgtataaaaaaaaaaaaaggccaggtgtgatggaatgcacctgtagtcccagctacttgggaggctgaggtgggaggatcgcttgagcataggaggttgaggctgcagggagctctgataatgccagcctgggtgatagagcaaaccctgtctctaaaaattggaaggaaggaaggaaggaaggaagagaggaaggaaaggggaggggaggggaggggagggggggatggttacgggtctaaaaataatttgggtcatgaaagagacttgaaaagaaaatgcccatttaggccaagcctagtgcatctgagagcagtgtaaaaataggtaacaggctctatcatatgtggttgcatttaattctcacagcaactctctgagacaggggtgattattcccattttatagatgagaaaaattaacagtcagagctttcaagtaacttgataaagatgatacagctgataaagaattgagcccaaatttgagcccaagtctgcctgtcttggaaatttatgtatttccacttattcttcctagaagggatgtagcaaaacactagcaactaatgcagggaggaagtgtagccaccttttgattcatattgctaaactgcactccagaaaggaaccatactccctgggtttgaatcccagctctgccacttacaacctgtataactctgagtgtttctatgtctcagtttcctcatctgtagaatggcttcataagtgtcatgagtgcataagatgtaaaccacttggagcagtggctgccacatagtaaagtgctgtctaaacttgctatttgtagtatgctgttgcagtgaccctgggaatatttctaatgatcctgttgccaggtggcccatacgtagtagctttcattatgcaatcatgcaccacataacaacctttatgtcaatgatggactgcatgtataataacagtggtttcataagattataatgctgtaagccaggcgcagtggctcacatctgtaatcccagcactttgggaggccaaggtgagtggatcacttgaggtcaggcattgaagaccagcccggccaacatggtgaaatcccgtctctactaaaaatacagaaattagctaggtgtggtggtgcgtgcgtgtagtcccagctactcaggaggctgaggcaggagaatcgcttgaacccaggaggcggaggttgcagtgagccaaaatcgtgccactgcactccagcctggcgacagagcgagacttcgtctcaaaacaaacaaacaaacaaacaaacaaacaaaacacattgcccattatgtgtcatgcactgtcccatatactttacaagtactatttcatttaattctcacaactagcctttgaagtaggtattagtcttttttttttttttttttgagacagagttttgctcttgttgcccaggctggagtgcagtggcgcgatctcggctcaatgcaacctccacctcctggttcaagcaattctcctgtctcagcctcccgagtagctgggattacaggtgcgtgccaccacacccagctaagtttttgtatttttagtagagacagggttttatcatgttggcctggctggtcttgacctcctgacctcaggtgatccacccacctcggcctcccaaagtgctgggattacaggcatgagccaccgtgtgtggcctgaagtaggtactctcatttccattttacaaatgaggaaactgagtctggatccagaatcttttatccttactgtactgtactgtctcctgtttaagaaccatgcaattttggggtgcaaaatgccaacaaaagcaaatgcaacacttctcagcctgcttcattcatcatctactctttctcagccgcaagaacattctgcattagatccactgcagcaagttgtctgagaactgaggtgagtgtcaataaatggattatgggccaggcatggtgacttacgccataatcccagcacactgggatgctgaggtgggagaattgcttaaggcctggagttcaagaccagcctgggcaagatggtgagaccccgtttctataaaaaaaatttaaaaattagccaggcacagtggcacgtgtctgtagtcccagctactagggaggctcaggtgggaggattgcttgagcctaggaatttgaggctgcagtgagttatgaccatgccactgcactccagcctgagcaacaaagtgagacacccttctcttattttatttatttattttttttgagatgaagttttgctctttgttgcccaggctggagtgcagtggcatgatctcagctcattgcaacctccacccccctgggttcaagcgattctcatctcagcctcccaagtagctgggattataggcgcccgccaccatgcctggttaatttttgtatttttggtagagacggggtttcaccatgttggccaggctggtctcgaactcctgacctcgtgatccacccgcctcggcctcccaaagtgctggaattacaggcgtgagccactgcacccggctgacacccttcttgagagaaagatgaaagaaagaaagaaagaaagaaagaaagaaagaaagaaagaaagaaagaaagaaagaaagaaagaaagagagaaaggaaagaaaagaaagaaagaaaggaaagaagagagagagagaaagaaagagagagagagaaagaaagaaagagagaaagaaagaaatggattatgtgtttgctacccactcaagccttctcaggtcaaattcttgtactttctcagtgggggtggaggatggggagaggaagatgaagcgcactctcttttccttttttttttttttttgaattgtaaaacactaggcacttttcagtgcaacagactgcaataacaccaggcctgattaaggaatgacaatatggaaggcagatggcagatgcatgggtgccacactattgcttttcagttaaatattgcttggtgttagttttttttctccttgtaaatctcccaaataaaacggtttgctttccccaagttagaagtgttagcacgtcttttctttaaatatctgtgcatggctgtttttttccctgccaatttgtcaccatctgtaaccctccctttatgagacgatctgatgacagcagttatcttggagagtagaagtgtggtcttgaagcgccatggaagagtagagtcagtgtaggctgtgtgtgtgtggagtgtatgctccccctgcacttggtgtgtgtacatacagaaacacagtgtgcgtgtgtgttggctctgggtgtgttgtgcgtgtgtacactgtgtgtgagtatgcagtgtgtgtacattctgtgggcatctcgtgtgtgtgtggactgtgtgctgggcgtcgtgcctgcccgtgtccttggcgccttggcgtctatgcgttctctgcacataggtaggtaccacgtgcacaccctgaatgtgagtgaactgcctgtgtgctatgtatttgccggctgaagaggggctgtgtggactactgggggaagacgttcctcaggagggcataatttctctaaagtgcttaaaggggatggagagagcctgaaatttgggggaagtaggccaaggagtattagcaacgtctgggcctggttgaatttcattacttttcctaggaaagtaaattatgggtggcttgaaggagggtgctgctgagatggggggcggaccatgaagcgtggaggggtctccggtgttgctggagggcagctggagcctgcggagagcctcggcgcgctcctccctctcccccaccctccccccaccccgggcggggctccgcgtggggcggtggactcgggcgggggggggggcggccgcggccgagcgggggtgctgcgcggcggccgtgatggctggtgacggcggggccgggcaggggaccggggccgcggcccgggagcgggccagctgccgggagccctgaatcaccgcctggcccgactccaccatgaacgtcgcgctgcaggagctgggagctggcagcaacgtgagtgggggccccgggctccacgggaggggactgggtggagggggacgaggcagaggggtcggccgcggaggggcaggcggtgcccggctcgcggaggtaaggctgcctcccgggcctggtggaggggtgatagagagaccccgggcccgagagcagggcaggtgggaagggaagggccctcttagcagggcggaggggtccgcgaggcagggagcactggggcagggtcgtgggcaaatagccctctctgcctgacctcggttggcaaccccgactgtctggcagatggtggagtacaaacgggccacgcttcgggatgaagacgcacccgagacccccgtagagggcggggcctccccggacgccatggaggtgggcaagggggcttcccctttctcaccaggccccagccctggcatgacgcctggcacacccaggagctctgggctgttctggagggtcacctgcccccacctccgctccatctctggcctctgctctaggactatggtgaggcgatgctaagccgtgacgttgcacaaaacagactcaaggctcaactcactggctggcctcattgcccccgggcccagagttaaccctgtggctctgaaaactgcctgtggcttcaccctctggtaatcttggatccctgccctgcatctcagtcactctctgtccccctgtgttccccaggtgggattccagaaggggacaagacagctgttaggctcacgcacgcagctggagctggtcttagcaggtgcctctctactgctggctgcactgcttctgggctgccttgtggccctaggggtccagtaccacagaggtaggtgggcccacactcttcgtcagtattcataactaggggttctggaggcctaagggcctctaagattttcacttgtgggaaccaagccttccctgcagaaaagcccccggctttgctttctcttcccaaccttcctgctgtcatggcccttgcagagtttgcctcttccagacagacagactgacagtctcctaccctccggccatgttccctaccacagacccatcccacagcacctgccttacagaggcctgcattcgagtggctggaaaaatcctggagtccctggaccgaggggtgagcccctgtgaggacttttaccagttctcctgtgggggctggattcggaggaaccccctgcccgatgggcgttctcgctggaacaccttcaacagcctctgggaccaaaaccaggccatactgaagcacctgcttggtgagtggggctgttagggaggccttgggccacctatgtgccttgtgcccagcacagggcctggcacttagcaaataggcagtgtccatgaatgaggaagtggatggttctgtgaacactccagagggtggggaggcagagagcaggggactattgagaagtgcagatgggtttgatgggggcagaactctgggtacaatggagggccgcttctctgcactctgtttggagcactgtcgtggtgtggtagacaccagggagcctgtactgcttagatatccttgggtctccatggacagggagaggaagccacggcttgctgtttcagacactcttcctgggtctgcgttagcaggactgctcattgacaaggcaaggagagaaaccgagcaagggccagggactccccctcagcagttaacgtaattgccacctggatcctgtgttctgccccacagaaaacaccaccttcaactccagcagtgaagctgagcagaagacacagcgcttctacctatcttgcctacaggtggagcgcattgaggagctgggagcccagccactgagagacctcattgagaaggtagggccactgagccggttgagggcaggggagcaggagaggccttgagagaggagatggcccaggaacgctttgggagctcctgcactaatcattccacttatggtctctacatagattggtggttggaacattacggggccctgggaccaggacaactttatggaggtgttgaaggcagtagcagggacctacagggccaccccattcttcaccgtctacatcagtgccgactctaagagttccaacagcaatgttatccaggtgatgagctgggaaagggtggggagagacttagggacactttgctgagcccagacttccctctcctgtgacaggcaggctgggctgaccccccggccccacccctacccccgctcgggaattcaggttcccatggtggggaaagcgaggggctcacctcctttccttgacattgcaggtggaccagtctgggctctttctgccctctcgggattactacttaaacagaactgccaatgagaaagtaaggaacatcttccgaacccccatccctacccctggctgagctgggctgatccctgttgacttttccctttgccaagggtcagagcagggaaggtgagcctatcctgtcacctagtgaacaaactgcccctcctttctttcttcttttcttcctccctccctccctttcttccccttttccttccttccttcctcttattcttctagtaggtttcatagacacctactgtgtgccaggtccagtgggggaattctgagatataagtttccgagccattgccacaggaagcgttcagtgtcgatgggttcatggacctagatagctgagaacaaagctcacaagagggtcctgaggattcaggagagacttagggagccagcaaagtcttcctgaagagattgcatttgagccaggtcctgtagaatacataggagtggatgagggcatgctgggtagaaagaagtttaggccaggtgcggtggctcacgcctgtagtcccagcactttgggaggccgaggtgggtggatcacctgaggtcaggagttcgagaccaggctgaccaacaaggtgaaaccccatctctactaaatatacaaaaattagccagtcgtggtggcaggcacctgtaatcccaactactcgggaggctgagacaggagaattgcctgaacctgggaggcggaggttgcagtgagccaagattgtgccactgcactccagcctgggtgacggagagagactccgactcaaaaaaaaaaaaaaaaaaagaaagaaaaagaaagaaggaacagtttaaacaaaagtgttgatgaggctgagcacagtggctcacacctgtaatccccgcactttgggaggctgaggccggcggatcacttgaggttaggagttcaagaccaggctggcctacaaggtgaaaacccgtctctactaaaaatacaaaaattagccaggcatggtggtgtgcacctgtaatctcagctacttgggaggctgaggcaaagagaatcgcttgaatccaggaggcagaggttgcagtgagctgagatggcaccactgcactccagcctgggcaacagaacaagacttcatctcaaaaaaaaaaaaaaaagtgttgacgagggaaaggctaggtgtgtctggaccatggcaaggggtccactgtggtaaaatatagaactcaaggcagatgagaggctggagaggtgggcaggaatgggttatggaggggaccttgaatagcacactacggagtttattctgtagctcccggagagccattgcatgctccaaagtagggagggagcgcagtgctttgggaagtcagtttgtttggggtgtgaagagtagatgtgagaaagaaagcctggagatgaattaagagcatctgcggtactccgtgctctgagtcaggaaggtcccaaatgaaagagtggcagaaggaatggtaggaaggggaggatgtaagcgatatcatcaagtcagaatcatgagttcttggtgcccggatgttagaggagggaaaaggtgaagatggctgaagctgtacactttcatgatggtggaatggaggggtcccttgggaattaggggtgtctctaggaagaaccagcttagggtacattgagaaagaggagacagtgcaacatcacaggaataggagagactttggagtcagacctggatttcagtctcagctctgctgcttggtgcaagttgattaatctctctgaggctgttccctcatccgtaaacaggggatcatagcatcaacctcatatggcatttggagtaggttaggggtacaaacttatgctcctgcatgtggcagatgctcaatcagagtgtgggagctgctccttttagacatgtgagtttgatgggacctgggcaccttacatacagagaggtcagcaggcagctgggaaagctgtgtggagtcctgaagagagaataagcgtgaaaggacccagaggcctgaggggcatctccttagaaacctaaccaggccaggcagggtgtctgtaatccaaacactttgggaggccaaggcgacctgattacttgaggtcaggaatttgagaccagctggccaacatggtgaaaccccatctctactaaaaatacaaaaattgggccgggtgtggtggctctcacctgtaatcccagcactttgggaggccaaggcaggtggatcacttgaggtcaggagtttgaaaccagcctgactaacatggtgaaaccccatctctactaaaaatacaaaaattagcccgacgtggtggcgggtgcctgtaatcccagctacttggaaggccgaggcaggagaatcgcttgaacctgggaggtggaagttgcagtgagctgagatggcaccactgcactccagcctgggcaacagagcaagactctgtctcaaaaaaaaaaaaaagaaagaaaaggaaaaagaaacctaaacaaaggctttgaagaggtgagacaggaggaggacagagaaaggacagaaggagatccttgtattttaagggcagtgggagagtcagcaaaagagattgctgtggagtaggacaaccatttgtccttctgtcattcattcagaaacatctgctgagcatcccttggccagaccctcctctaggcatatggtgaacaagacacttctactaccctctgagtggaggagaaggcataaaacagttcgctacacagttgtcctgtttccagttgttgggactattatagaggagaagcatagggttctgagagcaagtgtgaccaggaacctgcctagttccagggtgcggataggctgcaatgaagggagagggctctacaaaggcaacaggttatgcaaaggctccaaggtgggaaggcatatggccagcccactggccattctcaatggatgagggagcaggaggggcatgcgggccaaggccttctggacaggcccatagcctcacactatgcaggagcattgtgggccaaatttaggattcatcccgaaagaaatggaaagggaaactcaaaagtgatgtgaacagatgtgtgattttgacatcatctgagtcaggggaggagataatttttacaatttgggagagaaccacatccttcaaccctttggaaggggcaagaggaaagacttcggtttggctgtcagcatgtcactggttgccttcaggaagcctcctgtgctgggatctagagaaagatgcaacacaaaaggttaagataggatgaaaactaagagtaggctgggtgcagtggctcacgcctgtggccccagcactttgggaggctgaggtgggcagattacctgaggtcaggagttcgagaccagcttggccaacatggcgaaacactgtctctactaaaaatacaaaaattagccatgcgtggtggcccgcgcctgtaatcccagccactggggaggctgaggcaggagaatcgcttgaacccgggaggcggaggttgcagtgagccgagatcacacacctgcacttcagcctgggcgacagagggagacgccatctcaaacaaacaacaacaaaaaaactaagagtaaagcagggttcaggagagtctcaaaagtaagcactaagctgaaggtgaggaggtagggagagaaggggtaaggtgagatcactggtttagctaaccatccccctcaggagctgggatgactgggattggtactcaaacctcttcctctgatgccagcagcaagtaagaggagaggtgagagacaggaggaatttgaaatacacagaatgaatattaagggatctaaaacttcttggtaagtagaagaagagatggcctttggcgattagtggagcccaggtgggccttcaggttgagtgggaagtggtttctgggaggagggttaagggaattggcacagagcagtgttgagtgtctgtttgcaggttttcgccctgttattcaacagatatttattgagcacctactctgtggcagacagctgcgcttgggtctgaaattacagtggtgaacaaagcaaacccagccctgctttcatggagcctcagggccagcaggggtgaggccacatgagtttgtactggacccgagcagggccagggccgccatggccctggggtcatcaggcctgggccacattctcactctgccatctgctagtttgtgatggaagtcaagccgtgtcatcttcccaagcttctgccctggggtgtgaaatgggactcatcttcacttcatgaagttgctgtgtggggaggaaaagatacactgtatggaaagcctctaatagagagtctgatgtatgtctgcagaagtggtcactaaatatttcttctccatgcttttctctcccttggagaccagcgggtagtggagaaagcagctagcttgaggcctggcaggatgggaggtaatagaggcctgaggacaccatggccccgatcccctgtgaggtccagtcagctgttcagagaaggcacatggtcactgatgggctgggacaactagcagggatctaggaaatgagaaggcaaagcagtatgggaagtaggcccatctgctggacagacatttgcagagcacttactctgtgttctagtccctagagacagcagtgagtaagctgctgtaacttggaacaatgctctgctggaactcaccttctccttggagaaatagatgataaacaagtacagaagtaagtaaacatggccgggtgcagtggctcatgcctgtaatcccagcactttgagaggccgaggcgggcagatcacctgaggtcaggagttcgagaccagcctggctaacatggtgaaaccccgtctctactaaaaatacaaaaaattagccaggcgtggtggcacacgcctgtagtcccagctacttgggaggctgcagcaggagaatcacttgaacccaggaggtggaggttgcagtgagccaagatcgcgccactgcactccagcctgggcaacagagtgagactccatctcaaaaaaaaaaaaaaaaaaaaaaaaaaaaaagaagaagaagaagtaagtaaacaatacttagccaatggaggtaagcagtgtgtcagaaatgaaacaggtcatccagaaaggcttccagaaggatcaagcagaagagatattgggcagaggtggtggtaagaacagatctcagccttgggcaggacttgttgctgggctctgaggatcacccgggccttgacaggtgctcactgcctatctggattacatggaggaactggggatgctgctgggtgggcggcccacctccacgagggagcagatgcagcaggtgctggagttggagatacagctggccaacatcacagtgccccaggaccagcggcgcgacgaggagaagatctaccacaagatgagcatttcggagctgcaggtggggcaggcagggggctggagacaactgagaggggccagccttggcatggaccacccagcttccctccatgccatctccccaaggcagccagtcctttcctcattcccttgcttttctgtgctccccagctgcactgctgctgtcctggggaaaaaaatggtgtccatttaggccacctctcactgggtcatcctttggtccctttcttgcctggggatgcatggagggattgtgttaaaaatgtgtaacagtttgtatgagatgtccacaaaacaatcagaataggctgggcatggtggctgacatctgtaatcccagcactttgggaggccgaggcgggtggatcgcctgaggttgggagttcaagaccagcctagccaacatggtgaaaccccatctctactaaaaataaaaaattagccgggtgtggtggcacatgcctgtaatcccagctactcgggaggctgaggtagaagaatcgcttgaacctgggaggcggaggttgcagtgagctgagattgcgccattgcactccagcttgggtgacaagagcgaaactccatctcaaaaaaaaaaaaaaaaaaaatagaagtgaaagtttccactgggggacccgtactgtgccaggccattaacactttagatgttggattatggaaaagttgggatggagtgtggttctggaggagaagccagtacgtgcagggtgttgggagtggtattttatcaattgttaggaaaatatttgaatatctaggccccagctgaatgtcacatgtagtggttatccttgtataataagtggttgggctcccagattggaggtgtccaggcctggaaaagggtatattacaggaaggatacaccatgaagccagtagttgttgctatggcaatgggaagggctcccaggctacagcatacagtgggggagggttctgctggaagcgagtcgggcaggcaaggcctgagatttttttctttcaggctctggcgccctccatggactggcttgagttcctgtctttcttgctgtcaccattggagttgagtgactctgagcctgtggtggtgtatgggatggattatttgcagcaggtgtcagagctcatcaaccgcacggaaccaaggtgtgggggtagcccagggtgagggtgggttctgtggaggtctccagcaaggctgggcataatggacaggcccagccacacagaacaacatttggtaatgctatgggccttccaaacattgaatcagaatgtctatgggcttttcctctgcgctagggttgcagggtgctccctgtgatctctgtccccccactgctctccaacctgacctctacaggcaggtgtgtggccccgggaccaaagaggaaccccgggacagcttccacatatgcctctcgggactcctgcaacttgcatgttcctgggggctggtttgaggggtgtgaagggcatcccacctgcccttttcttattttctggtctggttgtcagcatcctgaacaattacctgatctggaacctggtgcaaaagacaacctcaagcctggaccgacgctttgagtctgcacaagagaagctgctggagaccctctatggcactaagaaggtgggctttctgattttgcctccacgttctgatccagtctaaccgatgctgcataccttcagtgtgacaggcaccatgtgcctcatggtgcacaggtgcatagtatggagcgcagaatttggaagcaagccgacttgcgtttcaatcccaactcattcattttctagcctgtaggaccttgggcagatcacctagcctctctgactctccatttcctgctctgtaaagcaggaataacttggagggttgtcaggaagagtattagctgagttaatgtaagtgaagcacctgcacagtacatggtatgtataggcactcggctttgatgaggaggatggagaggatataataaataagtgagtatttagtttcaagatgccccattaagtggggggagtggacatgtaaacaaatacattatattttgtggtgataactgctcacactgagtgaaagacttttctgctataggacagaggtgggacagcacatttcacctggggggatggtggggaagggcatcagagaagccttctctgagaggtgccatgtgatggaaaagttcaccaagaaagccggggagaagggcattccagggacaaggaacggcatgtgcaaattcctagaggccaaaaggagcatggtggctttacacacgttctggcatgagcttgagaagagggcaactgagagacggggtttggtaaggtgggcatggggcacttgggaagggatctgaatattgtattgggaagtccggccttgattctttcacagatggggctccatgggagtagcatggagaggagaaacacagttgggttatgtatgaaatgatatttctggtggctaaatggaagatggaggggagcagcagggaagcggggatgagaatggagtcagggtgtccagttaagaggcaattgcaggccaggcttggtggctcatgcctgtaatcccagcattttgggaagccaaggcaggtggatcacctgaggtcaggagttcaagaccagccttgccaacacggtaaaaccccatctctactaaaaatacaaaaaattagctgggcgtggtggcaagcaactgtaatcccagctactcgggaggctgaagcaggagaatcacttaaacctggaggttgcagtgacctgagactgcgtcattgcactccagcctgggctacaagagcaaaactctgtttaaaaaaaaaaaaaaaaaaaggcaattgcagactgagtgtggtggctcgtgcctgtaatcagcattttgggaggctgaggtgggtggagtgcttgagctcaggagttcaagatgatagtgttataggtcagggaagtggtaatcattttccccgtccacttgagtggatgggaaagatgattaagaaatcaaagcaggcagggcgccgtagctcatgcctgtaatcccagcactttgggaggtcaaggtgggcggatcacttgaagtaaggagttcaagaccatcctggctaacacggtgaaaccccgtctctactgaaaagacaaaaaatttagccgggcgtggtggcgggcgcctttagtctcagctactcgggaggctgaggcaggagaatggcgtgaacccgggaggtggagcttgcagtgagctgagatcgcaccactgcactccagtctgggtgacagagtgagactccatctcaaaaaaaaaaaaaaagaagtcaaagtagtagaaactgctgatagactgaatgtggggggttagggagatggaggaagctgagtgactcccaggtttcttgcatgggggactgactggatataaaattagttgtgggccgggcacggtggctcatgcctttaatcccagcactttgggaggccaaagcgggcagatcacttgagctcaggagttcaagaccagcctgggaaacatggtgagaccccttctgtactaaaattacaaaagaaaatagctgggtgtggtggcatgtgcctggggtcccagctattcgagaggctgaggtgggaggatcgcttgagcccaggggacagaggttgcagtgagcagtgattgcaccactatactccagcctgggtgacagagcaagaccctgtctcaaaaaaagacagatgtggcactgagcaaacccaggactcttgtccagagctgagaagggctgctagccccagtgacagagaaaggccctctgactggaggacacagccatctctagggtcctggctctttgtcctttaacagtcctgtgtgccgaggtggcagacctgcatctccaacacggatgacgcccttggctttgctttggggtccctcttcgtgaaggccacgtttgaccggcaaagcaaagaaattgtgagtctacaagattctttcaacactatgccctcaaaattgactgttcatgtatgtgcagacatatagaaaaacaacgggagccaggcgcggtggctcacgccggtaatcccagcactttgggaggccaaggcgggtgaatcatggggtcaggagttcgagaccagcctggccaacatggtgaaacctggtctctactaaaaatacaaaaaattagccgggcgtggtggcgggtgtctgtaatcccagctacttgggaggctgaggcaggagaatcacttgaacccaggaggcggaggttgcagtgagccgagatcgcgccagtgcactccagcctgggcgacagagcaaaactctgtctcaaaaaaaaaaaaaaaaaaaaaagaaaagaaaagaaaaacaactggatgtaaattgatgaacaaatgaagtagtgctgctttgggcagtgggattataagagtcctttaaagttgtctatgtgtttatgtttaactatataactagaagaaatatttatttattaggatatgataatggatgtgcttaaagtattacctgtaaggatgtttatggtttttatggcaatgttgtttataatagcagaaaatgagaacaggttaaatgtccaactatagggtaaaggaaaaataaattgtggttaggatgggttgtgaggatccttaaatggctgatatatctttcagcaaaaaaagtaggttacaaaaaatatataccctatacaacataattccatattttatatgcatatcaggggagggaaaaactctagaagtgggtaatcaaaatgttaaaagaacttatctatgaatgagtgctttataactggtctgttcttcaattctcaattttccaaattttctgtgaatgtcctcttttcataatcagataaaaatcattgcactaggctgggcgtggtggttcacgcttgtaatcccagcactttgggaggctgaggcgggtggatcacgtggtcaggagttcaagaccaacctggccaagatggtgaaaccccagctctactaaaaatacaaaaattacccgggcatgatggcgggagcctgtaatcctagctacttgggaggctgaggcaggagaatcgcttgaactcgggaggcggaggttgcagtgagccgagattgcgccactgcactccatcctaggtaacacagccagactctgtctcaaaaaaaaaaaaaaatcattgcactatattaaattataatataatttgatgaacttattgtcaattaaaatgtgtacttaattaagaaaaaagccagccacaatcccagtacctttacaaatggtgtttccttctcatcgtctccaggtgctcagccgtatttctttagtctagacgttcccatttcccctgggtggacagggatggggcaccaagggtggatgggtggggcagggatgcattcagtgcaggggaaggctgactttacctcctccctcccaggcagaggggatgatcagcgaaatccggaccgcatttgaggaggccctgggacagctggtttggatggatgagaagacccgccaggcagccaaggagaaagtgagcggtggctagggttggggcgccatcttgaggtggggttcaaggatacagttttgctaggaacctggggaaggaaacaaacccttaacctggtctcttcaggcagatgccatctatgatatgattggtttcccagactttatcctggagcccaaagagctggatgatgtttatgacggggtgagtacctacgctcatcagtactgaacttcagccctgtagagggcactgttccctgggcttagaaattggggctcaagcactgggaaagaggtgcttgtcggtttcttttagaggcagatggaggtaaccagcattgttaaaatgttggctctgtgacaggctgcaggccaaacagcagtgaaatatagtgctaacgagccaagatttggagtcaagcctaatcaaattctgtttctacctctaactttgtaaccttaacaaaatctctctaggccttggtttcattttctgtaaaatgggggtcctactagtgccttcctcatagggttgttgtgagataaatgaatacagtatgtaaaaaaacagcacccataacataaatggcctttaaatattgccaattatggtttactagatattttacagttgaggaaactgaggtttggagagatactaatgagtagccaaactggcgctattatcttctccaatggattctcttgctctctttctacttcccacctttcccacagtacgaaatttctgaagattctttcttccaaaacatgttgaatttgtacaacttctctgccaaggttatggctgaccagctccgcaagcctcccagccgagaccagtgagaatgacggggtggacatagacactaggggtggcaggagaggtgggggaaggttcctgggatgggggaaaagggtggcaagactggtcccagaccggcggccccatacccttgcaggaggtagggcagggctgttgggaggggagcagtgtcaggagagtcgggagcctcagcccctcactcttcctccgccaggtggagcatgaccccccagacagtgaatgcctactaccttccaactaagaatgagatcgtcttccccgctggcatcctgcaggcccccttctatgcccgcaaccaccccaagtgtgtctgaagcaggaggggctgggtgctggggcctgggcctgtggttgagctgggagcagggctggaggtgggattcagaagtacccccgccatgtcctcacttgctattcctcacccaccagggccctgaacttcggtggcatcggtgtggtcatgggccatgagttgacgcatgcctttgatgaccaaggtaggggcccatggagtcgtcccctctagcctagaattcccagtggctcctgcaaggccttgggacattgatgtagccccaagggccctgaagtctgtggaccagggctggtgggggcactgctgcccccaagagacgagctctggttttggtggggtgcaaaggtgagttctcctcagggcgcgagtatgacaaagaagggaacctgcggccctggtggcagaatgagtccctggcagccttccggaaccacacggcctgcatggaggaacagtacaatcaataccaggtcaatggggagaggctcaacggccgccagacgctgggggagaacattgctgacaacggggggctgaaggctgcctacaatgtgagtggcctgaccagccctccagcggctgaggcctgctggcctggggtgaaaggtgccgggtgggtgggggcaggcctggatgggcttgttgcccactgttctgtccccaggcttacaaagcatggctgagaaagcatggggaggagcagcaactgccagccgtggggctcaccaaccaccagctcttcttcgtgggatttgcccaggtatcaccctctcggaaggcctggggtctgcccctttgtcctgctccctcctgagtatgtcattaggagaactctggggcacgtgtcaaacgggctggtgaatggggctgaggctggggcatgaaaggtgggctgggaaggcccatgcccagagcctccggccagccagggcccacaaaggcagcctgaagaggcctgagcgggagaatgccttggtaggatttcgcatagttcaaagggcaaggttgtcgtgcttgcggggcacagggtggcgaagggggcaaacgttcatcctcacgctgttcctgtgagggagacatgcaggaaacgaaagctcgggacgcagagtggcctgtccagggctgcccaggaatagagtaagtggcagagcaaggacccaggcagagcctccgctgggcagccacagcaggcagcttctggggctccgctttttcccctcgtcatgtccatgctgggcaacccgatgtccagggcagttttggaaggaacttgggaggggctgcagcggtggtggtttgtgcccctgggatggctgtagctgactctaaggcccggctccacactagacaccatatgcccccatgtctgtcctggcccgcaggtgtggtgctcggtccgcacaccagagagctctcacgaggggctggtgaccgacccccacagccctgcccgcttccgcgtgctgggcactctctccaactcccgtgacttcctgcggcacttcggctgccctgtcggctcccccatgaacccagggcagctgtgtgaggtgtggtagacctggatcaggggagaaatggccagctgtcaccagacctggggcagctctcctgacaaagctgtttgctcttgggttgggaggaagcaaatgcaagctgggctgggtctagtccctcccccccacaggtgacatgagtacagaccctcctcaatcaccacattgtgcctctgctttgggggtgcccctgcctccagcagagcccccaccattcactgtgacatctttccgtgtcaccctgcctggaagaggtctgggtggggaggccagttcccataggaaggagtctgcctcttctgtccccaggctcactcagcctggcggccatggggcctgccgtgcctgccccactgtgacccacaggcctgggtggtgtacctcctggacttctccccaggctcactcagtgcgcacttaggggtggactcagctctgtctggctcaccctcacgggctacccccacctcaccctgtgctccttgtgccactgctcccagtgctgctgctgaccttcactgacagctcctagtggaagcccaagggcctctgaaagcctcctgctgcccactgtttccctgggctgagaggggaagtgcatatgtgtagcgggtactggttcctgtgtcttagggcacaagccttagcaaatgattgattctccctggacaaagcaggaaagcagatagagcagggaaaaggaagaacagagtttatttttacagaaaagagggtgggagggtgtggtcttggcccttataggaccctgtgccaataaacagacatgcatccgtcagcctgtctctcttccttcagtcctgttttcatgtatccattcactcattccaccagcgtctatagagcaactactgtatgccagccactgtcgtcagtgctcatttactcactagtggatacaggggactgagatttgaagcccagagaagacagagaaagagaggcaggatggaggaatggaaggaagttgagtctgactgggcagaatacattgtctgctaactggtggccatagcctcatccccagctgttctacagctggaaggatttgctgctttcctccactggtgcgtgcagccaggcctgacactgagtgtgggtaactactgggccagggtcaacttggaagatgggcggcccttaccctgcagtggtgggaagtcctgggcatatcactccctgagctcccagagctcaaagccctggcctctgcttgtagctgaaaagacaaacatttccttctagcctcaaaggctcagagctcccaagagtcagccattccacctacacacactcattaggcctaccaagtgccaggcacagagactgcatatatggcctctaccctccagagtgagggagggaaaaggaacgttgattgaatacctcctgtgttccaggcacctgtgctaggtggctcatttctttattcattcatccatttattaatttatacattcataggcttattttcaaaaaaaattgctttatcaacaatgtgtcaggcactggtgatacacaaatgaataagataggtgaggtggtgcgcctgtagtcccagctactcgggatgctgaggtgggaggattgcttaagctcaggagttcaaatccagcgtgggcaacatagcaagacctcatctcttaggaaaaaaacaaaacaaaactgatgaatgagaagtttcttcttcccttaggtgactcttcttctgttggcactttcgccttcatgagctcacctaatccttgcaacaaccgcccttttcaaatactctagtctccattttacagatctatccctaactacttcactgcagtcaaagagagctggactgaaatggaagctctgatagttttgtgagcttcagcctgttccctaaactccatgaacctcagtgtcttcacctatgaaatgagaactacagcaaaacagtggaaagagtccaatctcaattctctttattttttattcttgagatggagtctcactctgtcacccaggctggagtgcagtggtgcaacctccacctcccaggttcaagtgattctcctgcctcagcctcctgagtagctgagattacaggcgcgtgccactacgcccagataatttttgtatttttagtagaaatggggtttcaccatgttggccaggctggtctcaaactcctgacctcaagtgatccacctgcctcagcctcccaaagtgctgggattacaggcgtgagccacaacacccagcctcaatctcaattctctttaaaactcagtgctttaggctgggcgcggtggctcaaacctataatcccagagctttgagaggccgaggcgggctgatcacaaggtccagagtttgagaccagcctggccaatatggtgaaaccccatctctactaaaaatacaaaaattagctgggcgtggtggtgtgtgcctgtaatcccagctacttgggaggctgaggcagaattacttgaaccgggacctgggaggtggaggttgtagtgagctgagattgcgccactgcactccagcctgggctacagatcgagactccatctcaaaaacaaacaaaaaaacacaaaaaaaccttagtgctctccaaggtgcaagtagggatgagtttgttcagtgtggaaggggaggagtgaagctctggttatgattgctgctggtccttggccccttggtgaatggcaatagtatgtgtcccacaatctttccataaagagctgtatgtggatctctgtcatgtgacctcaaagtgctggctggccacaaaaggaagaaagtagccaactgctcagaaaggagaaaagtgtcctgaggaactccatgacccagggaaagcacagcctgagtctctaagagcatgactccagggtaaatggctgcgtgtattggaaagaggaggccatcacatctgcaggcctggtctacctccagctctgccacccttgagctgtgtgacattaggccttcaggtctcagtatcttctgcagtctgtaaaacaagtgaattggatgagacgatctttgaggagcatttctgctttaatgctctaaaaagtgaatccatgggcttagcaaattccggaacccaaagagatagtaagtgactcgtgacattcagatgagatttataatgtcagacagcataatgactgaggagacaggcttggcagataaagccttaccctttccctgacacctaatttcagaggccagcttaggattctgacaggctggccagtgggttattaaaacctcatattgcaaaaaggtcaaagtgtcaaatgatgatgatgatggctagccttaatttactgggtcactattttgcttaagcttgtgctaaacactttaaacataccttctcattaaatgcacacaatgatttgcaaggaggttctatcattgtctctattttacgaatggagaaactaagggaaaagatcacgtaacttccaatgtcagacaagacagattgcattaaagttagatttggaactcagatgcccttaatcactatcagttagtcttccaacacgacagaatttagactgaaacacacacatctgtcttctgggcaatttcatcatgcttctgagtgggaccatcaccagcaggtgcatttccatgcaacccagattccctgggcaaggcacatgtgacaaccagacagcttcaggaaacctaagcacacattgagctgaaatcaagccagggaacacctgtttgttgaacactctgcaggtgcttggttccagaggcaagccaaggtgaacatcaggtaagagatgtaacctttacccttagtagccctgtcaggctgagtatgcgtatgtgatatgctctggtgtgtccaggcagaaggggaaataagggatggtgctcctcggtggacacagggaagcaattataggtaaagtgctaggccatcccttatgcagtcccattggtaagtctaactaattcccatccacaataagctaacatatgccaagaagtatgatttcacacccttgatagcactttggaaatgtccgggtggaagagagtccctcataaaaataagcacagttttctgcaggattggaggtcctattttttttttttaattaaaaaaagcaggctgggcgcagtggctcatgcctgtaatcccagcacttcgggaggctgaggtgggtggatcactatgtcaggagttcaagaccagcaggagaatcgcttgaacccgggaggcggaggttgcagtgagccgagatcgtgccactacactccaggctgggcgacagtgggagactccatctcaaaaaaaaaaaaaaaaaaaaaaaaaaaaaaaaaaaaagcagttttagtgggtctatcatgatttacaaatggagaaacctcatgattttccagtgcctagttctggcctccaaagacagctcccagtgggttgttattatacacaaagatggcctgaagatgaatgcaaagccattcattcattcattcattccgcatgcatgcattctgcaaatatttatcaaggctcactacaagccaggcgctaggctggaggctaggagcataaagatgaataagacacagttccaggccgggcgcagtggctcatgcctgtaattccagcactttgggaggccaaggcaggcagataacttgaggtcaggagttcaagaccagcctggccaacatggtgaatccccgtctcgactaaaaatacaaacattagcggggtgtggtggtgcatgcctgtagtcccagttacttgggaggctgaagcaggaaaatcacctgaacccgggaggcagaggttgcagcaagctgagatcatgccactgcactccagcctggacgacagagcgagactccgtctggaaaaaaaaaaaaaaaagaagaaggaagtcatggataaagaggagttttagaaaaaaatccctctacagatgactgaagaaagcatgaaaatgtatggacaccgtgaagccagagatagaataggcagaacagttatggactgttgaatttttgtctgcagaccagcgctgggggagtcattggcaatggcaatggaaggtcatgcctagaatccaagcactgagtggaaaagagcaacaggtatttaaaatggattcagacctttacttccgtatctacacaaacatttacccaacattcactctgtgatatgttgtactaggtgtctttttcttcaatgtgtcagaacccataaaataagattgctagaagactcctgagtgttcccactaggtgaaagggagaagagatacttccttttttctcaccttacacgcacacacacacacacacagctgaagaagaaactctggggtttgcctaaaacagtcaagggctttgaagactgaaagactgagctttaaattttgattccgccgggcgcggtggctcacgcttgtaatcccagaactttgggaggccgaggcgggcggatcacctgaggtcgggagttggagaccagcctgaccaacatggagaaaccccgtctctactaaaaatacaaaaattagccgggcgtggtggcacaaaaattcaacagtccataactgttctgcctattctatctctggcttcacggtgtccatacattttcatgctttcttcagtcatctgtagagggatttttttctaaaactcctctttatccagctactcgggaggctgaggcaggagaatcacttgcacccgggaggcgaaggttgtggtgagccgagattgcgccattgcactccagcctgggcaacaggagagaaacactatctcaaaacaaataaataaaataaaaaataaatcctcattttactacttgatatgatcttctctgtaaaatggacctaaccctaccaatctcaaaagattgtaagaagtgcatggaatcactcgaaagcagtcctgacataagcgcgtcagtcacacgcctctaaggcttcacagggaaagacgagaagatagaggacgaagaccttgtcttgttctgcttttagctccagaacttggcggggagcacagggctttattgatcgatgtcaactccacctggctccccaaagtatttaaaatggtagccacgggaatagcagagtactctctttcaactggggaggaatatcaaatgaggttaataggccgggcgcggtggttcacacctgtaattacagctctttgggaggctgaggcgggcagatcacttgaggtcaggagttcgagaccagcctggccaacatagtgaaacccccgtctctactaaaaaatacaaaaattagctgggcgtggtggcgggcgcctgtaatcccagctactcgggaggttgaggcacgagaatcacttgaacctggtaggcggagtttgcagtgagccgagatcgcgccactgcactccagcctgggcgagagagcgagcctccttctcaaaagcaacaacaacaacaaaaccaaatgaggttaatattccacagtggtgtggggctagacacagttacacagactttatacaggcggcaatcaagcgtcctggacgtcaagaaatctagtttgtctgtcgcgccacgcagtcaactggagtgtcactgtgggttctatttacaccgttatgagaaaaacctgtggcggagtaaaactcggtaactccgctcgcagaccgcccatctacagcagtgagcgaacccaaaccccacacggccaagtcccgcgggtttcaggaaactccgaagaggtcgggggccaggggcgactatggcgcgggggaggctgggaattgtagtctccacctgcctccgagggcggggtccgagggcggggctctcaggccgagggggtgggtgggtcgccgagcgccccggctcgccccggcgtttccggtcgcaggcgggctctggaggaggaggggcgccgcgaccgacgcgcgcgagttggtctgggaaaaagggcggtgcgagcgggtgcgcgcgcagcgggccggcagtggcggcggagatggaggagggaggccgggacaaggcgccggtgcagccccagcagtctccagcggcggcccccggcggcacggacgagaagccgagcggcaaggagcggcgggatgccggggacaaggacaaagaacaggagctggtgaggcgcgaccccgagagtcggcgaaggaggctgcggggctgagtcacggcggctccgcaggcctcaggcccgacacccaactaccccaccgcgccagggagagggcggttggggcgaccctcgggactcccggcaccttgcctctctgctcctcattctccgttccgcgctgtcacctccgccgtccccaccaaccctcaccaccgccgcgtgaagtggactcgggcaggtcattgtcacctccgtttcctagagtggcattcaagtagagcctgattcagaacccaggctgatttctcaccagggcttcccattcccactcggtttccttgtccacctggcccctcctaaggaggcaggcttattcttcacctgccccgggtaagtgggaggaggacgtctttgggattccttctcttcatgagctgcttctcccaaccctccagtctgaagaggataaacagcttcaagatgaactggagatgctcgtggaacgactaggggtgagtcacgatgttaacatgattcggtgcatgtttggatctttcccacttgttttattcttttttgaggcaactgctatgtacggtggactgtattttagggtcagtgttatgatgatgttgggaggcaggagagttacaaagggtatttgtacagttttgcagctttctcttgtgggagaagcagagttcttacctcttaacttgggtcatttgtttttgtgccaggcagggtgcagggagttgaggaatcacagatgaatgaataagacacagcatttccttggaggagttgttaagttaaatatctctgtattatgacttgaaggggtgtgactcctttttgtctgagccctgtcgtctcttgatcaggagaaggatacatccctgtatcgaccagcgctggaggaattgcgaaggcagattcgttcttctacaacttccatgacttcagtgcccaagcctctcaaatttctgcgtccacactatggcaaactgaaggaaatctatgagaacatggcccctggggagaataaggtaaaactgtttcaaacctggtggaggcctagtttaggaattcctttttacccagatcatggggggactcattgtgagtcacaggaagcctgatagacctaagccgtgatctatttgagcagagttcatcacagtcaaaatatctacagaagagctgaaaggaaggtcagcttctcagaagacactgtttctgtcatgtgtattggactttggggtttcattagcatggtctacttttaacgtatgtttaaccttgatttttctcttttcttctatcccatatacattcatttatctctaaaatatgttccacattcagtcacttctctgcctgctggtacaaccctaatcctggaaatgttcagtttttgcatgggttattgcagcacctcttaactgatgttgttgcttttgtgctttgttcctacacagtctgtctctcatgtagcagctatcgtgatctttctcggttataggtcttttctgcttaagaccttttaatagtttataattgcaattaaagtaaaattgagagcctccatttttttccactttatccctcatttatcacccttcagctgtgttagtttaaaaggaagacagtggctgggtgtggtggctcacacctgtaaccctagcactttgggaggccgaggggtggatcacctgaggtcaggagttttagaccatcctggccaacatggtgaaaccccgtctctactaaaaattaaaaaaaaaaaaattagctgggtgtggtggtgggcgcctgtaatcccagctacttaggaagctgaggcaggagaatcacttgaaccccggaggcagaggttgcagtgaaccgagagcacaccattgcactccagcctgggcagcaagagcgaaactgagtctcaaaaaaaaaaaaaaaaggagatagcaacaacaccaaccttggtttttgtgaggtttagcttacataacatgttaaatttctagtacagagattggtatgtagttagttcagtttcggagacaatgatcttgattccacaatgcatgctccctttatgctggactgctgggtttgacttcaaagaactcttttctttatagcgttttgctgctgacatcatctccgttttggccatgaccatgagtggggagcgtgagtgcctcaagtatcggctagtgggctcccaggaggaattggcatcatggggtcatgagtatgtcaggtaagatctttcttcttgggaatccgaagggggctctgaggctctgagataattcagaattttcttgtggagtacaatctgtcttggagcatcagtgtattgaatttcccagacgctggattccttgacccacagagaagtgcttcccctgaagctgtgctctcttaatcgtctgggactatctgtaggcatctggcaggagaagtggctaaggagtggcaggagctggatgacgcagagaaggtccagcgggagcctctgctcactctggtgaaggaaatcgtcccctataacatggcccacaatgcagagcatgaggcttgcgacctgcttatggaaattgagcaggtggacatgctggagaaggacattgatgaaaatgcatatgcaaaggtctgcctttatctcaccaggtgagtgaacatggtagggaagggtggcaggcatgccctcctcagcacctctctctcaattgcgcctcctctattttcccagagcatttgctcaagcatagcatcacgctgtagttaatcttttgatgtgtgtgagtttcttgaggacagagactttgtgtcttcttagtagttctaacatctagcacagtgcctggtgtatatagtagatatttattatttattttgggtaagtgaattcatggggaaaatgagtgcctgggactttctgaattctttgttacttttacttttgtagttgtgtgaattacgtgcctgagcctgagaactcagccctactgcgttgtgccctgggtgtgttccgaaagtttagccgcttccctgaagctctgagattggcattgatgctcaatgacatggagttggtagaagacatcttcacctcctgcaaggatgtgtatgtagggaagaagctggcaaagagataagcttacgaataggacacttgcataaagagctgggacttgtagtttctggttagggcttgaggggttttcctgtgcccttagtggacagtgatgagcagatgtacgggctctctccacagggtagtacagaaacagatggcattcatgctaggccggcatggggtgttcctggagctgagtgaagatgtcgaggagtatgaggacctgacagagatcatgtccaatgtacagctcaacagcaacttcttggccttagctcgggaggtgagactgcccttttttcatcaaggccttttcgtcataattctacctgccatttcacctccctgactctacctctgactagactctccttgattagaattgccattcagtgggatagcagaagggacagctgggggagttctagggaagcaattgtgaccctctgacttctcttcagctggacatcatggagcccaaggtgcctgatgacatctacaaaacccacctagagaacaacagtgagtagccctctctgtgtatgggatttgggggattgtaggtatgccccttgtattgggagtgatggcttggccaacatgcttatcctatcgagctcagaatcctcatgaatctttttcaggtcactgcttgggggggtataggtagaggatactaagggactagctcagaaccagagaccagttgccatgctgtgtttctttcctgtcctacctgaaaccttctttccttacttttcctctccctcctgttgcagggtttgggggcagtggctctcaggtggactctgcccgcatgaacctggcctcctcttttgtgaatggctttgtgaatgcagcttttggccaagacaagctgctaacagatgatggcaacaaatggctttacaagaacaaggaccacggtataattctgttcctgctttgtcttttgttttgctttgatcacttcttttgtcctcttggagtcataagttatctgacaagggatccaccatgcagttctttggagagctctttataataacaggatcctcaggatagggccattttaagactaatagattcttccctggtataggaatgttgagtgcagctgcatctcttgggatgattctgctgtgggatgtggatggtggcctcacccagattgacaagtacctgtactcctctgaggactacattaaggttggtctgcatacagcctgctcatggggacttccccgttccatattctagtgcctagcagtgcctctctttcactgatgaggtctgcccagtttttaactctagttaataagggtgctgcagtgaggcccatgttgcatcctttgcggtgaggaagatagagtatcctgagtgaagaatctgtttgctctttgtagtcaggagctcttcttgcctgtggcatagtgaactctggggtccggaatgagtgtgaccctgctctggcactgctctcagactatgttctccacaacagcaacaccatgagacttggttccatctttgggtaaggttcctcgcttgtctttctggtagtgctcagcctgtacactctggagaacaggaactgggcccttttcacccatattgccaagggctaccactgtgcctattgggtatctggctcttggtgaatgtttgttgaaatggtgaatgaatgaccgattctccttttgttcttttcttgctgcatcgttgggtatgtgttggggaccgcctttccatggcttttgcaggctaggcttggcttatgctggctcaaatcgtgaagatgtcctaacactgctgctgcctgtgatgggagattcaaagtccagcatggaggtgagtagaggctattgagcatttagagtaagtagggaaggtgctttgagtcttactttctgtgataaataatgaaaaagaagtaagtgtgtgcatgtgtgcatacatgtacatgcctgttggtgtgtattgaggggcgtcacctcagtgaaaccccttgatctgggattctaagcctctggtggttttaaggctaaagagttaacattttaggcctggcacggtggctcgtgcctataatcccagcactttgggaggctgcagtgggcggatcacttgagcccaggagttcgagaccaacctgggcaagattgtgaaaccccatttctaccaaaaaataaacagaaaaattagccgggtgtggtggtgctcgcctgtagtgccagctactagggaagctgaggtgggagaattgcttgaacccagaggtggaggttgcagtgagctgagatcgcgccactgcactccagtctgggttacagagtgagaccctgtctttaaaagaaaaaaaaaattaacattttagtgttgagttctgtcccttggaatctctgagaaactacttggactagagtgaagtgtaacttaacacagcctggggttgatgattctccttagtattgtagtcattggtcagccttaaatgttcatacttgtgcagagtcattaatggataaatacagcatggtggctagtggcatagatttagagtcagaaagacttgagttcaaatcttgccacctctgcttataagcagtgtgatcctgaacaagtaattcaatctctttaggccgtatttttctcatccataaaaggggataacagccaggcactcatgcctgtaatcccagcactttgggaggccgaggtgggtggatcataaggtcaagagatcaagaccatcctggccaagatggtgaaaccctgtctctattaaaaatacaaaaattagctgggcgtggtggcgcgcacctatagtcccagctacttgggaggctgaggcaggagaatcgctcgaacccaggaggtggaggttgcggtgagccaaaatcgcgacactgcactccagcctagcgatagagcgagactctgtctcaaaaaaaaaaaaaaaaaagcagtgcaggggataacctcaggatctgtgaccttggggctgtcacaagggttaaatgtcaatagtatgtaaaacagttggcctagtggctggcatatagtatatactcaatgaataatgactactattgttattttgatattatgaactaatgttattagggagaatatcttgcagtggactgtaggaataggctatcttgaatcaagacataaatattttaataacttactctgtgtaatactgattttcctacctctaggtggcaggtgtcacagctttagcctgtggaatgatagcagtagggtcctgcaatggagatgtaacttccactatccttcagaccatcatggagaagtcagagactgagctcaaggatacttatgctcgttggcttcctcttggactgggtctcaaccacctgggtgaggggatgtttctatttgggcaaagagctgacagtaactggatacaacagggagggtttatgtgtcaggctgtgctggatggaggcaagtatcctctgaccccttgaatctgtcctgtagggaagggtgaggccatcgaggcaatcctggctgcactggaggttgtgtcagagccattccgcagttttgccaacacactggtggatgtgtgtgcatatgcaggtctgtgtctttatgagtctgtcttgtgcttccccagtgactcctcacttctttcttggtccttattttcaggttgtttctcctttctccttcattctgatctgctctagattctttagacttctcctgttttccaaagcttttccttggtaacttctcatttctgtccattctccctcaccaccctgacgcaggctctgggaatgtgctgaaggtgcagcagctgctccacatttgtagcgaacactttgactccaaagagaaggaggaagacaaagacaagaaggaaaagaaagacaaggacaagaaggaagcccctgctgacatgggagcacatcaggttatatgggcagctgggcacttgcagagaggctgtgagaagagataagcatataggggaggctgggtttggtttttgctttagggcctctctgggtattgccatgtattgaaatagcgtgtgactgggttctgtatgtaaggggtaaaggtgttccccacaggatggctttttattttcagatgggacttgagtcaagggtgactgttttttattccttgagcttaatgggttctgctctctcttcaattgcagggagtggctgttctggggattgcccttattgctatgggggaggagattggtgcagagatggcattacgaacctttggccacttggtgagtatagcatgaagaaaattggaatatactggttttgatggcctggggttccccagggaagatttttctgatgggttttcttggtggagagctggtctttttgctgtgccttttctttcttttttcttttcttttttgaagcggagttttgctctagagtgcaatggcacggtcttggcccactgcaacctctgcctcccgggttcaggtgattctcctgcctcagcctcacaagtagctgggactacaggcacatgccaccatgcccagctaatttttgtatttttagtagagacagggttttaccatgttggctaggatggtctctatctcttgacctcatgatccacctgcctcggcctcccaaagtgctgggattacaggcatgagccaccatgcccagcctgctgtgccttttctacagaagttaaggcccccttttacccatcagtccactcctgtaatggaatttgtttttactgcattccgccttactgttgtattttcttggatcatcagctgagatatggggagcctacactccggagggctgtacctttagcactggccctcatctctgtttcaaatccacgactcaacatcctggataccctaagcaaattctctcatgatgctgatccagaagtttcctataactccatttttgccatgggcatggtgggcagtggtgagtatccggcagaagaaggtcataaacagattgggggaagatttgaagccccttttttcacttctgtaatgcttaacatttccaggtaccaataatgcccgtctggctgcaatgctgcgccagttagctcaatatcatgccaaggacccaaacaacctcttcatggtgcgcttggcacaggtaaagaatagaactcctccacagagcgtgccggggaagtatctgtggtgatggaaggaggaacatggagtgttggcccaggaggaaagatgtgaccaagtgggagatttctgtttggctgggttaggcgatgtctcctcagtggtaactcctcacctctacttccctctgtttttttcagggcctgacacatttagggaagggcacccttaccctctgcccctaccacagcgaccggcagcttatgagccaggtggccgtggctggactgctcactgtgcttgtctctttcctggatgttcgaaacagtgagttcctgtcagaaattttatatcatagcatgcagggctctgactccaccctttccagggccactttgataatttaggttcaagaccccagtttagctctgtatcgctctaggtttctgagacaggctttgggcctgtgacatgagactttcatcacccacacttttgatctggcccaaagagatttgagggtgatgtgcccagcgtctgctcctaagtcactggggaaatgcgattttcaagtctaagggctgtaagcaaagtgaggtgggggcgtctctggttcgtagtagggtgtatgaggggaggagtgtggattcagtcgtatgactgacgggttaaagggtcagcgctgaggtgggctctcaatgtttctggccaggcctgtctttttgtctcttaactttttgtcctgtctgcttccctcagttattctaggcaaatcacactatgtattgtatgggctggtggctgccatgcagccccgaatgctggttacgtttgatgaggagctgcggccattgccagtgtctgtccgtgtgggccaggtgagaggctgagtagaggggagggctcaggctgtattctcaaactggagaatgtacatatacttgctttgctgaaactggcgtgggcggtggcttgtcgctacttttccatctctcttttcaattttcttaccctacaggcagtggatgtggtgggccaggctggcaagccgaagactatcacagggttccagacgcatacaaccccagtgttgttggcccacggggaacgggcagaattggccactgaggagtttcttcctgttacccccattctggaaggttttgttatccttcggaagaaccccaattatgatctctaagtgaccaccaggggctctgaactgcagctgatgttatcagcaggccatgcatcctgctgccaagggtggacacggctgcagacttctgggggaattgtcgcctcctgctcttttgttactgagtgagataaggttgttcaataaagacttttatccccaaggtctctctgtgtctgttttctggggtgtcatggctggagtctaaactagagtaaggagtggaagtgagagggcattgttaggagcaacgctgagtttaggttagcagcactgccctggatggaaagaactgagccccttccctcccctgggtggaaaaaactaagcccctcctttctaatcatcttctctttgcattttcttagaacccttgagaagccaataaatgtaatggatcttctttttgttttgttttgttttgtttgagacagagtcttgctgtctcccccaggctggagtgcagtgaggcagtctcggctcactgcaacgcctgccttccgggttcacgccattctcctgcctcagcctcccaagtagctgggactacaggtgcctgccaccacgcccggctaatttttgttttttgtttttgtttttttgagatggagtctcgctgtgtcatccaggctggagtgcagtggtgcgatcttggctcactgcaagctccacctcccgggttcacgccattctcctacctcagcctcccgagtagctgggattacaggcacctgccaccacgcctggctaatttttcatatttttagtagagacggggtttcaccatgttagccaggatggtctcgatctcctgaccttgtgatccgcctgcctcaacctcccaaagtgctgggattataggcgtgagccaccgcacccggcaaatttttgtatttttaatagacggggtttcaccatgttggccaggatggtctcgaactcctgacctcagatgatccacctgcctcggcctcccaaagtgctgggattacaggtgtgagccaccgtgcccagccaatggatattcttcctaggagacgcaaatacacaaatttttacacaaactcttccaaataacttcagggggcttgtggatcctgtaaataaccccccacactcaccctccaccaccaatacaccctcttcaagcctatcatcttctgaccttgggctaaggatgcccaagagtgggcagcctcatacttttctaacttgacttacgtgctactgaatgaaaaggacatctttacctcccgcaaccatctgtccctcttgggaggctgctatgaggaatttgatcatgttaacatctacttctaggatgtccttgtagaaagtggattcaagaaggcttgaccctcagcctcccaagcaggtaaggtagggctacaggtgtgtaccaccacttctggctttttttttttttttttgaaatggtctcactcttatcactcagtctggagtgcagtggcacagtcatagctcactgtagcctcaaactcctggactcaagtgatcctcctgactcagcctcccaagtagtaactaggactataggcatgacccaccacagctggcctacttttatttttgtggaggtgggggttttgctgtgttgcccacgctggtctcaatctcttggcctcaagggatccttccacctcagctcccaaagtgctgggatcacaggcatgagccagtatgcctggctatttatttatttatttattttgagacagagtcgtgctctgttgcccaggctggagtgcagtggcgtgatctcggctcactctgcgtctggggttcaagagactgtctgcctcagcctcctgagtagctgggactacaggcatgcgccaccatgctctgctaatttttgtatttttagtagagacggggtttcaccatgttggccaggatggtctcgatctgaccttgtgatccacctgcctcggcctcccaaagtgctgggattacaggtgtaagccaccacacctggcccagttattttattactaaatttttttagagacaaagtctcactttgtggcccaggctggagtgcagtggcatgatcatggctcactgcagccttgaacttctaggcttaagtgattctcccacatcagcctctcaggtagctgggattacaggcatgagacatcagcaattttggattgagtcatcttggcagcctgtataaaaaggttgaaacaggattaaggaatccctgttgagcccctttatggttcctgccataatcttcaagttagcatgtgtgatgtgatgagcctctgttattatataatgtggatatagtagttgccttacctgatttccagtggtggtgatgttagaataaaaagtgatttgtaaactaaaaagaatgattctctcccaaattgtgatttaggtgattgtgctttagaataagacagtttcatagtggcttttaacctttcacctttagttcttcattcatcagtgaatagcagtggagccttactctgcatcagacattcgtctaatttatggggatgcaaatacagaaaaaaacccctatgctcaaaaagtttaatgaaatgatgaaaacaactgtgatcgatacttaccagggtgtgaacaaggtaccctggtatcactgagatggggcctaagtgcctggggcaatcgggggactttgaggaagcttatatccttagaggaagataagtttgtacagaggaaaagagggcagaatatagctaagggagtagcaaaggcaagaaggaggaaaagctgttttcagaaacttacagataatttggtttggctaaatgtataggggccagggaaaagggtggtaggagatacagctggaaattcaggctcagactaggtttacaagagctttgttgtgctaagaatttgacagtatctttcaatggggcccactgaatgagagcagaaaagtgacatgatcagctatctgggtgagaaagctaaccctggaggacaggagagcaggcaaggaaaatgaatgcttgaactaaggcagttgaaatggggacatagggaagggtagaatagttattttttaaaagataagatcaataggacttgattttgatccaaataccagtaagacctggtgtctgattagatgtagtgtgtggatggagaaggaatataggatgaatcccagattttcaggttaggcactatctattacgtaagcaacaatatatttgggggacttgattgagtagggaaagttaacaaattctggccaggtaataagtatcagagtttggatgaaaactcaagcaatctgacctgtggatttggctgtagatgatggtcccttctggcctctgtcagctttttctttttttttttgagacggagtttcgctcatgttgcccaggctggagtgcaatggcaggatctcagctcaccgcaagctccacctcccgggttcaagcaattctcctgcctcagcctcctgagtagctgcgattataggcatgcgcaaccatgcctggctaatttttgtatatttttagtagagacggggtttctctatgttggtcaggctggtctcaaactcccgatctcaggtgatccgcctgcctcagcctcccaaaatactgggattacaggcgtgagccaccgcccccgaccggctgtcagttttaagattacttctcttctgtccttattcttccatccttacgcttttgcccctccgtgggagtgtctgctctttttatattttatttcatttatttatttatttatttgaaacagagtctcactctgttgcccaggctggaatgcagttgtgatctcaggtcactgcagcctccaactcccaggttcaagcgattctcctgccttagcctctccactagctgggactacaggtgcttgccaccacatctggctgatttttctatttatagtagagatgaggtttcaccatgttggccagggtgctctcgaactcctgacttcaggtgatctgcctgccttggcctcccaaagtgctggaattacaggcgtgagccaccgtgcctgcctttattttttatttttatttttattttttgagacagagtctcactgtcatccaggctagagtgcagtggcgcaatcttggctcactgcaagctctgcctcccgggttcaagcagttttctgcctctgcctcctgagtggctgggactacaggcgcacgccaccagacccgtctaattttttgtattttagtagagatgggggtttcaccatgttggccaggatggtgaccccgtgatccgccctgaccccgtgatccgcccgcctcggccttccaaagtgctgggattacaggcgtgaaccaccgcgcccggcccatgatccttttaaacgacaaatctcatactacttgcctagttagaatgtttctaactttttaaacgacaaatctcatactacttgcctagttagaatgtttctatccttttaatttcctttgttataggcctttcaaggacctaatctaaattcttttcaaagcctgcataattcgtgttgtatcacgatttacttaggcaggactgagtctttaatttctttttttctttctttttttttttttttgagatggagtctcaccctgtcgccaggctagagtgcagtggcgtaatttcggctcactgcaacctccgcctcccgggttcaagcaattctctgcctctgcctaccgagtagctaggactacaggcgtgcgccaccaggcccagctaattttttgtattttagtagagacggggtttcaccatgttggccaggatggtctagatctcctgaccccgtgatccgcccgcctcggcctcccaaagtgctgggattacaggcgtgagccactgcgcccggcccatgatctttttaaactacaaatctcatactacttgcctaattagaatgtttctatccttttaatttcctttgttattggcctttcaatgacctaatctaaattattttcaaagcctgcataattcgtattgtatcacgatttacttaggcaggacggagtctttaatttctttcttttttttttttgagatggagtctcgccctgtcgccaggctaggctagagtgcagtggcacaatctccgctcactgcaacctctgcctcccgggctcaaacaattctcctgcctcagcctcccaagtagctgggactacgggtgcgccaccacgcccggctaatttttgtatttttagtaaagacggggtttcaccatgttggccaggatggtctcgatctcttgacctcgtgatccgcccacctcggcctcccaaagtactgggattaaggtgtgagccaccgcgccccgcttattttttttttttttttgccgagactttgatttcagtttctcagccctcaaccagcacttcgccttgtacttagcatgcactcaataaatggttgcttaaaatatgaatgaactaaagaatcgcggaacagagagaaacacagaggggaatcggtctgggagtttcaaagttcgggaggggacacgggggcgggctgtggctgtcacgtgacggggcgggggcaaatcccatgtgctcggcggcgcagatcgcccggcgcggctccgccccctgcgccggtcacgtgggggcgccggctgcgcctgcggagaagcggtggccgccgagcgggatctgtgcggggagccggaaatggttgtggactacgtctgtgcggctgcgtggggctcggccgcgcggactgaaggagactgaaggtaaagccgccatgtccgggcccgacccggcccccccaccccctccccccgcatccgccgccatccgggccgggaccggccaccctgcgccgccgccccggcgccctggccccgcggcccgacccagggccccggcccgccagggtcccgatccccggcccacgtgtgcctggcccggccgggcctggctgctgggtgggggtggggagcgcagggccggactatgcgggccccgcgggctggtagggcgccgggttcgtcgccgcgaaatgccacctcggcctgacccgaggaggcccggcagcccacgggcgcaggcaccacggctcccggcccgccgccccctccccccttcgcggccaggccgccgggaagtgacacgttgttctttggcactggcccgcgctgcgcagggagggcgcaggggagggaggcggtggcggcgggcagggaggagcccccggccccgcccgccctccgggccgaccctcacttgcctgaaaccggctcctcgacggccgccgcccgcctggccttttagggcctgactcccgcccttcctggcctacactcctgggcggcggcaggcctagcttctggcccagtgcgggttccccggcggcaggcgtatcctgtgtgcccctgggccaggcccgaacccggtgtccccgggtggggggtggggacgccacggccgaagcagctagctccgttcgtgatccgggagcctggtgccagcgagacctggaatttccggtctggttggtctggggccccgcggagccaggttgataccctcacctcccaaccccaggccctcggatgcccagaacctgtaggccgcaccgtggacttgttcttaatcgagggggtgagtgaggggtctgtttcagtaggtcaggggttggttggaagtgatgcgggtttgacagcatgttggtggggacaggctgtatcttttctgcttcaccctcttggcatctctgggactccgtatgggacccagcccttgcatcaaccctttcaccgccccatttgccttaagcttgggtcccttcctcttcctgagcgccactctttcccaacaggtgctggggggaccctgatgtggcaccaaatgaaatgaacaaagctccacagtccacaggccccccacccgccccatcccccggactcccacaggtaattagggaggaattagcaggggtgggggtgggggagaccaggcagtctccagcctctggatcttcctacccccatctgtgtcagggcaaagtgcagccgcctgctgccaaattgagacagggcccctgggctgtccccgggggctgtcacggggagggggtatgtggattgttaaggctcttgccgcagatctgctccccttatttcaccagcttgggtttctgccccacctgggcttcccctcttgctgaactctggtctcccctcttcagccagcgtttcccccggggcagacagcgccggtggtgttcagtacgccacaagcgacacaaatgaacacgccttctcagccccgccaggtgaggggctgtggggaggggagtaggggacctgggtgggagcagtggaaagctttggccagtttaggtctaggatggaaactggaggccccatacctggccttaatcctctgtgttctttcatgcggctctgcgccttgccctgttgattactcacggtggctggtcccttggatagtatgttgtcaatgagggtggcattactgggatcctagtgcctctgagaattgggggcagtgctttgggccctgctgccagctcttgctttcctatttgctccttttaccggaggctgctattgctctattgctctctctgctttctctttggactgtggtgaggtaaacactccagctggtccttgcctttctctgttccccagcttcttccttactaagtgggaggattcttgtcctgtcttattgccttcattccctccccccgccatcaccttgggggtaattctcttctttcctatccccatgtgctctcagggaggattcaggtctctgcaggtaatatccctttcccaaccctggacagtcttctggtctcatccttaccctccaccctagtcaggggctagacacagggaatggggatcttcagggtagtgacttgtttggtgtccaggttctcagttggaggccgagtgatgcatgttaggggctacatcttgaagaacgcgcatctggggactgggatgctgttgcatgttatggttagctcctcattacatgctggtggagcagtgcatgctggggatatgttgcccgaaagggccttacttaggcatgatgcatctcggtgttaggaagcctctgcagaggggtagtttggtagaggtgacgtgtgtatgcatggcagtgagagagtaaatctctgcaggatgcaaagtgtacatctgaatttggaggtttggagggcatgtgtgtgtacaagaagccgcttagccatttggtcaagtggtcttggaaggattggtcgccatgttctgaagcccacagtacttctttccaggctatagagacattgtggagtggcaattttttgtccacttccttctctttacaatgccaactgctttcctccctcctgacagcacttctaccctagccgggcccagcccccgagcagtgcagcctcccgagtgcagagtgcagcccctgcccgccctggcccagctgcccatgtctaccctgctggatcccaagtaatgatgatcccttcccagatctcctacccagcctcccagggggcctactacatccctggacaggtgaggctgggggcttggagcctagaagccacagacccctatacctctcacttaactcaccctgaccctccagttccattgcttttccagaggtgggacttccttctggtcattgcccagagttggcttgtcttgtcttgacctatgttctttttggagtctgatatggaactcatagctccctcaactccttctctccctctcccccttccccaccaggggcgttccacatacgttgtcccgacacagcagtaccctgtgcagccaggagccccaggcttctatccaggtgcaagccctacagaatttgggacctacggtaagcaggggagggagtcagaggtgagaacaagcccaagggagcatctaaactcatctgctgatttctaaagcagaagacccttcccaggcttggcttctggtctaaaaatgataaggttaataggtggtagggattggtgcttaatatttaactggtgttgattgtggggagaaaatttgattttattgccaggagagttaagagtctttcccacatcagggaatgtaggatcaggcaccagcctgagagcctattagtaggctttccctgtgacacttcttccatggttgggagcccatgtaatgcaaatttgggaggtttttgtagctattttttatttatgttctagggaaggattagtctgttctttatggcagtggcttccaagttttttgatcacctatcaggaaaagttttgagtatgaatctctcatacatgtatgtttttgtttatatgtatgcaaaatttaaacaaatacacttgtgcttgtcaaaaacaagtggaatttagggatgaaattaaagaatgtgcccggatcttgcttgtaatcccagcactttgggagtcaggaggactgcttaaggccaggagtttgagaccagcctgggaaacttagtgagaccctgtctctattttaaaatttgaggggggctgagcacggtggctcacgcctgtagtcccagcactttgggaggccaagacaggcggatcacttgaggtcaggtgttcgagaccagcctggccaacatagtgaagctccgtctctactaaattttattgttattattttaattttctttttgagacggagtctcgctctgtcacccaggctggaatgtagtcgcacagtcttggctctctgcagcctccgcctcttgggttcaagtgattctcctgcctcagcctcccgagtagctgggattacaggcgtgtgccaccacacccagctaatttttgtgtttttagtagagatggtgtttcatcatgttgaccaggctggtctcgaactcctggcctcaagtgatccacctgcctcagcctcccaaagtgctgagattataggcgtgagccaccacgcctggccctgtctcaactaaaaatacaaaaattaggcctggtgatgcactcttgtaatcccagctattcgggaggctgaggcaggaggatcgcttgaacccgggatgtggagattgcagtgaaccaagattgtgccactgtattccagcctgggcaatagagtgagactccatctcaaaaaaaaaaaaaaattaaggggaaaaaagaactcacccactttggagatagtttgctttaaggaattaatttttcttcatcttgagcctagttcataatgttactttgtttctttgcccctttgtaaagggctggagacaggaactagactcaagttaaatggaacagggttggcagatctctttctctcattaccagccaaagacctggttctgtttcaggttcagagtatgtgtgtacatgttgatagcgggtggggtacacacacgagagtaacttgtacggtggaaggacagacataagtcctcctggtcactggtgtgtggtaggaaagagtgcctgcctacgaggggtgtgtgtgtgtgtgtgtgtgtgtgtgtgtgtgtgtgtgtttgtgtgtgtgtgtgtgttaggaattcttgtaaacgcagttcagactggttccccagctttgacagacacctaattccctgggggaggagggcagggcagggcaaggcaaggggccggctgtgggtggtgagaggttttggggtgggaggtgtcaggcaggcattagtatatggttgggccctgacgctaccaccattcttctccgtcccccctcccccaagctggcgcctactatccagcccaaggggtgcagcagtttcccactggcgtggcccccaccccagttttgatgaaccagccaccccagattgctcccaagagggagcgtaagacggtgagtagcagtgaggggctccgggacatctgggaaggggagaatcaaggtcaggtgctgctgggacattgtgccggaaagagcagtgacttgaggaggaaggagctgagagtgggcagagaatggtgtctgtggagggctcaggttctttgtaagatgctaagatttcagcatagaagcaggtcatgggaagactgaagtgcctagcgaggaagttcctgcgagacctgggtgctggggggttggaagaactatgcttggttttgggtttctagtggcttgccttggaaatggtttgttttctgtggccccagcccccattcccccctgcccccccagtcctggaagctctcaaggcctccgcctctgctcagtcctcaagccctgggcgtggtgcccagaatagggtgccagagctggggaagccgctgagtcaccctggctccacctactggatctgggccctgcccccagagatcaggcacactagccacaagtgagccgattgggttctagatgggggtcctgggccccagggtgtgcagccactgacttggggactgctggtggggtagggatgagggagggaggggcattgtgatgtacagggctgctctgtgagatcaagggtctcttaagggtgggagctggggcagggactacgagagcagccagatgggctgaaagtggaactcaaggggtttctggcacctacctacctgcttcccgctggggggtggggagttggcccagagtcttaagattggggcagggtggagaggtgggctcttcctgcttcccactcatcttatagctttctttccccagatccgaattcgagatccaaaccaaggaggaaaggatatcacagaggagatcatgtctggggcccgcactgcctccacacccacccctccccaggtactgtctgcttttcgagtgataccctggctgggatgtctgttctgccctggactcccaagtccctggatcttttctttcaactaagggatttatttccctgctttcctggatttctaggcagagctaaagtagaaatggctctagtaaagaagggttgtgggactcttcagtgcaaacttggtaaccctttgtgtcctgcagacgggaggcggtctggagcctcaagctaatggggagacgccccaggttgctgtcattgtccggccaggtaagtaagccggtgggacggagcttttatggggaaagggaatgttaacagttaaatgctgaggtggtggagtgacttgaactgggtaccagagaatgatgacttagatttcaggttgtgggattttgagggtgaattgggttttggatgaaagtggaagtatagcttaggtggggagaagatgatgcggggttattaagttgggaatgcctgggctggaggatggggaggaacaacagcagttaagcacttgcctttagttgctcattcttccttcctatggtgcagatgaccggtcacagggagcaatcattgctgaccggccagggctgcctggcccagagcatagcccttcagaatcccagccttcgtcgccttctccgaccccatcaccatccccagtcttggaaccggggtctgagcctaatctcgcagtcctctctattcctggggacactatgacaactatacaaatgtctgtagaagaatcaacccccatctcccgtgaaactggggagccatatcgcctctctccagaacccactcctctcgccgaacccatactggaagtagaagtgacacttagcaaaccggttccagaatctgagttttcttccagtcctctccaggctcccacccctttggcatctcacacagtggaaattcatgagcctaatggcatggtcccatctgaagatctggaaccagaggtggagtcaagcccagagcttgctcctcccccagcttgcccctccgaatcccctgtgcccattgctccaactgcccaacctgaggaactgctcaacggagccccctcgccaccagctgtggacttaagcccagtcagtgagccagaggagcaggccaaggaggtgacagcatcaatggcgccccccaccatcccctctgctactccagctacggctccttcagctacttccccagctcaggaggaggaaatggaagaagaagaagaagaggaagaaggagaagcaggagaagcaggagaagctgagagtgagaaaggaggagaggaactgctccccccagagagtacccctattccagccaacttgtctcagaatttggaggcagcagcagccactcaaggtaaggtgtggttggacggtagaggtagggcgggctaggggatatcgttccttgccctccttgatgaccgcccatttttgacatgtttctgggtccctgcaatggaatctaagaactagattaaggacttttaagcctaaaaagggtgatgcaaaggggaaatactgttctttggctgctttctatttcccagggattaagggtactccttaaattattggcaaagatccatgcttttatttatttatttttaattagtggcagtatctgtgccaaagaggagacggaaaattaaggagctaaataagaaggaggctgttggagaccttctggatgccttcaaggaggtaagggagcagaaaatgggaggggagagggccaagttgaggtatggagcagtggtcattctgcaaccaaaactggatgttctgttgttctaggcgaacccggcagtaccagaggtggaaaatcagcctcctgcaggcagcaatccaggcccagagtctgagggcagtggtgtgcccccacgtcctgaggaagcagatgagacctgggactcaaaggaagacaaaattcacaatgctgagaacatccagcccggggaacagaagtatgaatataagtcaggtatgctgaagaaagggttgagaatggcttgagttttcttattagggccagaggaggcagtatgattgcttcattctgttttccttgcagatcagtggaagcctctaaacctagaggagaaaaaacgttacgaccgtgagttcctgcttggttttcagttcatctttgccagtatgcagaagccagagggattgccacatatcagtgacgtggtgctggacaaggttagtggcttcagttggggaggggacgataagtttgtgctggatggattggggaggagcctgaggtcctgaaagagtagtcaaccgctctagcctgcttctgagaccttttcctgtcctctttgcaggccaataaaacaccactgcggccactggatcccactagactacaaggcataaattgtggcccagacttcactccatcctttgccaaccttggccggacaacccttagcacccgtgggcccccaaggggtgggccaggtggggagctgccccgtgggccggtgagtggggctgggtaaagtggcaggtgggcaaggagtgggagtggatgattccgtgtctcagtgcccgcggggaggggtttgccctggaggcgtgtagtagtggtgtcacatattgtgctgactagttccatgtcccctcttgtcttcatcccttgcttagcaggctggcctgggaccccggcgctctcagcagggaccccgaaaagaaccacgcaagatcattgccacagtgttaatgaccgaagatataaaactgaacaaagcagagaaagcctggaaacccagcagcaagcggacggcggctgataaggatcgaggggaagaagatgctgatggcagcaaaacccaggtactggcaagtcctgcttttggtctctctccatttcttctccaggtctgccatctgtgccctctttgcttctttttgtccttatcactagcatctgtcatgcctaagtccccaccaccctctcctgtccctcccaacagcctgttctgagaccctcactggaactcttgtctcttctccctccaggacctattccgcagggtgcgctccatcctgaataaactgacaccccagatgttccagcagctgatgaagcaagtgacgcagctggccatcgacaccgaggaacgcctcaaaggggtcattgacctcatttttgagaaggccatttcagagcccaacttctctgtggcctatgccaacatgtgccgctgcctcatggcggttagtttccagtgggttctaaatctaatggtctggttgcccattcctattcccaagactccttgagtccagcttcttggttcccctccaacttgtgcctcttccagctggaaggaggcagagctggggccagagatcttcctgggtcaggtagttaaaggctcttggagggccttccctgcccaggactagtcttgagtgtgacattctctctgacctacagctgaaagtgcccactacggaaaagccaacagtgactgtgaacttccgaaagctgttgttgaatcgatgtcagaaggagtttgagaaagacaaagatgatgatgaggtttttgagaagaagcaaaaagagatggatgaagctgctacggtgagagaaaacccactatcgattccactcaccacttacctccttcccttacccagatgctactcagctgtagaatttggaatggaggtagtggtgtcttggggatttctctggctcaggacgttttttttcctttttgagacagtcttgctctgtcacccaggctggagtgcagtggtgtgatcttggctagcctccacctcctgagttcaagcgattctcctgcctcagcctcccaagtagctgggattacaggcatgtgccaccatacctggctaatttttttgtatttttaatagagacggggttttaccatgttggccaagctggtctcaaactcctcctgacctcaagtgatccgcctgcctcagcctcccaaattgatgggattacaggcatgagccactatgcccagccagccggcctcaggactgagtgcttattgctaggtttggatatccaggtagaaaagggttttagccgagtggctggttatctttttgacacaatccctgtcctgtgaatggcaggcagaggaacgaggacgcctgaaggaagagctggaagaggctcgggacatagcccggcggcgctctttagggaatatcaagtttattggagagttgttcaaactgaagatgttaacagaggcaataatgcatgactgtgtggtcaaactgcttaagaaccatgatgaagagtcccttgagtgcctttgtcgtctgctcaccaccattggcaaagacctggactttgaaaaagccaaggtagaggtccttgcatctggagggggatgggctgaagcatatgtggggctcactgagcccacaatgatggggcggaaggcctgaggaggggtggggcctgcagttataggtgggacatgagaagttcctggtctgatgcctttctccttcctagccccgaatggatcagtatttcaaccagatggaaaaaatcattaaagaaaagaagacgtcatcccgcatccgctttatgctgcaggacgtgctggatctgcgaggggtgtgtgtccccctcctccccactgccagcctgctgcctccagtttctgacactgccttgtcttgccttccctgacatcatcgtgactggccctctgtctccacagagcaattgggtgccacgccgaggggatcagggtcccaagaccattgaccagatccataaggaggctgagatggaagaacatcgagagcacatcaaagtgcagcagctcatggccaagggcagtgacaagcgtcggggcggtcctccaggccctcccatcagtgagttccaagctgggattgagaagggagcagtgaagggaccgggaggttatactttcctctgatgacttcctgttagtgccacgtgtctgggccactgagacaccatgatggaactgaggatctgaggaagggaggctgggggtggcccaaggggaaggggctgctaggatttattcattattccagtatgcccctctttttgtgtcaggccgtggacttccccttgtggatgatggtggctggaacacagttcccatcagcaaaggtagccgccccattgacacctcacgactcaccaagatcaccaaggtaggggtgtgtgtgggagtgggtgattcagctcaggtttagatcttagtcccttcacttttctaaagttgagaaggtgacagctgaatgtttcctcttagactaactggttggattgctggagacaggactgccagctgtagagggagggtggtactcccattagtctggaccagtgtttggcaaacacacacacacacacacacacacacacacacgtgccagatccagcccattcatacatcccaggacccagtagtggtttttacattttaaagttgcgaaaaatcaaaaagtgaatggtaatttatgctgtggaaattaaataaaatgtaaatgtcagtgtccatgaagttttattggaacacagtcacagcatgcctttatcatctacagctggtttcatgctactgtggcagaattgagtagttgcaatagagactggccctttattaaaaaagattttctgacccctggactgggccattcactacctgtttggttgcatatggtggtgctggccaagggactcagccgggttggacctatgattctactccccttttcttcttcagcctggctccatcgattctaacaaccagctctttgcacctggagggcgactgagctggggcaagggcagcagcggaggctcaggagccaagccctcagacgcaggtatggaggcagtgtcaggagctgggtggttacccgtcagagctcccttgaggacagagccttttctgttagggaggccttcagtacaaggtggttaggcaatgcgggcaatagaggaggtttgtgttgtggttccagggattgaactgctttacttttgggactgggaccaagtgtcctaaactggcaagtaggggataaaatgcaggaaaggagaaaaagattttaatacggattttctgcatccccagcatcagaagctgctcgcccagctactagtactttgaatcgcttctcagcccttcaacaagcggtacccacagaaagcacagataatagacgtgtggtgcagaggtgaggtttcctggacatctttgttattcacactgggggtaccgtgattgggttctggttgttgccataggttggaaatttcttcatacctgtcctggttggagcccttgggttagattggggcatactcattatgctaagaacaaggcccaacagttgctcagcatgttgtgtaattacatgagtgcctgggcagtgcaagtgagtgaaaatttgtctgtctgtcttccaggagtagcttgagccgagaacgaggcgagaaagctggagaccgaggagaccgcctagagcggagtgaacggggaggggaccgtggggaccggcttgatcgtgcgcggacacctgctaccaagcggagcttcagcaaggaagtggaggagcggagtagagaacggccctcccagcctgaggggctgcgcaaggcagctagcctcacggaggatcgggaccgtgggcgggatgccggtgagagtctgggagaggaatggagggaaaggcattggctgccttgggactagctggtccccagctttttgagagctccaaatcttgtttgctgggaagactgaaaagtccctctaatctgtgttctcttcccacagtgaagcgagaagctgccctacccccagtgagccccctgaaggcggctctctctgaggaggagttagagaagaaatccaaggctatcattgaggaatatctccatctcaatgacatgaaagtaggcagtgggagcggcgtgtgattgaggagtgggcagggagggatcatgctggcaggcataggggtccggggtctgggtcagacagtgactggtctcttcctgctgtgccctgcacccctcaggaggcagtccagtgcgtgcaggagctggcctcaccctccttgctcttcatctttgtacggcatggtgtcgagtctacgctggagcgcagtgccattgctcgtgagcatatggggcagctgctgcaccagctgctctgtgctgggcatctgtctactgctcagtactaccaagggtatgaccagcttctctgggcctcccacttatacagacccacaattttctatctcctttttgggacccttggaaccttgcataagagtgtaggttccctggccgggtgtggtggcttatgcctgtaatccctgcactttgggaggccaaggtgggttggattccttagaggatcacgtgaggttgggagttctagaccagcctggccaacatggtgaaaccctgtctctactaataatacaaaaattagccaggcgtggtggcacagtaatcccagctactcggaggctgaggcaggagaactgcttgaacccgggaggtggaggttgcagtgagccgagatcgtgccattgcactccagcctgggtgacaaaagcaaaactgtctcaaaaaaaaaaccaaaaaacagtatgggttccttgaccatcctggtcagcataactttagggggttaagcggggtgaaaaccatctaaggacacagaggtggccttagcttgaaataattgtccccatgtctagaaaatgttcctgggggttccatagttgatgccctagccatgccacgttgccccagaaggagagtggggacctggcctagaatgtcttgactttgaattcccttggcaggttgtatgaaatcttggaattggctgaggacatggaaattgacatcccccacgtgtggctctacctagcggaactggtaacacccattctgcaggaaggtggggtgcccatgggggagctgttcaggtaagtccccctgggtggaattcaggggaggtaaagaccagaggaaaggtggtagggaaatggctgggttggataccctggtttggagggagatggagtagtggtgagagaactgtggaggctgtcagcattaggtttttctcttcttgtagggagattacaaagcctctgagaccgttgggcaaagctgcttccctgttgctggagatcctgggcctcctgtgcaaaagcatggtgagtgagggccaggagtccagagatgcctcccacggtgtggttttggctgtttgctgtggccctgaagcttcatggtccattggtggagtggagtgatggtgatgacaggattgtgttggtacctgggagaggaaatactgaggtgggccatctcccgcacaccagttcctatcatgagttctggccaagactggaggagaatggcagtctaagaccctaggcctgtgattgatgcatttatttattcattcattgaactagggttttgttgatgatcatttatcatatactaagcactagggacacagcaatgaataaaacacaagaaacaagttggtagagaaaaaggaagaaatgggccgggcgcagtggctcacgcctgtaatcccagcactttgagaggccgacgtgggtggatcacgaggtcaggagttcaagaccagcttggccaatatggtgaaaccccatctctactaaaaacacaaaaattagccgtgttgtggcaggtgcctgtaattccacctactcaggaggctgaggcaggagaatcacttgacccgggaggcggaggtagcagtgagccgagattgtgccactgcactccagcctgggaaacagagcaagactctgtctccaaaaaagaaaaaagaaatgacagcttgataaaaacaacagtaaagcgtgacataaaacagttgaaatagagtggagtatcttaagtactgtggggttgcaaaggaatatttgacaatatttgtgacaggaggctttcagggtgctgaagcggctttgtgaaagttaattggtaactagcgaatataaaggtaaagagatggggaaaggtaagttgaatgtggtacttagtggaagtgagaagttggggtgagtgtgtgcagtttcaagggttcagccatctggaacctggaggaatcacacttgggatttaaaggaattgttatgtcaacatcatttaattcttttaaatagacgtgtaccaggacaagttgttttttaacaacaaataagcatattgaactatttgtgtatttcatcaactccaaggtgccatagattataagacattctttatgcgctgttaagaaagaaaagactgggccgggcgtggtaatcccagcactttgggaggcagaggtgggtggatcacgtgaggtcaggagttggaaaccagcctggccaacatgatgaaaccctgtatctactaaaaatacaaaaaaattagctggacatggtggtgcgcacctgtagtcccagctacttgggaggctgaggcaggagaattgcttgaacccaggagggggaggttgcagtaagccaagattgtgccactgcactccagcctgggcgacagagcaagactctgtctcaaaataaaaaaagatatatatcggctgtaagacaacttttagttaaaatgtgaaaaaatgggcatgttttaaaatctgtgaactgcaataatcttgctaagagccagtgccattagtctgttataaagaaaagagtgatgtcttcatagtctattgccccttacagaaaatgcactcagactgctggttttatgaggattttttatttgtgttagggatggggtatatttgtgtcttaagattttctgggtttaggaaacaagcatacttgttagaagttgtcccttcctagaggcccttacatcatttttcctaccctagtgtcatagcactttggtggacaagttctcttttattttattttattattattatttttttgagacagagtctcgctgtgtcgcccaggctggagtgcagtggcgtgatctcagctcattgcaaccctcgccttgggttcaagcgattctcctgcctcagcctcccgagtagctgggattacaggcacccaccaccacgcctggctaatttttgtattttctgtagagacggggtttcaccatgttggtcaggctggtctccgactcctgacctcaggtgatccgcccacctcgacctttcagagtgctaggattacaggcgtgagccaccgcccgctcctgggacgagttcttatttatttgggtggttatttgactgacatctgtgccctgcaccagaccgtaggaatggaagggctttgcctattagtatttctatagcatccttaatgcctagcaagtacctagtaggctttcagtaaatatttgttggattaatgtggtagagctgttgggtccttggagagagagagctttggtaagctgggttggtcttgtgttttccagggtcctaaaaaggtggggacgctgtggcgagaagccgggcttagctggaaggaatttctacctgaaggccaggacattggtgcattcgtcgctgaacaggtttggggatggagttgggttaattctagcatttgaggctggccagtcttctttcttgtctcctgttggcaaccttacctcttaactgcgggccttttccattgcagaaggtggagtataccctgggagaggagtcggaagcccctggccagagggcactcccctccgaggagctgaacaggcagctggagaagctgctgaaggagggcagcagtaaccagcgggtgttcgactggatagaggtaggtttctcctggatatcgataaaggaaaggtagttcttagggtgggggtgggggcagcaagaatgaagactgaagggcccaattcagaatctggggatcatttgtttctcccatacaggccaacctgagtgagcagcagatagtatccaacacgttagttcgagccctcatgacggctgtctgctattctgcaattatttgtaagaggaaccagggagatggaggggcaagggtgggcctgacagacaagtggagggaggtgggtgtcagccttggcctcccagttctgaaccggggtaagggtatattgctccactcatccctgtcttcttgtagttgagactcccctccgagtggacgttgcagtgctgaaagcgcgagcgaagctgctgcagaaatacctgtgtgacgagcagaaggagctacaggcgctctacgccctccaggcccttgtagtgaccttagaacagcctcccagtaagagccaggccatggggacaggggtggggtggagggactgccagatagcagggcatgagacccttcatggaagggtcttaatccaagaaaggtaggtagtcattagagagcaaaatgccctctgggtttcattctttccttttacgtttgtgttgtgttgttcctacaagtggaaggagttagacacagccttgaagggtaattgcctgttttgtgcctagccatgtgtttgatgccaacagtgcagaggtgataaatgataggatcttcccagtaccgtgtgcccccacggcgtggcacagggctgaaatgctttgcttaccttgcctcatgtagtcctcacaaatgttgtttagggtggatggtattacccctattttccacatgaggagactgaggtctcagtgaacatgtctcaggttatgcattcagaacataggtatgtgtcagggcattggcatgctcacagagaggaagccgagcaatttcctgtgctggcctggagttagtactggcgtgagcaatgagcctgggaagacgggtgctctcggagggaggacacctggtctgaggggtaatgagtggtaattcactccacaacaactgggaaggggagggggagaatgtttgaagcgaaggcactatgtgtgttctttctacctatggtaggaagaacttgacacagggaaaagaactattaaagaaaggccagtgtgggagagcacagcaaccagtcctaagtgaggcaagatggggccgaagagagggatgtgggcctgaccacacagggccgggtgtaagccatggccagagtctggggctttagcctgggggcaagaaaacgcctttgtgggattttaagcaaggaataaaggaatttgattttagtttttagatcatcttggcaatagagggaagagtggtttggaatggggtgagagtggatgtggcagtgttagcaccagtggctcagccttgctggtgatggtggagaggagtaggcagatcaagagatacttaggaaatggagttggcagcttttggttacactggtctggggagggggccgtgagagattagaagtcatggatgactcccaggatggtttttaaatcacagtgggcttagaggccatagtgtgatgtcatttgctggggtaggcaacggtggatcaagttgagttgtggtccttgagtaagggaatcgagatgtcagctcaatagctggggtatctgggtccttttggaaaagaagagatcagggcaggaggcagctttgtgaaatgccggcacagggtaactcatgtgcaagtcataagaggatacgggcttgcctgagggagagtgataagggcctgagatacagccccaaggaggtagagcggacatactggtagggaccaaaggaggacaggcccctctgaaccaaggacagagaaatttgaggagagggatgtggttgataatgccagatgctgctgtgagcgtttgtaggagtgggcctgaaaatgcaggatgtttggaatataaaaacatagaggccaccctggcaaaaacagtatttagtggggcaggggacagattctggattggaaaggactgagaaatacttaagtgagacagaaagaagggaaaacatcaagtgtagacaaaatattttattagctgtaagatagtggttgaaaacagggctttttgtttttaggttagagaaacttgggcttgaaaatacagggcagagtgcataatcgattggatggggtccctgggtgggtatgtgtgggatttggagtgtaggtacgggttaagtgaaggttctgccctgctatggcccattgctatggggtgggggtagcaggtgactgtgcccctaggcagtttgtgactttgaggctgggcatgccctgcagaacatcctggctggcagcatctcatagatggcttagaagtgtaaggtttggtttggaaagactggtggtgccttgtgggcactggggtcggttgtgtttcaggggttataggacacgttgcttgggaaggctacccagcagctaggggttgaggagaaagagggcccgaacaggtgatgcttgagttgagtcctgaaggaacaagacacgaggaagtttccggcaaaggatatagcatccacaaaagtgtcaaggccagagaaggtgtgtatgtacaggaaatgtgtggggaaggaagggaaattgagatcaggagttgtcaggatctgtttggggggcagtgaatgttcaggttacatgtaggatatatataggactttatgtatgatatatataggacttttagcgatttcctgaattcaggagtaccaattctgaatatagttttctccattaaatacatcatgggcagagaggtttcaggctgccaaggtgaggccaagcaagtttgtaaggtttttctgatggccaagtgactcattgctgtgcagcagtctcagatcatgagattagcatcctgtcagaggcctagtcactctggaatggccacaaatgtcaggctggtgcatcagggccttgtttgaacagtggaacttgggagggttccctggggtgggctggggtggcggtggccagtcacctctaactgctgtcccgcctgcttgcagacctgctgcggatgttctttgacgcactgtatgacgaggacgtggtgaaggaggatgccttctacagttgggagagtagcaaggaccccgctgagcagcagggcaagggtgtggcccttaaatctgtcacagccttcttcaagtggctccgtgaagcagaggaggagtctgaccacaactgagggctggtggggccggggacctggagccccatggacacacagatggcccggctagccgcctggactgcaggggggcggcagcagcggcggtggcagtgggtgcctgtagtgtgatgtgtctgaactaataaagtggctgaagaggcaggatggcttggggctgcctgggcccccctccaggatgccgccaggtgtccctctcctccccctggggcacagagatatattatatataaagtcttgaaatttggtgtgtcttggggtggggaggggcaccaacgcctgcccctggggtccttttttttattttctgaaaatcactctcgggactgccgtcctcgctgctgggggcatatgccccagcccctgtaccacccctgctgttgcctgggcagggggaagggggggcacggtgcctgtaattattaaacatgaattcaattaagctcactgcctttctgctttatgccctgctccctctagagaaggtgtttataggtggggatccttcccagagctggtactgtagcgctgttccctgtaacctggcacccctcctgcctcttcccctgtccatgattgcagggatctgaggtttcctggaaggttgggccctcagatgggcttgataggtgccttcctggtccggagaaaagggagattagtgataggacatccttgctaggctctgctctcctaccagaatgattcaagcccctgtgtggggaaggcttttgggtttcgggttgtttatagctggagaatccctttatggcttgaaggtgtcatctgtaaaatgaaggggctggatgcatgaagggaggttttgcgaccccgtgtagtgtgactgggctggcttagtgagtgttcgccgcccctgccttcaggtggcagtcggctctgggaggagaggaccggcattttcgaacccggtccaggccgcctctgcgtggctgtgacgtcgctgcgccccgcctactttgggtggtgacgcggcggtcacgcccccgcgcttacgtcaccggcccggttccctctccggggagcggcggcggacgcgcggctcccacccctcccctctcacgggctctcccctccccagtgtggccgcgaccctaccctctgcaaggcgatggcccgcgccccgagcgcaggctagcgtgcctgggtgcccggccatgggctgtatcggctctcggagcccggcgggtcagggtaagaggcggaggccgggtacgggttggggagtcgggctgcggccgccggtgcgcgggccgcgggtgggtgggggccttgaggagggggccggtgtcgggagagggaggagcctgcaccgggaggcgggccaggcaacaggagggagcgggaatgagcagggaaggggccagaccgactccggttcgctcccacggcctgcctgccttggggttttgcagggcagacgcatggtctcgccgctggctgccgtgtgcccactgctcagggtggccggagacgcacagccccgggaggggctgggcagcccgatgcccccaccactccagccctcggcgactggccttgcgcgcccacacacacactcccctccgcctacacctctgccttcacagtcctgggagtggccctgtgctgggaacctgcttctcccagccgtgtccccatcttcttaaagaggtagcctttcggtcctggctaagcaccctaccacagaatttttgtcggacattgactcccctcttcagtcagtcggcgaagggggactgaggtcccgtttggggcacctgtgaacactgaatcacctctcacctattacagttgttttaatgtcctgcccccactcagcaaaaacaaatcactctactctgtggagggaaagaggaacccagaggcaggccatcagggcttccttcccacagtgctgacccctgcctgggcctcggtttccgtgggtggccatgcacaccgggcctggccgtagtcctgtgcatcagaggtcggccagcttcctttactccggtgtggtggatttctccacgcataaggcaaggcaggactgggtttgggatgggtcctggaccttcagggcaggtggtcagtcacacaggccttggtgtggttggtacttgatgttctttggagctaagactggctgagatttgtacttcccttgaggaattctgggatttgtagtcctaagttaacctcgtggcttttgaagctgaggagcagctgactgctctgatctctctggccctatcaaggcttggagttcaggaagtcatcaccttctcttgtcaggggtgagtttggctgacctcaggactggcctcgagagccctggttaggtaccagttgggggccagggatggcctgtaacctcctgttttccttctggttggtagcatttctggggaccaacagctggccgaggctcagggatagagacggctgctccagctaaaggtcagttgtgatgtacattgcctgttggcactgtctagggaatgggcctcagctccccgagtcccagagagcttggctgagccctggtgttcccacctcctcagagccatgaggcaggaatgttctccttatgtgactaggcacaggttccaaatggggaggggactggctcagcatccggagccaaaacaggaatagaactgggagctgagcctggagcggttctgggcttttggttctctgcatcaacacagccagcatgcctatgatttctgtgctgggcaaaatgtttctgtggcagcgtgaagggcctggaggacgatggacttgtcagacaagtcgcagaggtgagaccagggatcatggatgtgatctgggagatgatgggaagctgagcagtagggtgcttaggtggaaaaggaaaattactctggcttagatattaagaaccaggctgaaacagggagaaccaggctggggccagacagggcatcaggaaacggcttcaggggacaggggtgaaaatcagaaaaaatatcatgagttcgtcagaaaagaagagtaaagagctgtggaccagctgaggctggcgagaggaaagaaggcagcaggaagagagaaggaaggcaaccctcctgcaaagggtccagggtggcggtggtgggggggacagtgatggcggaagaactcagtgtgctttccaagaggaatgggtaggctgggaaacgggaaggagagtcagaatttatcattgtttggtttcaccctagggttttgaggcaaaatttatccagagcaggaaggtggcaagtgggctgccacagaatggccccaggggcccgagggtcagtgatgtgtgggatgggggcttttagagttgaggagagcactcagtgggcgctggtcttctggaaggtgggggaggggccgagaaatgatacggcaatactggatgaaaatggggatctctgcagaagtaggggcacagctcaacagcctttccccttcctctcagtgtcctcggaccccgcttgggctgtggagtggatcgaacttcctcggggtctctctctatcctctttgggatctgctcgaaccctccgaggctggagcaggtcctcccgcccttcctcggtggacagtcaggacttgccagaggtgctgggcccctggtggtggggggaaggaggacgtcatccatataaaggggatctgcagcccccacccacgcctggccagccagcttctggctcccttttccggcgggcggaggcgctatccggcggcgggccgggaggccgcccccgtgccggtctgctctgctcggcgctgtgccagcaggcggagagctcgcgccttccgcgctgacgtcagcgcatcccgggccgtatcccgggagaccctgttgcgtggtgatgggttgccagggagacatacaccttttctctgggcctgggccgcagctgcgcggagcgccgggcacggatggcggcggctgaggggagcgaagcgagggagggagagcaagctaagaaacacccagcaggtgctcccccgcctaggcctggctggaggctactggcgccaccctgggggccctgtcagccaggtacccaaggggagggatcgagggtgggcctcaggtcaaggggcagtgttggctgcccttgtgagggacgggaacgtgatagaagagagctgggcaatgccggggagggatgtgtgcctccaacttcattaagtgagggaaacatttgctggggcttgtcagggagccctgagccaggtacagggtggagttaggaacttacgtgcatcagacttaggccttgccatcctgagctccctcgggagacagacaagggcaatgatgggggcggggtgtgtcagagaaaagaagaggctgtcggctgaaagcattatttgcaggtgacacttgagatgggccttaagtgatggcaagcattttttcacgtaaggatggcattcttggcccagaggaaagctgagttccttttcctggaggcaggcgggctgcttgctgacagggattggtggagaagggtttttgttttttgttatttatttttatgtatttatttatttgagacggagtttcgctcttgttgcccaggctggaatgcaatggtgcgatctcggctcaccgcagcctctgcctctggggttcaagcgattatcctgcctcagcctccagagtagctgggattacaggcatgcgctgccacgcccggctgattttgtatttttagtagaggcggggtttcaccatgttggccaggctggtctccaactcccgacctcaggtgatccgcctgcttcggcctcccaaaatgctgggattacaggcgtgagccactgcgcccggcctgagaaggggggttttattgggcagaggagatcagcagtggattcaaaggaggcttggaaggaggcaagggtgtcacagagtgggatccttcagggcctgggtatgatgcctgcactaacctcactggacagtagcgtaggctagacaagattttagagatgtgttgtgaccagctgcactccaggaaaactgtttacattatatcttacctcattcatccagcctttgcatttttgtttgcttgtttttgagacagagtctttttctgtcgcccaggctggagtgcagtggcacaatcttggctcactgcaatctccgcctcctgggttcaagcaattctcctgcctcagcctcctgagtagctgggataacaggcacccgccaccatgccctgcccattttttaaattatttttagtggagatggggtttcaccatgttggcctggctggtctcaaactcctgacctcagatgatctacccaccttggccccttggcctcccaaagtgctggaattacaggcgtgagccaccacgcctggcccagcctatgcattttttttttttttttttttttttgagatggagtcttgcaccgtagcctaagctggagtgcagtggtgcgatctcggctcaccgcaacctccgcctcccgggtcctggttcaagcaattttcttgcctcagcctcctgagtagctgggattacaggaacgtgccaccatgcccagctaatttttgtatttttagtagagacggggtttcaccatgttggccaggctggtcttgaactcgtgacctcatgatccgctcacctcggcctcccaaagtgctgggattacaggcatgagccactgacgcctggccagcctatgcatttttaagaaattattctgtattaggtgctgtgctaaacattgggcactacagtgaccaaaacagactgaattccccaagagccaaagaccagtgagggagaccaacaagaaacaggaaatgcaaaagagaccattattactcactatgactaagggccacaaatggggtacgttgatggagagtgatttgttaagagactacagagggaggacagactaccaagaggggggccaggaaagctcctctgacgaggtggtatttcagcccaaactggaagaatgagaaagagctagccagccatcagaatagtccagaagagatggggagcactacactcactacactttggcctgagaaaatagcatgggattggaggaggctgggggaacaccacttctgccgacctgggcaggaggcattgagggcttgagaaagggcaatggcagtagcagtagaaaggacagggtaggagcagggactttgcaggtggaatcattaggtcttatcaacagatatgggcaagcaaagccaggggagaattgatggtaatgctgaggtttggagccaggctagatgggacagtggtgggtgatgcaaaggaaagaggtcaggaagcagggccagacgtggggagaaggtgtgggggtttggtttccatcttgccgagtctgccggaatgtggatgggaagaccaagaggaggagcaaggggcagaggggaagggaatcttaaagaagtcctggatgccacactcttcttccttcctcctcttccctctcctcagaggtctcactcgtggttcttcatttcctgccctgcctccatctcctctgggtgctgggaaagtggaggattagctgaagttttgcttctcggggcctgtctgaatctccattgctttctgggaggacataattcacctgtcctagcttcttatcatcttacatttccctgtagccactgggacatatgtggtgttccttcctagctcctgtctcctcctcatgcctttgctgggtatgggcatgttagggggaaggtcattgctgtcagaggggcactgactttctaatggtgttacccaaggtgaatgttggagacacagtcgcgatgctgcccaagtcccggcgagccctaactatccaggagatcgctgcgctggccaggtcctccctgcatggtatgcagcccctcccatgtttctggccactttgtcctttctcctcccgtttgcacatccctttggaactgtttcctgtgagtacatgctggggtctcccctttcttcccttgctcaggtgaatctcagccccttctcccacccaaaggttcacatggatcctaactactgccacccttccacctccctgcacctgtgctccctggcctggtcctttaccaggcttctccaccctcccctatctccaggtatttcccaggtggtgaaggaccacgtgaccaagcctaccgccatggcccagggccgagtggctcacctcattgagtggaagggctggagcaagccgagtgactcacctgctgccctggaatcagccttttcctcctattcagacctcagcgagggcgaacaagaggctcgctttgcagcaggtggatggcagaaaggggataagctacactcttggcacagggctgctttctttctttattttatttaatttttttttgagacggagtctcactctgtcgcccaggctggagtgcagtgatgcaatctcagctcactgcaacctctgccaccccagttcaagcgattctcctgcctcagcctcccaagtagctgggattacagttgcctgccaccgtgcctggctaatttttgtagttttagtagagatggggtttcaccgtctaggccaggctggtcttgaactcctgacctagtgatccacctgcctcggcctcccaaagtgctgggattacaggcataagccaccacacccggccagggctgctttcttatctcctcgggtctgacatgggggttggagtcttcccataccctgtttctcctctctcctgtcttcaagctgagccctagacttagctcaccttctctgcttatgcattctgtccctgcgacaggagtggctgagcagtttgccatcgcggaagccaagctccgagcatggtcttcggtggatggcgaggactccactgatgactcctatgatgaggactttgctgggggaatggacacaggtgagggacatcctgggctagggctgtggtggacccacctgatagaccttggcattctttcagagccacatccagaacactctcagcctttgcaaggggagggagagggacagactcagtccaggcaggcctggacactccagggacaggaaggctgtccacactcatgggtgggaaatgagcagacagaaatggattcgttcctttcccacaggtgctgaggcttctctgcctgtctgcacagttgtgccttgcagtcctcaaaaaaaaaaaaaaaaaaaaagccgaaagacctcaaggacaccttctgtgcagccatgtctctgggagggtctgcagtgcctttgcctcttcctctccgaggcagccttctggctggctgtggcagggcagatgagctgcagtgcacagcccagcacctcgcagggctgcagcccaggtcaacaggaaggcatgctgggcctggaacacccacggggccatgctggctccaactcagcatccttgcattccagcccgtgggcctttctctgggccagtgcttgcagaggggaccctgcagggctctgcagctgtgttcggccctcctttcatctttcattccctagaccacatggctgactttctctgtagcttctgggctcaagtctcacaggccaccattccccacaacctctttgcctttgaagattacctctaccatcccatacccctccagtgaattaacaagttctccaaagcaggcaatacatgagagcaggttggagactgctgctgtggtctggagggctgatttggttgtctgaagccaagatggaaccttaaaccacaagcatttttgtttgattgagttccaggcctactttgacccctggggtaatgataataactaacatttatccaaggctgctactagcctgtgtggaatctttgtgcaaattagaaaaaggcacccctttctctggcaggcacagcctttctctggcaggccagggcatgctgcttggtgagcagagtatgggttagattttgctatttctcactgccttggacaggccctgttgtgcgatgagcaacctgtatggccataggcggtgaccctgcatttactgcttgttaactgtgtgccagactttttttttgagacggagtttcactcttgttgcccaagctggagtgcaatggcacgatctcggctcactgcaacctccgcctcccaggttcaagtgattctcctgcctcagcctcccgagtagctgggattatagggatgtgccaccacgcccggctaattttgtgtttttagtagagacagggtttctccatgttggtcaggctggtctcgaactcctgacctcaggtgatccacctgcctcggcctcccaaagtgctgggattacaggcgtgagccaccgcacccacctgtgtgcgagactcttgttcttgtattgttagaatctccaactcaccattaaggacactgaggtctcaaaaagttgtgactggttcaaggttacccagcacctatccacccctagagctatgccaggggtggagtggggtgaatgtggcttccaggttgtccagttgaaatggagccagcaggactgtcttcttttctcttctcctcacagacatggctgggcagctgcccctggggccgcacctccaggacctgttcaccggccaccggttctcccggcctgtgcgccagggctccgtggagcctgagagcgactgctcacagaccgtgtccccagacaccctgtgctctagtctgtgcagcctggaggatgggttgttgggctccccggcccggctggcctcccagctgctgggcgatgagctgcttctcgccaaactgccccccagccgggaaagtgccttccgcagcctgggcccactggaggcccaggactcactctacaactcgcccctcacagagtcctgcctttcccccgcggaggaggagccagccccctgcaaggactgccagccactctgcccaccactaacgggcagctgggaacggcagcggcaagcctctgacctggcctcttctggggtggtgtccttagatgaggatgaggcagagccagaggaacagtgacccacatcatgcctggcagtggcatgcatcccccggctgctgccaggggcagagcctctgtgcccaagtgtgggctcaaggctcccagcagagctccacagcctagagggctcctgggagcgctcgcttctccgttgtgtgttttgcatgaaagtgtttggagaggaggcaggggctgggctgggggcgcatgtcctgcccccactcccggggcttgccgggggttgcccggggcctctggggcatggctacagctgtggcagacagtgatgttcatgttcttaaaatgccacacacacatttcctcctcggataatgtgaaccactaagggggttgtgactgggctgtgtgagggtggggtgggagggggcccagcaaccccccaccctccccatgcctctctcttctctgcttttcttctcacttccgagtccatgtgcagtgcttgatagaatcacccccacctggaggggctggctcctgccctcccggagcctatgggttgagccgtccctcaagggcccctgcccagctgggctcgtgctgtgcttcattcacctctccatcgtctctaaatcttcctcttttttcctaaagacagaaggtttttggtctgttttttcagtcggatcttctcttctctgggaggctttggaatgatgaaagcatgtaccctccacccttttcctggccccctaatggggcctgggccctttcccaacccctcctaggatgtgcgggcagtgtgctggcgcctcacagccagccgggctgcccattcacgcagagctctctgagcgggaggtggaagaaaggatggctctggttgccacagagctgggacttcatgttcttctagagagggccacaagagggccacaggggtggccgggagttgtcagctgatgcctgctgagaggcaggaattgtgccagtgagtgacagtcatgagggagtgtctcttcttggggaggaaagaaggtagagcctttctgtctgaatgaaaggccaaggctacagtacagggccccaccccagccagggtgttaatgcccacgtagtggaggcctctggcagatcctgcattccaaggtcactggactgtacgtttttatggttgtgggaagggtgggtggctttagaattaagggccttgtaggctttggcaggtaagagggcccaaggtaagaacgagagccaacgggcacaagcattctatatataagtggctcattaggtgtttattttgttctatttaagaatttgttttattaaattaatataaaaatctttgtaaatctctatatacatctggtcattggaggttccagttataaacccatcttagttccacccctttcccctcaaagggggagcaggggtcaagtgaccccaacccatcctgccagggcagggcctatcttcctgcctctggaagacttgttgcaggtgggtagtgggtcagattccaggtaggatgaactgggagaagctggcaccccaggtctggagggggctggggtgcagcctccagctgtagctgcctcctgccttccgaaggcagaaggaatgaaagatgcacattctgggctgacgggcatggctagcaccatcctaggccacccacgaggggctcattggcatttgtcgtcgctgtcggaagggctgccctcccgggggaggccatgacgggagtggggcccccagagtgcatgcacctcagtggtctccgtgtcactgctgctggtggcactgtctcggaagctggcgaggggcggccggactttcacaccctgtgctgtgacagagccctcgatggccttccggagctggaaaggtgagagggacagatgtctggacccagatgtcagactcctccccgccttcctccccaggtgagctggacataagcctccatgactttttggaagtggagcagctttggaggccaccatcacctcacctcctttagagtaacgattccaatgagtctgccaatactggtgacataagcatggtccactcccagcagtgagaagatagtgtgagtctgcagtgtggggagaaaagcgattggacttgatggacgaggggcagctctaaatgacaggccacaggggcccaggacaaggttggtgtggaataggaggggtgccccagattgggagggaaggagacaggactgctggagggaaaataataacaatcgtaataataatgagaatgtttctgtgtccaggcctcaggaacttgatactcaaaatccttatattgcttacactgacggagaaataggatgggggagtaattcttagtcccatgttagaaagggggacgtgggacagaacaactgttcacacgtgaaatctagtgattggccaggctccgtgctaggtcttacattatcatttaattccagtactgtcctgagaactaagcattaggagaagcagcatggggctcaacagtgaagtgacttgttccaggcgggtcctcaggagtggctgtgcagccccagtcacttttcatcacaccggagagggacgcacaaccccagtcctgtttagttgcagatataccgagaagggagagcccacaccgaccttaagggcacttgggccctgaatcctatgcctctcgttccactgcttctcagttgccctcctacctggctggccaggtttggagtctctctcccctgctctggcattccagtcttggcctgaagcacgctatgcctctcatacagtctgccttttctagggtccaagcagcatcccaagttctgttgagatgcagcttgcagtccaggaggacaacggtcacccccatcttcccatgtttttcttgctttaagccctcccctaagctttcacatataatcaccaggggttcagaaattgtcagccagttctccttatgctttaagtagattttcttggggccagatgtcttgaaaaacgctctcctgactcagcagttcctggaatttttggcctatcatttatctcactgttctgagtttacttgtaagcctcttcgcttaatgtttgaatcaagatgagcagtaataacagcttcttgtgtaccaattactcagaactcacttaaattgccttaacactttttaaatgttcttacacatttgaaattctttagggagggatttccagaactttcctaaatttctccacccatggcatgacagtacttagaggggcaagaagttcaattttagaataagctcttctgggcgcgatggctcatgcctgtaatcctagcactctgggaggccaaggcgggtagaatgcttgagcccaggagtttgagactagcctgcaatatgcgaaaccctgtctccacaaaaagccagacatagtggtgcatgcctgcagtcccagctacttgggggcgctgagttgtgaggatcacctgagcccaggaggcagaggctatagtgagccatgatcgtgccactgcactccagcctgggtgacagagtgagacgctgtcgtctcaaaaaaaaaaaaaaaaaaaagttcttctgtgtttcttgaatacctataacacagttgtcatgtggttagcgattccttctggctaactggagtcctacgtgctacaagttagctttaatttccttgtctgacttcagagggaaacgcttttattataaggcttcctatgttactaatcccttagccttgtcttcttatggtcaaataacccctctcatcttctcccaaggagcctattaaatagttcccttgaattttctttttctccacaatcctaaccaggtgagcttctggcgggcgatatgcctttcaggtttgcaaaccacttgcccctgacagtcaccaagccttaccaattcacttcctaaacatcctggccattactgactgtagcctcactatcctcactaagactggggctgcaacagcctgatgggttctttctgcctcccttccctccagtctggccctgcttatcctatgccctttgtcaaacttgagtacagcccagactccctagaaggcccatgagacccttcccaagccaaccccagcctgtctttatagcctcacattctactgtgtactccagcttccagcctgcagcttcacataatcactcttctttttctgaaaacattcatttcttccacacttcagctcttctctcattacagtattttttttaaacaattttttttagttaaaaaaattttctgggccgggcgcagtggctcatgcctggccaacatggtaaaaccctgtctctactaaaaatataaaaaattagtcagacgtggtggcacgctcctgtaatcccggctactcgggagggctgaggcaggagaatcacttgaacctgggaggtggaggttgcagtgagccaagatcgcaccattgcactccagcctggtgacagagtgagactccgtctaaaaataaataaataaataaaatttttgtgttagaagacagtctcactatgttgcccaggttggacttgaactcctgggctcgtgcagtcctcccacctcagcctcctgagtagcttggactacaggtgcccaccaccatgcccagcatatgctatcttttaaaattcatctctcagtataagtagtaggagtagtaacagtaattcctaacatatattgagtatttactgtgtgctaggccctattgtaagtgcttcacatgtttcaagtcctttaattcttagaaaacccagtgaggtgtgatccccattttacagatcgggaaagtgaagcacagagaggctaagaaacttaccaaggtacacagcaagccagcatgtggcagagtaaggatttgggttcagttggtctggccctagctgtggccgccactctggcctttaccattgcttctccgtgggtggcctctgaatgaattacttattagccggcacagcgatctccagttgcacgggttcctaagtagtctccagtgttttctctctcttatctgaatgttcccctcctgaacttaattgggcgactacctattgattcctcaggcctgtaaggacattttgaattctaatcttttatgttcttatcacttctagttctttgtacttttgttagttggttcctcaaagacttcttctcttctgatttttaagtttgtaacaaatatctactttgttctttttcatttaattcaattagacatcatggaacccattggagggcccatacttcttgggcctgggaacagtgaactgacatggagagggacaacatggccttctgaaagaatcctgggagcagggccaggaaatctgggctctgggcctgactctgctgtgctgactcaggcacgtgacctcctcgctgcatgcctcagtttccctgtgtattaatatggttaaggccacaggcttttgagtcagaccatcctagattccaggcccagttctgctacttattattatttttttgagatggagtttcgcttttgtcacccatgctggagtgcagtgtcatgatctcggctcactgcaacgtccacctcccatgttcaagcaattctcctgcctcagcctcccatgtagctgggattacaggtgcctgccaccacgcctggctaattttttgtatttttagtagagatggagtttcaccatgttggccaggctggtctcgaactgctgacctcaagtgatccacctgctgcagcctcccaaagtgctgggattacaggtgtaagccactgcgccagttctgctacttattagctgtgtgtccttgtgcaacttgctcaacctctctgaatctcagttttcttatctataaaaactggaggatcgcaatatctaagtgcgtgcttgtgatgattaaacagttgaagagcttagcacagtgtctcgcacatagcaagcactcgaaaaatgtcagcatgatcatcatcatggatgtttgaggagtaagatcattgtggaaaggcctcagaggttttgggaagaagggctttagataaaagccctctcaggcctattaccttttttcttgcaactgcactgcagtttgccactcatccaaggacttctaagttcctttatttttgcctttttgtttctcttttgtcccctatgcttcctgcctcagtctccgcttgtccatgctatactggctcttaggcagagcttgtgtgtaagctgaatgcccaagctgcaggttttgggtacatctacctgctgcttatcccctcccccaaaccccccaacgcttcaaggcttgtacattatgcctgtcaaaagtttagctaaaacaccccttggcttctgctggtcccaggagccattttaccaatgcaggctgccccccttaggagtcctggacgcagagagctcctggcctcctctggggtctgcctcgcccaccccaggcagtctgctcagttcctcgccgcatttctgcaggctgctttgcagttctgctgagccatcttcccgcgtccgtaccagttttccttcggcccacattaaggcagactttctggggtctggcattccaagccccccactgggtgtttctcatctttgtttatctctactctgcagtctccccacccctacttggatgtttgttggcttgtttattgcattttcttatcctgcctgtttctcacccgtttttttccgcatgggcgtatcaaccttgctgggctgtggtggcctcccgcctagctctgaccctggcctggccttctggcttccacccagctcaatccctgtctttgttgcttcgttggtccagagttccctcgagggcaaggctgagcagaggaaaaacgatgcctggctccaccacagagcaggaggaggctgctcccacctcccatcatccaagcagtatgtctaaaaaacatctccgcactgagccaactcccttctcctccctccttccccactggcctgagtccaaacttgtagggggaccaagatccccactgtgtcctgagagcctagaccagccctgggccaggctgctggccctaccttgtgcaaagaggtccgctccaccagctggaagggagcaggatcaattttgcagtcactgaagttgacaggttcatctagttgctgctcctcccactccagaatctgaggggaagagactatgaggtttagggagaaggtgcctgtagctgacctcacctccctgaaagctggcctgccctttttccaaccccgtggtccctcccatggggacagcagccaacatgatgattgaacacaaccaggaagaaacagggtccagagtccagtggcaccttacctcttcagggctcatctcgccttccaggtccgcgtcactctagtagagagggagggaggctggcagctaggggctctggagtttatccagcctagaccctgccctccctgcccggtgccgccgagatgctagaagagcaggcatacttactgccagggagattcggacacgcttcagcttgcgcttctcacaggattccaacttcttcagttttgttagagccaaaccagaaagatgaggagttgaggttatagggagaggggaggtgaggggaagtggtggagcccaggggaaagggcacgccacaggacctgagctgacagcagggagggccgaagggcagggagaatagaggcaggcactgcagggttaatgacgtggtctcagcattggagagggagctggggaaaaagcaagctaggaggacaggctccagccactcacctccgaagcagcctcagggggtggactgccacagaagaggctccggagggcgatgcctgccgactctgcgctccctgtgttcccaaacataaggccccagggggcaatgtcatcttttggggagaggaccaggaaaggtaaggaagacacagggagaggtatcccagttccagccctggcccatgtgggcagcctcttccagctgggatgtaccccagcaacagggctgggcagggactctaatggatctcagtagcttggctgaggctctgtggacacaggagacatgggcttacctgtgggactctctccgaggttcctggtgacactgggccccctcttgagtgcaggctttaggggcttgtgggtctccccccgggctgctgggaaggctgagtcttctgtgttcacctgcataggcaggaaggggctggtgaggccacggccccagaccaccctcccaatcagtctacacaatgacatttaggaagcgtttgtggcttttcccctcacctggaagcagacagaagcctcaggggtagggggaccctcctgatcagatagtggagaggtctgggtggctctgcgctcctgcatgtgctgccgccggcgggctgggctcagctgggcccccaacaatgccaccacctgtgaacgctcgatggagcccagcagaatcatggactctggacagaacaggtggaaggactcaggagctgagagggagccctccagccccgtccttctctcacactcagagtggggggccttgcatgcaggccacacaccagagggaagcccccacctggcaagtgctggtccattccctttggaaccaaggagactggtcctgagctccctgccccttcccgaagcttcgaccctgggcaatgcccctagcacctgggacccctcctggcctcaccaggggactccactagggccagcattcggcccttggtcctgtgcagtgccaaacgcaggtcccggaaggtgcagctgagggccacatggggaacatcccgcaccatgatgtcctccacacgcacccggtactgcctgggggccgagagaggcgcttggtttgtggtcagcatggggagaggtgcccagagcattgccatcccagggccacaaggagggctccagagcccatccatggggacgggagctaaggaccaaggggtgctcccacccttctttctgaacagcaggggccagctacagcccctccagagtgtggacgaaggtggctcatctcccagcttcgtaggctccaggaccttgctagaggtggctgtagggggatctaggatgccctctgcccttcacccacagcccccttggcacccagccctccgtactggtggcggccccagccgagctcaggcaggtagggcagtttcttgattcggatgatgctgtcatagagggagggctgcagactctgggcgacagcgttggccaggatgacggcgatcatgacaggcaggatgtgggcaatctggcctgtgagctcgaacacgatcacagccgtggacactgtgtgtgtcaccgctcctgccagcgcagctgcccctggggacagtcacactcagtctcctcagggtgcccaggtcccagaagaccctccacaaccagggcaggtcctgagtgggtccctcagggctgcccaatacagtcctgggattggacctgtgcatctgagggaagcctggtttctgccagcagggggcaccagagtctcggaccctgtggctggggcgtgggtgggggggtctcccaaggccgatgggacctgaggcactcaccgaccacagcgtagcccccaggcacaatccggtaggtgctgctgtccgtatgaattccatctgggaaccaggcagccatgctttcacccaccagacgcccaaatgctgctccttcagggaggggggtgggaagagaaagaggcagtggagggggagggcagggggcactaggaagagagagggtcagagggtgagggaggggccaacgggtcattcagtgtagggcacagccctgtggggtcagggttcgggctagggctggaccaaaaacccgctcttgggcagagggttggctgggggggtggccagaggctgaggaaggtgcaggctgggtgagcaggcagctgagaactcaccaatgacaaagacaggcatgaaggccccacagggaactgggatggtggtggccagtgcagacatccagaactgcaggcagggggtggttcaaaggcgaagaggctccacctggccccaggcagcccacagcgccacccaggagaagtctacctcgctgatcaggtgggcgtaaccctcccagccaccccgtaaccctcctagctaccctgggacccccaggcctcccaggtgatggcaaggggaaggactctggaagcagatggcttgggttcagatcatcgctctgccctctagctgtgtgactttgggccagctacttgtgtttcgactcccccatctttcaaacgggggtgataatagtgcctttcccatggcactgtggagaggcttcgaggagtgagcactgcgtggcaggtgcttagaagggcaagctatgtaaaggttagcagtgtacacgtgaggagcccaccttcatgagaatgaagatgaccagggtgaggaagacgttggcacgtggtgggttccaggcctgtgaggtgctgggtggttctagctcctccaccaggccctggcggacccacgtccgattgtcaaacagggtgaccagcgtctctttctgtgagagctagagtgaacagggtgcctcaggctgggaaaccgacaggatgaagggaagaggccatgggatcccacggggaacaaggggtcccacagtcacactggggctgttggctttggaggaatgccttccaagggaaagcacaaaactcctgttctgcctgtggttacctgtccagccatgaactgtccaaagccaggggggaaggtcagcgtggagatgagcagggtcaccagagccgggaagagcaggcgtctagagtcgtaggtttcacatcagtcgtgggtggccaagggctgggtggcctcgcatatctcagggctgaggtcagagcagagccttggctctttcatgaaaacactcagtcctgacagaaggtctcctttgctgtttatgatacgatagccccaaggctgatggtggactggggttattctaagagcaggggtctgacccaaagacctttctgtcagcccctgactctgtaggtgggtagcagcagcagaaagtccatcctccaagccctcccttggggccctccgagttgttattccaccctccaccctcagaagcccatcagggcatattgtgtgatggggtggagaagtttctgcctctctttgtctctctgcagtgacttagagtgaaggtcaatgttgggggaagctggggtcacttgtaaagttgaccagaggtgcgtagggagcaggttcagctggctgccctctctctgaaggatgtcagtcccaagggaagtcatgtctcgccctccccactcccaatcctcagggtcacactgagagagctgtgttctggagattaaaaaaaaaaaaatctcggccgggcacagtggctcacgcctgtaatcccagcactttgggaggccaaggtgggcagacctgaggtcgggagttcgagaccagcctgaccaacgtggcgaaactgtctctactaaaaaatacaaaattagccgggcgtggtggtgcatgcctgtaatcccagctacttgggaggctgaggcaggagaatcgcttgaacccaggaggcggaggttgcggtgagccgagatcgcaccattgcactccagcctggacaacaagagtgaaactccgtctcaaaaaaaaaaaaaaaaaagagatctcatctatccccatgggtcatggggggaacctgaggctcaaacactctccagggagcattcctatatgggccagcccagaggacctgaggaggccttagtctttgattcccaaatgtcctctaccgctgactataaacttaaaaatgccaattttcaggtaattcatatgaatataaaaatgctcagtcagcctggaaaacactgctggctgatttctcagtgaagtgcctgttttgactgggccattctctccccatcactgtcccctgacctactgtggcccttatacaactcaaagcagcctggagaggagccgagagccactcacttcctcatgaggaagcgattgatggttttctgcttccgcatcacctggacaatcttccggttcaggtagacaaagagggctccaccgaagccactagcaatactggaaagggaagaggcacctgagtgaaaaggagccttctagaaacccccctcctctctgatacccccagccccctcagctcctcacccaatgacagcaaaggctggcagctcctgcaggtcaaaggggaagtcgagccggaatcgggttttgaagagggctgtaatagtctctaaagggaagaacagcagagggaggcaggcctagcctcgtgggccccctacctggcaccatctcgggctgccctcatcccctgggtgcccccaccttcatcccggttccagactgccaagacccggaagatgaaggcactgaaggtggcagcgaagaagccccgccagtagttccgcactgcaaagaaggtggaggtgacctcgatgctgaagaggacgcctgtgagggggagggagaccagcacttgaggcctgggcctggcctaaggcctcagacccagataagaggggccaaggaggagaggccaagggcagggttgtggggctggactgacctaggagccctgcctacctccaataggtgccgcgaagcagcagcccacccccacggcacaggcggcagccagcatctctgtgttccgggattcattctggcgagagtggtggcaagagggggtcagctgtgggctcagcagcctctgccccctacttgccccagggttccccttacctcatagatacccccaaagagggagaggaacttgctgagaagggcagcacacatgcttgcgatatgcacaaaagggccctgcggggtggggcaggcggtgagtcgggagggggcccgccctgaccttggcctggcctcctcttccaccaggagggactccttcattccccagcctgcagttacctctttgccaagcggcatcccgctgcctagggcgcaggtcagcccaatgaccttagctataaaggtcttgagtgtgaggtattctttcagcaccactccccgcaagatggtcttcatctcagggatgccagagcctggagagggaacagtctcaggagaggcattcgatgcacccatttcaggggtcccgcctctgccctccccttctcttctaacataccgacagcctgaggggccaggatctgtgtgaatccggctgagaaagtgatgaggacaacagggtaggtgacccaggccaggtactggagcaagatgctggtgttcaagccccgggacatccactgctgggctgtgggaagaggacctgctggacccccagtgcacacacccactgcctgcctggccagtggaccacgctgatacgacaggctgtcccagggagtaccacacagagtcagggcatgggtgaaggaaagggtccctgagggtattcactgggacaaagcgcaatctaggcaagaggatcacttggagaggggatgcaagaagctgtgccctgtgggagtggccgagatgatgcctgaatctgggcagtcagactggctggggaaagtggtcagtggccaagaagccaagacgccttcctccatgtctagacgagtgtggcatggacgcaggaggtttattcccagtcctccccctgccagctgtcaccctcaccttgcagacaggcagcaatggcatagtccatgacccagctgaccaatgccatgagaagccccagcaggaccaggaagatccaatcttcaccaaccctggatactaggaacttgtggcagcggacagaacagactgggtgcagggaagggaagaagggggaggatggcaccaaagtgctcctaccccttttactgccccctcaactgtcccctctcccccatcagcagctctaatggcctctgcttccctcagcacagcacagccaggtcccctgcccccaccccagttctcaccgcggcatcgggcgcaacggctccgtccatattccaagagctctggggcagcccgagaggaagggggacctttccagggttcaggccctcccaggcgaatccgagcagcttcctctttggcaaaggccccaaggtcctgagtgtaccggccatacatctggagcaacagaggggatgggggcattcgaggtcatgggctgagtgggaacgcagggagagttcttagagcctccactcctcttctcccagcccccacactggatatccctcttgaacgcacagttcccactctggcccgaggtgtgggaacaatgcacattgcagactgtggaggctgtcctggccagagtgatggggacagccaaggtacagggacacagctctgggggtggcagaataatcggtcctcttctcacaggcctggggctggggcactgaagaggagtgagagggaagccccagaagaggaaaaggtggaaaaacctgtggcacagtctaaaagtgggaggcgggaaggccagggagtaagggatgatcaggggcacatgggcaacaataagagcctcgtggagctcggggcagctgagttgggcccaggagcaggcgcagccccaatccttatcacgttcctgctgggcctccggcctgtgaccaactcagctgcacctctcccacccaccctaatccccttgtccccattctccactgccacccccaccagcctgccagcccagctgggagtggaaagcctctcacttagggtgggtggagagggcttggtggcctcagccccattctggagctgcactgagcccagcggtgggttgggggacagcggaggctgaggatggctgggctgtgactgtggatgctggggtgatgggacgggagagtcgcctgaaccatggctagacctgccaagctgggcgtgtgttggggggcggggaggagtagattctggctgccacccgcagagcttcgggacacaaagggctcctgttggggctgggatgggggggagggagggagggaaagatagagacagagagagggtgagagataggaaagggaaagcaaagagaagagagggaactagagaggagaaagtagaagagaaaagagagggaaggcgaagggatggagaagagaaagaaggggatgagagaggaagaagtacggaggaggaagagaatggagagtattaagaggcaagcacggtgtaggaggagggaggtgagagtgggagagaaagacaaagggataggatggtgaaggggggcgggagcaggctggagcacagagtgcccgggacagagctcgaccctgagagctcattccagagacagctggaagggacggagatggagaggtggctggtgttaagaggcaccatttcagaggccaggtgcctggcttccttgaccatgctcctatcctggtctgggcagattggcaagtgtctcctaccccatcccaagggttggcccctctacccttgctctactcccacctctccctgacatcctgattcatccagctactttctcctaactgggcacctcccagacttatagcctctcctctccaagacgttccctccctgccaccttcctgggcaaattccagcccaagctggtaaaaaggaaccacgggccccttcctttccctagggcttgggtcttccaccccagtgacatgaggagggtcacgtggcttctcaaacaccaagtaacaatgggggcgataagtcagctcagagcccaggacccctgcttctaatgaggtcaggggacacaccctggggtgggtgggggctggataccccgcatcagcatagacaaaggtcccaattcccacacccattcctgcttcacccaccctccctaaagctcctgtcccccagagtggcaagccacctttttccagagtcaactgaggggctcctggagccaacgctgggtgtggagcctccagaggtagggtctggggctgaccatctttctacacactcgattctatgcttagcatggtgccatgcacatggcagggacacagagaatgtcttgggtggtggagatagtggcgtagagaaagttcaatggtgtgaatggtgccgcggaaggggcagtggggtgctgagacttgggcccaggtggtgaaggggaggtgcaaagaaaacgtgcatgttgtggggtgaggggaaggacacctgagacaagtacctggtgtccttgtcctctgcaggccctcagcctcagccagaaaccagcatgcagttttccatcccttcggccctgcagcctcagacttccaagcctcagtttccccagctcaaaatgctaggacaggattagggtaggcccctggtcctcgcgcttcccagggtaacctggagcaggggtcccggagcgcactcctggggctcagctcagcttcacttaccagggtctgctcgtactgcagcgcccgtggctccatcccttcctccgccgccgcggccgccatctccgcgcactgccctctcgcctccctcggcggttccggctctgtcctggactcggctcccggcccgcaaagtccgcgccggcagccgtcccgtccccgcagcccgggaggccgagagcagagtgcggcgggcccccggcgggcgccgctggcgcagcctcccgctcgcgtcccctccccggcgggcgggccgagggcggtgccctctgcgctgctccgcccgccggcccatccggaggggacggcccagccaggctggggtccgcgcggggcctcccgagaggcggcaaggggcgctgggaaggcgcaagcccgcgccggctccctgcggatgcccgggtcggagaggggcgcccgggaggggcgggtctactggcacgtggaggggccggcccgggttcgcggttccccgtgcccaggcaggaggggctgcagacgcctgagctccgtaggggttggggctgggggctgcggagctgtctacatcggactcctccgggtcagcccgttaggagccgcctcccctctgcccctccgaagagacgagcggcccagacaggcctgggaaggcccctctgccccgtcaggggtgaaaagcaaagctggaaggattcggagagggttggggccgtcttcctcatccttccttttctcggggctcccgtgggtaggtgcacttggagcaaccgggcctgcggggtgtgcgggggtggaggttggggagggcaccggaaggggtaggccggagggaagggagctccaggtgccgggaagtctactcctgggacgcgggcgtgggtcgcttctccctggctgggcccaaggaggaacccaagtcgctgcttccatccctccgctttgggggaactgcctgctggtgttctgggttctctatcaggggctggggaaggatagaacagagggcggagcgcgcgcagggtggatgggcagcgtagagatagtgtgagaggagcgagggcagcgcccaggaaacgcacaagtgtgcgggagagccagcaccaggagtaaggggcatttgggaggcagaggcggggctcagggggcgggagcagtgcccgggaagggggggccttgtgatagaagccagcactcaggaggaagggccagtgtgagggaagagctggtatccaagggacagggcagtgccaggctgaaggggcacggaggggatccgtgtccaggagaaggcagtggagggggaacgcgcagcactaagctggaggggtaatgcccgggggaggggggtggcgggagcccggctgaaggggcggtgtaggggaagagagcagggcctggggggaagagggagggcagtggtgggagggtgcagtacgagaggaggggacaatgcaggctttcctcttctccatagcgacgtcatggcaaattcccaaactggacggatccggctcgggttacgtccagcagggccgagccggcccaggccggccccggggtcctcggtgccggctggaggggctgggcacctctggggcggggttctgctccacctgccctcggcgcggactgtgccctcggcgggcacgcggaccggcggggtagggctagggcccggcttctctgggccaaggatcaaggtccctgcctgggttaggcccccacgcattccagtcttcggaacccggcctctgaagagggcgcagtagggccccagcggagcgcgagaacccgctctacagcctattgcttccccgccctgggcagagccacctggacatgagacccgccctcaatgccgaagcctctcggaagcaatctttcgggacggaagttaagtagccccgagcgggaggctgtggcggaagtggtcgcgttaccgcttgtttgtgcgcatgcgccactctcgtctggccgccgcgctttcaggaggtgcttttggttctctccggtcttgtccacgctagggggtgcacgtactcccaactgtggtcgcgctctcaccccttctgctgctctcgtggccccctcgcgatggcgggcatcctgtttgaggatattttcgatgtgaaggatattgacccggagggcaagaagtttgaccgaggtaagtaaggtatgtaggggcggtttggaggaagaggctaacctcgcggacatgcccctgggccccgtgtccacccagctcttgtggcctgcccctaccagcaggtcctggtgtagggacctccctcagtaaacattttatggatgagaaaacggagactcccgagctctctctggcttcacgcatgccgtgcccggtgcctgggtggccttttgtcatggtgctggcaaactcctaggcatatttataatcgctacctgctctgtgctagacactgtcttgtgagaccagcctggccaacatggtgaaaccccgtctctaccaaaaatacaaaaattagcctggcgtggtggcgggcgcctgtaatcccagctacttgggaggctaaggcaggagaattgcctgaacctgggaggcggaggttgcagtgagccaagatcgcgccactgcacgccagcctgggcggcagagcgagactccgtctcaaaaaaatgacagtcctcatgaggtgggtggtgcctttcccatttttctctgagaggttgagtaaaccacccaaggcttcacagcgagtaatctgacttcagagcctatattcttgtattgccctcagaatctttagcgctttgtgaagtcttctttgagttagagttagctgcttggtatatacctttttttttttgagacgcagcctttctctgttgcccaggctggagtgtagtggcacgattttagctcaccacaacctccgtctcccgggttcaagcgattctctgcctcaacctcccaagtagctgggattacaggcatgcgccaccacgcctggctaattttgtatttttagtagagacagggtttcaccgtgttggccaggctggtctcaaactcctgatctcaaatgatccacctgcctcggcctcccaaaatgtcgggattacaggcatgagccactgcaccggcctacacctctttattttgtcatctatcaataattttctctttgatgtctctttctttgcctggagactaagatgtttttcaagacggataccagttcttatacatcttggtcactcccctcagcacagtgcctagcatagaaagagaaaacctttggatgattgaataacttgcccagagtcaggttctcagtcatccaggcaggctttgctgctggagtatctttggttgttttctggggattacgttcgcttgccacagtttttctccccttttccttcttgcatatctggttctgattgagcctgaatttctatgagagcagatgagagaccactggatgtagactgggttagattgagtatcctgttgcatacaatcccacactgtaggatctgccttggcaatacctctgtcactcttttcctgcttctccccagtgtctcgactgcattgtgagagtgaatctttcaagatggatctaatcttagatgtaaacattcaaatttaccctgtagacttgggtaagtattgaatacagacaataataagagactttttgctgcttctgctattctttactctctgatattgctgttattttcaggtgacaagtttcggttggtcatagctagtaccttgtatgaagatggtaccctggatgatggtgaatacaaccccactgatgataggccttccaggtgagggagtggagaaggtaatacttgaaatatgccttgaggactaagtagataagtgatatagaaagactcttctaaaattcctggaataaatgatgatcagcagaatctgagtaaccttaaggaaatttctgcacttaagaattcaaacaggccaggcaccgtggctcacacctgtaacccaagcactttgggaggccgaggcaggaggattgcttgagtccaggagttcaagaccagcctgagcaacatagcgaaacctcactgctacaaaaaagaagagagaaaaaaaaaaaaggctgggcatggtgtcatgtgcctgtagtcccagctgcctgggaggctgaggtgggaggattgcctgagccagggaggttgaggctgcagtgagccatgattgcaccactgcactccagcctgggtgacagagcaagaccgtgtctcaaaaaaaaagaaaaaaattcgggccgggcgcggtggctcacgcctgtaatcccagcactttgggaggccgaggcgggcggatcacgaggtcaggagatcgagaccatcctggctaaaacggtgaaaccccgtctctactaaaaatacaaaaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaagaaaaaaattcaaacaaccaggtatttatctataacagtgattacatgcttgtgagttgcagccttttgaaggctgaggaggtaactgctgagtgacctaggccatgtgggtcttgtgtcttgggagggagcttggtgtgatggaaagactttggcaccccacttgagttcatttctcagctctaccacttatttgttgagtaaccttaatctccttcagcctgtttcctcatcaataaaatagagatggtcatgcctagctcatggggttgccatgaggactaaatgacatcatgtttgtaatgtgcctgttgttataatgctggcatttagttaccagtaaccatttttttttttttttttgagacggagtcttgctctgtggcccaggctggagtgcagtggcgcgatctcagttcactgcaagctccgcctcccgggttcacgccattctcctacctcagcctcctgagtagctgggactacaggagcccactaccacgcccggctaatttttttgtatttttagtagagatggggtttcactgtgttagccaggatggtctcgatctcctgacctcgtgatctgcccgccttggcctcccaaagtgctggggttacaggcttgagccaccacgcccggctgaccagtaaccatttttaaatgggatcttttatattgttaattactgttaagaataactttgctgctattgctccatagggctgaccagtttgagtatgtaatgtatggaaaagtgtacaggattgagggagatgaaacttctactgaagcagcaacacgcctgtaagttacgtaatcttgtgaggattcttttcctcttccatgttctgagactttgagctatgctcctgcttcctctgttgagtccctctcctcaggcacctcagaccgaggtgggaactagaaagaaatagttctgggagcagtttccagtctgaaatgtagactgccctttgtcaggccctcctggcccagtggtccacatgagaaactgattatctcactgtgtaaagtgcaaaggagacttgcttccccaggaataaatgcagcattaagtgattagactgttaggctttgtgtgtgtgtgtgtgtgtgtgtgtgtgtgtgttttgctactctgtaaaaggctgtgtgtgtgtgtgtgtgtgtgtgtggctactctgtaacccaatccctagttccttggttttcctgtccagctattttttcttttctttaaagtcttattaaaacaatatgtgctttttgtaagtaatttgaaatgcagaagagtaatgtgaagaaggaaaaaaaagtcacctgtaattccatatccagagagaaccttttacatagacttttttgcatatcctggtgttctgtttttttcttggagactgtggtgtttattatgttttcttctgctctttttgcttaacattatgtaaaacatgtttccccatgttagtgtaaagcttttcttttcttttcttttcttttttttttttgagatggagtcttgctgtgttgcccagcctggagtgcagtggcgcgatctcggctcactgcaagctccgcctcccgggttcacgccattctcctgcctcagcctcctgagtagctgggactacaggcacccaccaccatgcctggctaattttttttttgtatttttagtagagacagggtttcaccatgttagccaggatggtcttgatctcctgacctcgtgatccgcccgcctcagcctcccaaagtgctgggattacaggtgtgagccaccgtgcccggccggtgtaaagcttttcttaaacgtttcaatagttgcataacatttcagtaagtggatatgtcttgattcatttgaacattcccctgatttggggcatctaggtgttttccaccctcgataatataaagaacagtgccttgcacatatctgtgcattgatgtttgtcagaattttggttcctagtgacaaaacagtaggaagatgcctcttctgtttcttaggctgagatggaacagtgccttgcacatacctgtgcattgatctttgtcagaattttggttcctagtgacacaacagtaggaagatgcctcttctctttcttaggctgagattgagagctgctgagtggcagtgctccagaatcacgggatggggccttctgtttcagctctgcgtacgtgtcctatgggggcctgctcatgaggctgcagggggatgccaacaacctgcatggattcgaggtggactccagagtttatctcctgatgaagaagctagccttctgaacctcgcctgaagccagcctctctgccaagtcactcaggtcatgggcattgttcaagcctgagtggcagccgctcttgctcacctgttgaggaagggctggctcactgtccaccgtggcggcatctttaactggcctccactcaatgggaaactgactcgcctgtgaaagacacagtgggagagctgaaaatgaatcagaagctttatgtatatgatttttaaattaaactttactttttcagactgcccctcccctttttgtaaaaagtccatttactgtaaaatcgttttttccagtttgtctgtggtgtattgtttctggcccacagccagctgatcacttgtcaatgtaggatctattccagccttttggtatctgggttcagggttatctcagtctcctggctgactgttctcaacatttatcctccagtgtggttttcagtctgggagagagttgtgcttttggctcctgagggtaccccaggcccagaagataccacccatttggcgcagaattttgaattggcaaggagccctgctcatgtccttccaacactttcagtctcttaggaagtcagttcatgctgacttgaatgagtcacttgcatagtctagaaatgttcattatttttatggaagctttgggtagaggcttttagctacaggcatgggagatgactatgaagagagtaggacgagaggacttggtggttctggaagcagctggaggagctggctctctgctctacattccagtggtgacctgggagggagggtaagtggaagtggacagggcagcaataccaatgaagttggcaggccagagccagggccagtgccaggaccatgtagcggcctgactacagtcactaacttatgagtaggggaagaaaaaacattaaggaaatggctatgataagggctccagcatgtgagctggctcttcagcttggcattagaggtctctaggaaagcatatggggttctgttttcccctaggaagtttagggtaacaatccaaaaagattctctgtgcattaaacagttgtctgtttgatctggttttgcctgggagctggtcccctgctgggatacctggggtatttccttccccatcattttcggatcttcatgtgaggtgttagaaatagtatttagggaaatgggttgaaaatgaatggcctcagcagggaggaggaagaggtgtttcttttaccttactatgggtagagtagggggagggagttgggatgaatttttatgaaatcctagaacctttccatggggtgggtttttttgtggggttggagaacgacaaatgagagtgagacaaacgaattacaagtaatagtgtgtaggttatcatagactgtcctggcggtcttggggtagcagaagaaagagaactggtagagcattgaatagggataggagtgttctggttgtaattgtttttttgtgttagtgggaagaagggatgggaccaaccagactgatttgggaatgggttagatttgtaatagggcaggtaagttcacactggagaagcccatgagttactcgcatttgcccacaagtggagtaagtcacataccaataccagatgcctggaagtttctggtgacatttgcagttttgacattctatttctttttttcttttttttgaaatggagtttcgctcttgttgtccaggctggagtgcaatggcgcgatctcggctcaccacaacttctgcctcccgggttcaagcgattctcctgccccagccttccgagtagctgggattacaggcatgtgccaccatgctcagctaattttgtatttttagtagagacgaggtttctccatgttggtcaggccagtctcaaactcccaacctcaggtgatgcaccaccatgcccagctaattttgtattttttagtagagatggagtttctccatgttggtcaggctggtctcgaactcccgacctcaggtgatccgcctgcctcggcctcccaaagtgctgggtgtgagccaccatacctggccctaaagttttgccattcttgtctctcatctgtctgtgctgggaacccatcattctctggttctattggtgtatcgtgtcctaggtgctggcactttcatgtgctataaagtgtttcatttgattattaaatttaacccagctcaatatgtcagtaagttagtttccacttaacattcccttgactgcatgctggaatttgtagtatgaatgaactacttctcttccatgcagaaactgacagcatttgagatttggacaacatttttgagctttgtgcatttgttgattccttctctaggaaaactattctgtccgtgaagggagagagggacatgggaagatgtctaaattggtcacctccactaagaactttggttttctactcagaactcttttttttttttgagatggagtctcactctgttgcccaggctggagtgcagtggcgcgatcttggctcactgcaacctccatctcccgggttcaagactacaggcgcttgccaccacactcggctaatttttcatatttttagtaaaggcagggtttcaccgtgttggccaggatggccttgatctcctgaccttgtgatccgcctgccttggcctcccaaagtgctgggattacaggcgtgagccaccgcgcccggcctcaaaactctaactgttactccttaaggacttgtatgtctttcccagtaaacagaatcattaaatgacatataggacagtgtaccacactggagagagtatggaccctagagtgaggtcagactagggtgtttcttctcctgcccacagggcgtgtaaccactgataactcacctggcttctctgagcctcagtttcctcatctctaaaacagaaaagataatacctaccttacagagttgtgtgaatgttacaaaaggtaaagtacacgaggttcctagcacattgcctttcattctgctgctttggaatgcctttggtgaccctggggtatttgtggcagtgtttgggtttctgggttcctggctcctctacctccgtggtagcctttccttcctcaggggtcggggagaggaagaagcttccactagttttcctacaggaacctctggaggtagcaggttgatttttgcagtggaatttgtgtttttgtgcaacacaaaccttttcctgagcaccaaggcagcacttatttgcaaagccccataagcctgactcctttttagagatcccctagcagagtttatggtggtcacacagagctgctttttagatgcatttgcgggaactgggaaatgagccttcaacttgtacttgacttgtacttgttctcctgctgtgtgagctcaaggagcctgactcatgccacttcctgcacttcctcctgacctccacaggagggaggcaggcgtccatgcctggcaaagcctcctgctgagctgccaaagctctagctgtttgctcagctgtcacatccaggtcctgtctttactgaactgtctacacagccttacctggggtgtgaggctctccaaggcttcctgttagcttttttgtttggggtggcagggtgagggggatctattgccaccctcgaagaacatctttcccttgctttttagggagcttttcggcgctcccatttattccttatacaggctcagttttgtctagtgtatagggacagcatttctgagagaaagcttattcatttctcaagagtaaagatctgttaagaatatgggatcagagtcccactgagaatgatagtaaaggggatgggggcgttggaaggccttgaatttgaagcaaaggaaattaccctttctctgttttctgactcaaggttagtctctccctctgttcaactgccaggccagcccaggcctttgcagagttatcacagaaaaagagcatgtagagaatcagtgagttgcaaatttctgcagaaaatagaccaaagagctagctgctctgatgagtattgctgatagcttaaaaaaatagcttctgaaggtttataatgtacagtgaaaaatgattcccttttcagtcctgtgtatcccttttaccagggctttgggtttcaggagaaagtaggaaatcttgtccagttgtctcccaggggcgccctgcagggaagggagctgtacacgagacaatgctgatgtcggcagtgtctgagaaccttacccttcctgagacagattctgggagtgggtgtaggatgtgtttagaagagggctggtaggggtgggcgttggagcagaagggtcaggaagcagggggtggagctggaccacaggggtgggcaaggtgggtggaagagggaagagcgtatactgtccagtaggaggatgggttggggaaggagaatatccaggctggaggttgggtggcagggagcctgtgtctgatgttcctgaggaaatgtccggggctcctagggtcctgcgtgagggtccaggaaagagtccacgagttccattcaagagttcgtgtatcctgttcaggtatccggggatttggtccagggacctggaggtttggttcagcagaccaggaatcttggctctgaatccctgctgccacttcagaagcccagagccagtagttctggctgaggcagtgaagtttgtctccaacaatccagaagtcctgtttgggagctcgttcagtgtgaggactagagaggttctgctggggacagctgtggtgggtggggcccgcctgacgcagagggtggaccctcctacaagcatcaggaaacgcacctttcctcggagcaggtgttggaagctcaggaagatggcattgggatccttgtgagctgtggtcctgccctgtggaggaagctgagggcagaggatggtcctgaggccaaacaccagggccagatctcaggcctcccttgtctaagtaggaaagacaggatgccagtacccaggcattgtggctggcagggagcactcttagtagatcagctcttctgcccttgagctccctggaagagcccttcttccctcaggtcttctagggggactgagtcagaaaagaacagtttctacagatcccttgactggggacttacctgggttccaaggaggctctgcagggccccaaggaggagacggacctgtccagaaagctgccccaggagggatgagaggcaagtgggtcccagttgtccccgtgctgccatcactccctccagcagaagggtcactgctcccagaatgtcctgtgccttggtctcctcctgagaaagagatggaagagagaagcgcactgcctcaaagggcacactaaaagcgggtggggagccttaggagtagccagcagagtgaatcatacaggctgagaactggacaggaccaaggtcccacccagggcaggaattccttcacagtctcccgacagctggtcatcagcctctgcttcaaaaactcccgtgtcctctagtccagcctggtcttacacttggtttcagtgagaagagctccttttttcttacgttgctgaaatctgccctgttacagcttttacctcttggttctagtgctgcaaatttactctttctgctgcaaaaccttaggatcatttgatttttaaactgaatgaaggctgggtgcagtggctcacgcctgtaatcccagcactttgggaggctgaggcaggtggatcacctgaggtcaggagttcaagatcagcctggccaacatggtgaaaccccatctctaccaaaaatacaaaaattagctgggcatggtggtgggcacctgtaatcccagctacttgggagactgaggcaggagaatcgcttgaatccgggaggctgaggttgcagtgagttgagatcatgccactgcactccagcctgggggatagagtgagactccgtctcaaataataataataaataaactaaatgtaggtatgagactctaccataatgatcataaggatgaaaagaaaggactagaagggacccataggaactgcccttcttccctgactcagtcctgaaggaagaagggacgctagggttcttgaggatagattttagttttttaaactattgcccataaaacatgcttctagtctctttctgttcaggctgctgctttctagacacatgttagtttaatatggtccctcttaataaattagcatatgtcttcagggggatgtccggtgttcaggccagtatatttaagtgtagtccactcggaatagagttctgtacgagcatttccacaatggggatgctaaacatcaaacagacaagaattactagctttaagaatagcagcttcagtaatgttacatggtaagtttgggggcaatttaattctctcagatccttttcgtaggaagtgctagggccagaggcttaaatgatggaagcagggcattgtggcctgaaagctggaataggactttactcattaatttacacatgtagaatttttttttctttttgagacggagttttgctcttgtcacccaggctggagtgcattggcatgatctcagctcactacaacctccacctcctgggttcaagggattctcctgcttcagccttccaagtagctgggattacaggcatgcactaccatgcccggctaattctgtattcttagtagagacggggtttcgccatgttggccaggctgctctcaaactcctgccctcaggtgatctgcctgcctcggcctcccaaagtgctgggattacaggcgtgagcccccggcccacatgtagaagtttatatctctgttgtttcaccttgtttttgacctagtctttcagtgatttgaatcttgattcagtcttttgttattttagtggtacttcccagctttgtgtcatctgtggatgacatatgagtcttgcttcttcatgccaatttaagaagactgaacgggaataggtcaaaggcatggccatgagcgatttctctccagcttttcatggtgttcagcttcaaatctattcacatattggacctgcaagccatcatcttatccacaggctatcatcataggtgaatgtagattgggttagggtggccaagctgaaggtgagatatttttaaaaagctcaagaatgttggagaatccatgggaagcagtgggaaactgaagacaggacttagggaagccaaggttagggatggctttcttaccatctgggttttccattctcccaagctaaagtccacagcaggcagcaggacaggtgtaggcaaagggtgaacctctgggcactggctctgttgaaaaagattggtggggggagaagggagctgaaatagagagagctatggtagcctaataagcaggctagtcctccatgagtactatctctagacgagagcttttaaatgcgggctgtattgtgaagaataatccttgtcagagagtgtgatcagtaggtggggacaatatgggaagaatagtcattgggtcaaggagttagaggaagtgatggtgtcttcctgggagtatgggtgtcttaccagttacgcggataaaggggataatgttgggagttctcaccagtctgctgtgaaggacatgggagtcacgaagcagtttactgaggactcggaggtcacaagcaggaggagccgggctggacagcgttagccttgcagttaggagaagcatgaccacgaggagcaattcttagatgaggagaggtgaggttgaaagatgaggaggaaatcattgtcagctggtattccaggaattcccattcaggacccagacctgaaacccagggaatccacccctcagaccccttatttttgggagaatgggttcccccagcttcctgccccctgcagcgtgtctcctttctctctccccttctgtcatgtttccatatggccctagcccctcaggtgtgttctcaccagtcagctccattctggccggggtgtctggctggcgtggctccctgtttggggcctctcccctgaatccttcctggggccatggaggcggcttaggctcttgcacttctgggcagagtagggtggggcaaaggcgggccaagggtgaagaatctatcctgaaagtagcaagaagagtgaacatttaaccaagtttctaggaagagactgcctggcagggtgaacagatgctggggagggcttgagatgctgaccagcctggaactgccaaagccctgaattctctcacattttcttgtgatgaaagcatatggtgtgccgggtgcagtggctcatgcctgtaatcccagcactttgggagtccaaggcgggtggatcacctgaggtcaggagttcgccaccagcctcactaacatggtgaaaccccggctctacgaaatacaaaaaaactagcagggtgtggtggttcatgcctgtaatccaagctacttgggaggctgagacaggagaatcgcttgtacctgggaggcggaggttgtggtgagccgagatcgcaccattgcactccagcctgggcaataagagtgaaactccgtctcaaaaaaaaaaaagaaagaaagaaagaaagaaagaaagcaagaaagcatatggtgtctcctttttgtcaggactcctcagtgaatcggacatggatttggtgccacctacccctgctgagagcagcaggacatgatatgtatacacacatatcttaattagccttaaattctgagcaaccttggttgttaggtcagagaaaatctgggatggggatagagaaggaaagtattgtggcttcagcctggagaagagagtggaaaatgggatgcagggcctgggtgaggaactggcaaacgggcgcaatatgttgaggggtaacttctgcggtggggagtggggctggggaggggaactgcacaaagctgtaactgggaccactagaggtcaggattaaaaggcggtatgggagaaattaacctctattctttccctatctacccccacacataaagccactggagcttttctctggactccaagtcctgaaatactccattatctgaggccaagagatgggctaacagttctgggacttccttcctgagaccagctgcccaggaacgggcacctgctgggtgatgcccaccttaggggcttaccttgtcttaggcgcccactaacatatctgtctcatagctcacacctgcctccctgcccccttggcagaaccccttccggttccttcacaggaccccccacatggcttcctcctcctttcacaagttgtgcaaagaggcttgcacctgattcaatattgggatttcctgtaggtctgtcaacatgagtgggccctcctcccattaccctctccttgcgccctggcttgcctggcccagcttccccagcaccagattcagaaccttaagctaacgaggaatgaccagctaagaatggggattggggctgtgtccatcttactactgtgtttgctaagccctaagtgcagctccctctcttattttctccctgggctcatgtcccctttccttagggccagccagggctgtgctgtattccaccaagtaagtgatcagtccctcagaaaccagcaccccaccccctacccctgctctgccctgctcctcccattctgggaaggctacactcttctcgacaaaggtcagtgcctgtaggttccagtttgcctgcccctcccccagctgggagcccatttctctttgctgtcctttctaccctcacataaccccacaccctgctggccactcaccgggtggagaagggctccaggacccaagtgcacagcaggcagccctctggggagcagatgggtaggaagacatgtggcggtggggcacagcccctccacagcagcaggtcatacgcctgcctgggccacttctgcccaatcagagaagggagccaccagacactggtgaaggcccccggaagtgacgccttctcttccctggagcccctgcctggaccagggtccactcctccacccacacacaccacggagaagatttggatagggggatccatcttttcctggacatgggcaacctgggacctggagggggacaggagcagaagtttttttccaggaggaatctggcaggacatttgtgttgctggggaagaagcacagaggtcttgtttaagattggtggggttttcactccctggctatccaaatttcttttccctggacatcatacctgctgctgaaatccaacaggatgcttgctttcctgcttttctttctgtaatcccctagggagtcctatcttgtcattccccctttcgaagtgggaacacggatattgcccacatgagagaaatctcctgttatgggttggtgttatggggaaagggtttggacgggttgagtggactgtcaggtgcggggcacatgtatgtgcgcacacgtgcactgggttaagcctgagcttaggtgctcgtctgctggggtccagtggcttagatggctacacacacagacctctgtgcccagggccctcctttgcttgttctgtctccgtcttccatctcctaccgttccacatgtgacaagaggaataaccaggcccatgtgtccctgtcttaggaaagacagctgctggacctcccccgcaaatacctccctgctggccccccttttcctttggccctggctctagctcctttgctttcttcccagtcccagtctccccacagtctctgtcctcaggggcttcctggcctgaccttgatcccatcatccccctgtcccccagaacttcctcaggctctctcctgttcctcctccccaaggatgggcatgtctgctgagaagtgtggcctagatcctggaattttcccgtccagccagacgagatgtctcccaagattaggaaggagggtgctgggatagctgggaggatagtgggtgtgtgtgggagggagagacaggagacagggaggcaggcatgaccagggaaccaagagaaaggaggctgggagtgggctggagaggcagagggtcccttgggtgaaggaagggggtgagaaagcaagaggggactgtcgaatgcgcctgaggataagttacaatgagagggagatactgtcactccacagaagggggaatgctgccggtttctggctaggtccctgtcctgggtaacacaagaatgaggagcgacctcagagagaaggtagggaggcaggctaggcagtgagagagggtggtgagggtttggggggcgctgtgggcccaggcagggggagatcggctgatggacctttcctgtacgttgtcatctttaaagacaagtcttcatccttcgggcggaaccgggtcctcgctcacagagcggtccaggcctcaggcctagcctctgcccctccctagcctgaggctcccttcctgggctggacaccgacctcctggtccagccgccctgtggccgccagcagcggggggctccgggcccgcctctcctccccctcttcgcgccccctggtccctcccctccccctcccccgctcccccttcccctcccgcccctccctcctcccctgcccggtcccagcccctccctcccctcccccacccgcgatccgggccgctgctgctgggtcggaccccccgggctcagcccggcccctcgccgagctgccgccgccgccccgtttgctgaggaggaggcccccggccggggcgtcgggcgcggggcataaaacgggccggagccggcgcccggggcagtagagccgcgtacggcccgggtcagcgcccgcccgcccgcgctcctcccggccgctcctcccgccccgcccggcccggcgccgactctgcggccgcccgacgagcccctcgcggcactgccccggccccggccccggccccggccccctcccgccgcaccgcccccggcccggccctccgccctccgcactcccgcctccctccctccgcccgctcccgcgccctcctccctccctcctccccagctgtcccgttcgcgtcatgccgagcctcccggccccgccggccccgctgctgctcctcgggctgctgctgctcggctcccggccggcccgcggcgccggcccagagccccccgtgctgcccatccgttctgagaaggagccgctgcccgttcggggagcggcaggtaggtgggcgcccgggggaggcgcgggcggggagtcgggctcggggcgagtcagcgccagcccggagggggcgcggggcgcaggtggctcggcgcggcgggcggcccggagggtgggcgggggcagaagggcgcggtgcctgggacccgggacccgcgggcagcccccggggcggcacacggcgcgagctgggcagcggcctccagccaagcccgtccccgcaggctgcaccttcggcgggaaggtctatgccttggacgagacgtggcacccggacctaggggagccattcggggtgatgcgctgcgtgctgtgcgcctgcgaggcggtgagtgcaccccgcggccggcccgggccctggcgggtggggagcgccgggtcgcgcgggcgtcggagtggactcggagctgctgagaaggagcccagtcggcagatgttggggatatttttctggtggaggaaggggaatcagcccctccaattcttaggtgctgttactgatcgcccactctgtgtgaggctctgtgccaactccgtttcgttccctgctcatctaactctcatggcagccttgctagatagagagtattattatccccattttccagacagggaccttgaggcccagagagatgaagtagcttgtctagggtcacgcagcttgtaagtggcagagctggctgactctgcgggacatccttgcctgggggggtctcatcagttggcatcttgcactcacttgggtttcccgccttttccgggagcagcctcagtggggtcgccgtaccaggggccctggcagggtcagctgcaagaacatcaaaccagagtgcccaaccccggcctgtgggcagccgcgccagctgccgggacactgctgccagacctgcccccagggtaagtcttgctccgccctgcggggagggaggcagggccacgatactaggtcccgggccacttggatggggcgtcggactggcctttcccatggccagctgaagcccgtgttcttacccccccgcccgcagagcgcagcagttcggagcggcagccgagcggcctgtccttcgagtatccgcgggacccggagcatcgcagttatagcgaccgcggggagccaggcgctgaggagcgggcccgtggtgacggccacacgggtagggggctggcgaacagcggggttgtggttgaggctgggccaccaaagcggcgtttgacagtgctcaggccatcttcctcccgtcccagacttcgtggcgctgctgacagggccgaggtcgcaggcggtggcacgagcccgagtctcgctgctgcgctctagcctccgcttctctatctcctacaggcggtgagaaaggggaaggagcaaggaggggtcagctgccggggcccgggagggaaactgggagagctgggaggggctgcttttggctcagtccggcctcacccgacctctcattcccaggctggaccgccctaccaggatccgcttctcagactccaatggcagtgtcctgtttgagcaccctgcagcccccacccaagatggcctggtgagatgatgccatttatgagcacttgcccagtctgggcactgtgccgagagcatgctctgcattgcctcccgtggtcctcaccacagcccagtgggaggaaggcactgacattatgatgcccattttacagaagggggaactgaggctcagtaggataatgtgatttgttcaaggtcacacagctagtaagtggtgcagccaggattggaacccaagcatctggctccagcgttctttcttaagcttcctagggcaccctggaggttcctttccatgttcctttttcataagccctgcctgggcatcctaattggcctagcctgcacagtgtctgagcgtagggccttcttgtctctctgctccaggtctgtggggtgtggcgggcagtgcctcggttgtctctgcggctccttagggcagaacagctgcatgtggcacttgtgacactcactcacccttcaggggaggtctgggggcctctcatccggcaccgggccctggctgcaggtagggagcaaagagccccgggcgtgaagttctgagtcttctctatcacccaggaaagggggggagggtttctgacgggctctcatcatcgtcccttccccagagaccttcagtgccatcctgactctagaaggccccccacagcagggcgtagggggcatcaccctgctcactctcagtgacacagaggactccttgcattttttgctgctcttccgagggctgctggaacccaggagtgggggtaagtgggatgggggcaaaacacgtgagaaggttagggagagcacctgtctcagaaaggcccacatgtgcggccttgcaggactaacccaggttcccttgaggctccagattctacaccaggggcagctactgcgagaacttcaggccaatgtctcagcccaggtgagtggggatctggctctcgctgccacctgtcttggcctcttgctattgcccatcacaccctgctctgtccccaggaaccaggctttgctgaggtgctgcccaacctgacagtccaggagatggactggctggtgctgggggagctgcagatggccctggagtgggcaggcaggccagggctgcgcatcagtggacacattgctgccaggaagagctgcgacggtgaggcggggggggggcctggtgcgccgggcatgcacaactgagagacacagacaagtgccagggtgggtgtgggagagatcctgtggactgggggtgtaagcggccatggggtaaacctagcctcacctgtcttgcccctccgtagtcctgcaaagtgtcctttgtggggctgatgccctgatcccagtccagacgggtgctgccggctcagccagcctcacgctgctaggaaatggctccctgatctatcaggtaagagccaggggctgcagaaggtgggggaggggtggcgtgggcagcaggccccaggcctttactgcctctccactttgccctcctccatccctgcccatcaggtgcaagtggtagggacaagcagtgaggtggtggccatgacactggagaccaagcctcagcggagggatcagcgcactgtcctgtgccacatggctggactccagccaggaggacacacggtgagggctccaggtggagctggaccccagggcccaatgcatgggctgtgggaagccaggttggatgagcagggatgttcattatcatccactcactcatgggttctcccactcattcatttattcatttgacttttttttttttttttttttgagatggagtctggctctgtcaccaggctggagtgcagtggtgtgatcttggcttactgcaacctctgcctcctgggttcaagcgattctcctgcctcagcctcccaagtagctgggaccacaggtgtgcaccaccacacccagctaatttctgtatttttagtagagacggggtttcaccgtgttggccaggatggtcttgatctcttgacctcatggtccgcccacttcggcctcccaaagtgctgggattacaggcgagagccaccgtgcccggcatgatttgacatttttagtgagccccagactagggactagagtacaaagcaaatcatatgtggcccctgtgcttagcaagctcacagtcaaatgggagcattggacctggagaacagtgccacaggccacatattagtaaatgtaatggcaatggttgctacttatagggcctttccatgtgctaggtgctgcattggtggccttacatagtttttggctttcacagtatccatttgagagatgaggaagtgaagacttggagaagttaagttactcttgaaggttgttacatagctaggaagcagcaggggagggccttgaaactgggcctgccaggtccttatcctgtgtttctggtgtgtggaagtgtgtgtgggtggagtgggggcacaaaatggtccaagacttcagaaccttggactcgtgtgagagctgagaaggcctatcctcccctgcccccaggccgtgggtatctgccctgggctgggtgcccgaggggctcatatgctgctgcagaatgagctcttcctgaacgtgggcaccaaggacttcccagacggagagcttcgggggcacgtggctgccctgccctactgtgggcatagcgcccgccatgacagtgagtgtccttaggggtctgtctgccctttggtttcctagaacatttgagggatggtggcagacagccggagcctggtgtgtctttctttgtgcctaagctccggttgccatctgaaggtggggacatatagggtggccctgctggcggactcttcctgttgctgaggttcaagggtctaaaacttgctgctctccaggccctggacctatggacagtgtcttccagctcgtggaatgtgtgctggggagctgggaatgctgggtttgagggcttgccctaggccaccttctcacctgtcatctctcctctgtctggacccagcgctgcccgtgcccctagcaggagccctggtgctaccccctgtgaagagccaagcagcagggcacgcctggctttccttggatacccactgtcacctgcactatgaagtgctgctggctgggcttggtggctcagaacaaggcactgtcactgcccacctccttgggcctcctggaacgccagggcctcggcggctgctgaagggattctatggctcagaggtaaggatgtgatggtaggcggcagcttggaacatttctgttttttagcttgaagggctgtgtgggcctgtgttggggaaagcagagagcaggcagcctggtatagaagagctggcataaataaaataaattaaacagtgatttgtaggctgggtgcagtggctcaagcctgtaatcccagcactttgggaggccaggtgggtggatcacctgaggtaggaagctcaagactagcctgaccaacatggagaaaccccatctctactaaaaatacaaaattagctgggcgtggtggcacatgcctataatcccagctactccagaggctgaggcaggagaatcgcttgaacctgggaggtggaggttgcagtgagccgagatggcgccattgcactccagcctggacagaaagagcaaaaatccgtctcaaaaaaaaaaaaaaaaaaaaaaaaaaaaagagctggcatgggcttgggagtcagatagacctgggcatgactctgactggctttttattattcattctcctttctaagtctttttttggtggggtgtcttggatagtatgtaatatcctggacctcaggggggtaggtgggatggactaagcccttcaagtggggtgagttctcatggacttggtcagagagacctggcttccaagctccacactattgccaatgggctttgctaccatgaagactttatttaacctccctggctctcagtttcttcatctgtgaactggggacagtaggctcagccctaaagtgccttattcctatccattgtcctgtctatgtgcaggcccagggtgtggtgaaggacctggagccggaactgctgcggcacctggcaaaaggcatggcctccctgatgatcaccaccaagggtagccccagaggggagctccgagggcaggtaggtggcgagtgtgggcagtgggggcagtggggagggtgcagagttggaggggcactgtgtgccattgcactagtcacttgctgtctctgagtcctgggggtggtcgtatcacagcgcccccccggctggtggggaggatgagctacatgaggaggctggcagcccggcaccctatccctggcagctgagatgattgtggagcgaatggcatcctcctgggccactgcagcgctcagggggccgaggtgtctcctgctggctggccagctgccgctggtaaagacgcgagggggagccccagcgctgcctcagttggcctctcctcccaggtgcacatagccaaccaatgtgaggttggcggactgcgcctggaggcggccggggccgagggggtgcgggcgctgggggctccggatacagcctctgctgcgccgcctgtggtgcctggtctcccggccctagcgcccgccaaacctggtggtcctgggcggccccgagaccccaacacatgcttcttcgaggggcagcagcgcccccacggggctcgctgggcgcccaactacgacccgctctgctcactctgcacctgccaggtaggaggtcctggaagggcacactgggtcctgggatctggagcaaggggcctggacactcccgtcaatgcctctgctcctctctgcagagacgaacggtgatctgtgacccggtggtgtgcccaccgcccagctgcccacacccggtgcaggctcccgaccagtgctgccctgtttgccctggtgagttccccgcaggggagtggagggaggagttggcccagtgcggacaggtcctttggggagggaatgagggtggtcactctctgctttcaccatttctttggctccacagagaaacaagatgtcagagacttgccagggctgccaaggagccgggacccaggagagggtgagctggaagggtgcgtgcagggtgggaggccccagaggagccattaggttgaaccaggagggggacaagaaggggagagtatatagggggtggcctgaggggcacagattccaagtgatgcctgacaggactcattagtgttactggcccccaggtgggcccttggcttaggctcgtgtgggggtggcctgaggctcaagccttggttgtgggcccagctgatgagctcatactaatggctgctgggccctgttccccaccaggctgctattttgatggtgaccggagctggcgggcagcgggtacgcggtggcaccccgttgtgcccccctttggcttaattaagtgtgctgtctgcacctgcaaggtatggccacccaatcttctctggtgccataacccagcggggtctgcagagatggggaggggctgccaggtgaggaaggcccgtccttggtgaggagggctcaagaatcaaaacgatatgagaaaaggcccttgcgctctgagagtcggcttcctgtgggaaaatgaacagggctgacctgggtgtggattctggctctgccagctaactagtgccagtgaccctaggcaccttctgtccctgagcctcactttcctctcctgtaagcagatatgatggcacctaccttgcagggttctgatgaggagctgagtttaggtctataaagccagtccgggcctctgagtaaaaggccacagagagactgcatttgaggtgtggaataggagagggagtgggcaggaggcttatgtgccccctgcctgacactccttgctcaatggatccctacaggggggcactggagaggtgcactgtgagaaggtgcagtgtccccggctggcctgtgcccagcctgtgcgtgtcaaccccaccgactgctgcaaacagtgtccaggtgagagaggtggctgagcactgaggcctcacctttgggttgaggcaggctttgtcctgggtgaggggaagggtgctcagttaattgagcattatactgagcactgctctgtgcctagcctggagccaggactctaaatgcagtggaaagaatgtgatatactagtggggtatgatgggttctggttcctgctccatccatccgtccatccatccatccatccatccatccatccatccatccatccatccgtccattcatctatctatccacccatacaaccatccacccattgatgcatccatccatgcatccatccatccctccatccatccacccatccacccattgatgcatccatccatccatccatccatccatccatccatccatccatccgtcccttcatccatccattcatctgcccacccacccatccaaatttatcacctactaagtgccagaaactgcaacgtgctgggtattcaaagagaatactcataaaaccttgttggtcctcctgggctgatcctttctctttccctctcaacagtggggtcgggggcccacccccagctgggggaccccatgcaggctgatgggccccggggctgccgttttgctgggcagtggttcccagagagtcagagctggcacccctcagtgcccccttttggagagatgagctgtatcacctgcagatgtggggtaagtggggagcagaggcttgtgtgaggtgggtactgggagcctggtctggagtagggagaccttcccagggaggtccctgaagaagctgaaggtcactgtgtcccagtgcctctgggggacactcagtgtctgctctgtcttgtaccaggcaggggtgcctcactgtgagcgggatgactgttcactgccactgtcctgtggctcggggaaggagagtcgatgctgttcccgctgcacggcccaccggcggcgtaagtgagggagtccagggtcagcagctgtgagtggagggctcacctgcctgtgggactcctgatcagggaagggagcactcactgtgtgcaggaacagtgcagcctgcctcacaagtgccattccaatccaccctcacagcaacctggtggaattgttatttatgaccttttctttacaaatgagatttctgaagctcagagaaattaagcaacgagatgaaggtcacccagctgtgtgcactgacctgtttagaaaatactggcctttctgggaccaaggcagggatgctttgccctgccctctatgcctctctgtgcctctccactccctctcccctcctccaacattccctcccttctgtctccagcagccccagagaccagaactgatccagagctggagaaagaagccgaaggctcttagggagcagccagagggccaagtgaccaagaggatggggcctgagctggggaaggggtggcatcgaggaccttcttgcattctcctgtgggaagcccagtgcctttgctcctctgtcctgcctctactcccacccccactacctctgggaaccacagctccacaagggggagaggcagctgggccagaccgaggtcacagccactccaagtcctgccctgccaccctcggcctctgtcctggaagccccacccctttcctcctgtacataatgtcactggcttgttgggatttttaatttatcttcactcagcaccaagggcccccgacactccactcctgctgcccctgagctgagcagagtcattattggagagttttgtatttattaaaacatttctttttcagtctttgggcatgaggttggctctttgtggccaggaacctgagtggggcctggtggagaaggggcagagagtaggaggtgagagagaggagctctgacacttggggagctgaaagagacctggagaggcagaggatagcgtggcagttggctggcatgcctgggttccgcagaggggctggggatggttcttgagatggtctagagactcaagaatttagggaagtagaagcaggattttgactcaagtttagtttcccacatcgctggcctgtttgctgacttcatgtttgaagttgctccagagagagaatcaaaggtgtcaccagcccctctctccctccttcccttcccttccctttctttccctcccctcccctcccctcccctcccctcccctcccctccccttcccttcactctcccttccctctcccttcccttcccttctccttcgttcacagcaatggggtcttgctatgttgcccaggctggtcttgaactcctggcctcaagtgatcctcctgccttggccttccaaagtgttgggattacaggcatgagccaccacacccagcccagcctctaccttctttgtctaaagtgaggcaaacacttttctgtttttttcctggaaactcgtgttctggaccagttctggggcaaactggggtcagagtggattggaatcagctctgatccagcttttggctgtgcttaccttgagaccaaatcatgtagagaataagacaagaccctcctgccctgttaccctcttctctctcccctccctcattcctaccatcaagacccaggcattttgacaagctctaggaaatgagggtatcagaacagaaatctaacaaatgtatgtagctgcagatccatctttcatataaacaatgtggagtcaaatgaatctgggattttatgatctggtagggcaggggaaagggaaatcatagcttgcttatggagtgttaggcatgctgtatgtggttaagaagttattgtcttagcccattgaagcatcgagttccagttctgctgttaactagctgagttatttaactttcacaaacccccatttcccttttataaaacacatgatatccccctcacaggattcaatcagaacacgtgcattacacaagctcagggcctggcacgtattcgctgcaaaaggcactctccccgaggtgggatttgtggggctggtttggaatgaaggcagggagaatcgcagggaggagagtggccatgggcttcacttgcgtttggcaactgatatgctgctgaatgcttaggggagaggaggggctggactgaggattcagggatgatgaggatggggataaccacttgggccagagccctggctgttaataggaggatcgtgagggccagatagggatgaaaaagcagcagtattcagcacggggttaagtgtgggagtgaggcaccagttgtggtatgatggagatttggcccagaaatggtgtgctgacagtgttgtcctccttggtgtggaactttggtgggaagaagggttggaaagggaaattttgatccttggatttaacccgagtttgttactgatgctcacaagactaggggaaggaataaggcaggtgagtcactctaggatggctcagtgagctccacagagctggaaccacaggcaccaggagggattcagagcaggcctcagtgcacgtcagctgagtgaaccaatgagcaggtgatgggtccaggcagagccctgtcctctttaggcaaaaacccttgaaacaccgttcccatcctagcctgtgttccaaccaaagctggccagtctccaggccctgcctgagccccagggaagtggtatggtgaaacagaagggccagccctgtccagtgtgtgaggaacttcatttcagacttgttggaagccctgatgttcagagacctcaataatatcattcatttttcccatccattcaatgcccattcaatgcccatccattcaatgccccatccattccccttcaggcaactgcacattggtcagagagccctttccctttccaaaaaaccaaaccaaaccaaaaaccctgcaaaaatgcagcaaaatccaagcagaggaccattttcctgggtttagtatttctgtgtctcaaaacagttacctgtagtatttaaaatttgatctctcaccctggggtcagtcaggccttttacatggcagagggtttgactcaaccactgagcttctccagcaaaacagacagaagggaatacatacctgcttggctgaagaaatggggtggttttgatacaacattttttgaagagaaaactccttcatgtgcagtaatccactttgccaagttctccttgtgcgactacctcttaggcattccctagtgatactctgcccacttttaatataccaaatccagattgtgctaaggtaggtgatgaacagcaaacagtttggagctatggcatggtggtatgctggcagctgtcagttcacttttgtccatgtcaccagagcaggatctgtgcagtgacttaagaacaatagttttcaaatcttggccatggatatgtgaaattgccacagggcagagggacagatgggggttccagggacctcctgggagtgggagggccgaggcaggcagatcacctgaggtcaggagttcaagaccagcctgccaacatgatgaaaccccgtctctactaaaaatacaaaaaatcagccaggtgtggtggcgggtgcctgtaatcccagctactcgggaggctgaggcaggagaatcgctggaacctgggaggcagaggttgcagtgagccgagatcgctccattgcactccagcctgggcaacaagagcaaaactctatctcaaaaaaaataaaaataaaaaaataaagtcaactccatcttaaaactagcaggtaggccgggcatggtggctcacgcctgtaatcccagcactttgggaggcggagacagatggatcacctgaagtgaggagttctagaccagcctggagcctggccaacatggtgaaaccccgtctctactaaaaatacaaaaaattagccaggcgtggtggcaggcgcctataatcccagctacttgggaggctgaggcaggagaatcgcttgaacccaggaggcggatgttgcagtgagctgagatcgcgccattgcactcaagcctgggcaacaagagcaagactctgtctcaaaacaaacaagcaaacaaagaaacaaacaaaacaacaaaactagcaggtacgttccttgccagtcatgacccatggtcataagatgtctacagctcaggaagcagcttcacaatgcctgcaaagacaaactcctatgacagcagaatgtcctgatgtccccatatcacataacaatgtatgcttttatgatggttatagtcaagctttgatgtacttacgcactaaaatgccaaggatagttttctttaaatcagcaacataataaatgtcatgctgtcagtcccccacatgtagacataacttagcttttacatggataagaaacctatataagaaaaccttaggccaggtgtggtggctcatgcctgtaatcccagcactttgggaggccgaggcgggtggatcacttgaggtcagtagtttgagaccagcctggccgacatggcgaaaccccgtctctactaaaaatacaaaaattagcccggcatggtggcacatgcctgtaatcccagctacttgggaggctgaggcaggagaattgcttgaactcgagaggcggaggttgcagtgagccgagactgcggccattgccctccagcctgggcgatgagagcgaaacttcatcaaaaaaacaaaaacaaaacaaaacaaaaaacaccttagaagaggcgttcctcctcttgctttctgaagacactctacgctgaaacagtagctttcaataaaccatctcttctcaccgcactctgcgacttgccttgaattcctttgtgtgcaagatccaataagcctctcttgcggtctggatgagaacccctttttttggcaatacttctgacacaacaaaaatggcagaaaggagaggtctcatcatgtaataaaattaaggcagagaaagatttctctgggcatgctgaaagagacacagtttcacttgtcaaatattaggtagtcacatatgatgtgtgatgaaaaaagcctgtgtgtatggaatgcctacatagagggtattatggaatgctggaaatacattgttagggatgacaaaaggggaggacttattagagattgtggaatgactgtgctgctctgagaatggagcttacaacattgtttggctttgatacgttttcatgtacaaagggagctgccagaattatttttgctcttcataaaactaaatcattgttaacaattatggtaatatacaaatatgtgagaaggaaagaaaaatccacctgttattccaactcctggatagccaaccactcttaaaacaaaattactgatggctgggtgcggtggctcacgcctgtaatactagcactttgcagggctgaggcaggtggatcacctgaggtcaggagttcgacaccagcctggccatcatggtgaaaccccatctctactaaaaatacaaaaattacccgggtgtggtggtttgcgcctgtaatcccagctacttaggaggctgggataggagaatcagttgaacactggaggcagaagttgcagtgagccgagatcgcgccattgcagccttggggacagagcgagactccatctcaaaaaaaaaaaaaaaaattcactcagtatttttctaagtgttagtcagtgaaaacttcattacccagctttggccccgctcccactcccacgccaggttctacccctacagtgccttctgcagcgccttgatcctcacctgtgaagtggctgtgatgtcccagcatagggtatttgtgcgacagcttcaggagcaggagtgcacttctttctgcagaaataaggaaagctctggagtgcgtttaagggaaatctgacctttgcattgaaaatggccagggaggtacacaaacaaaaagtttgaaaaaaatcttccctagcttagagaatcgggcaaattttctgcaaactggctagagctcccccaggggaatccatgcttctcagctgatgggtgttgagcaggcctggaggttgtcctctcctcacgtgagcagcagagattggccagggccccagccatttcttgggaggagtcattcacagttttttcttgtccacctgccttggctgggctggctcagcctcttttggagcctccatttttggagttcgtcatgctccactgaggtgccaggcctactgtggggacagagactcctcactctctcatttgggcagtgggacaagcagggggcacagatagaggcagccgatgccagtgcaagggttgctgcctgacaggcattgaactggatacttctccatgcaggggcagaagggctgctgttgaggtcttgggaagacaactcggtcaagtacatgtgcttccggcccagcagctggcgggtctcatgagcctgcctggcaaagaggcctgtgagactggagcaggtggccatggctgtgaccttccacacttatggtaagaacaccctggagatcacaggcaaggctggttggtgctgctggtcttcctggtggcccggcagcttttaacatggtggcctgggtccctgaccagcccccgactctgagggaaggtggggaagagggagggaagccaggggctttctccccaacactaatataaaaaaaggaaaggacttgtcctttagggagaaaaaaagaacggaaaaaaaaacccccaagaatttgtccttcaaaacccgaaccttttgtggtcttttctgccttctataggggtagcagtggagacatattcttttttttttttttttttgtttgagacagagtttcactcctgttgcccaggctggagtgcaatgttaccaatttcttgcatataagaaaaaaaccttttaagaatggggatgtctaagatccaagtttaagttgtttgcattgttgtgatacagaccagtgtttttctttttctttgtattatttttatttttgaaatagagatggggagtctcactatgttgcccaggctagtcttgaattcctagtgtcaagtgatcctcccaactcagcctcctaaaaatgctgggatttcaggcgtgagccactgcacacatggcctagaccagtgcttttcaagcattcatgcacatgtgaatcatttgggagtcttgttgaaatgcagatgctgatcagaaggtctggggtgaggcctgggatgctgccttgccgacaagctgccaggtaatgctgctgctgttggtgcaggaacacattacgagtaacaaggctgtggacggcccatcacctgacatttttagcaaaatccgccatactacaaagcttcatgtaagtgtattcactcaactaatatttattgagcagcttcttttgtcaggtactcttttttttttttttgagacggagtttcgctcttgtttcccaggctggggtgcagtggcgcgatctcagctcaccacaacctccgcctcccgggtacaagtgattctcctgcctcagcctcccaagtagctgggattgcaggcaatgtgccaccatgcctggctaattttgtatttttagtagagatggggtttctccatgttggtcaggctggtcttgaactcccgacctcaggtgatccaaccgcctcggcctcccaaagtgttgggattacaagtgttagccactgcacccggcttatcaggtactgtcttaagtgctgggggttcggcagtgaattaaaccaacaaaaagccctgcccatgtggtttatagtctagtgggggaaaacagtcaataaatataataaacaagtcagttatatagtgtgccagaagaagatagtactatggaaaaaatagagcagaaggagaactgggaattccagagggagaggatctgattgcaattttattttatttgtattttgtttgttttatttttgttttttaaaattctcttttcagtcaggcttggtggctcatgcctgtaatcccagcactttgggaggccgaggtgggcagatcgcttgaggtcaggagttcgagaccagcctggccaacatggtgaaaccccatctctactaaaaatacaaaaattagcagggtatggtggtgcgcgcctgtaatcccagctacttaagagggtgaggcaggagaattgcttgaacctgggaggtggaggttgcagtgagcagagatcacaccactgaactccagcttgagtagacagagtgagactccgtctcaaaaaaaaaaaaatatatatatatatatatatatattatttatttatttatttatttttgtctttgcttttttctggttgcaattttaaaaggggtagtcagagaatgccccagtgaggtgacatggaaataaagccatggggatatataatactttttaaaaattcgtgaacgtgactaagttccttgtcaggagaaatgaagggaagagacctgccataatggtgagattcatgtgaaatcaataggttggtaaatatcacagtaggagaggaccctaagaaaatgagtcccttgggatattggggtgagaactggatctctacaaaaatagaggataaagtcttgattcaattatatttaaatctcaaaggacttagtgtttcatctaacatttaaatgatatgctatgtgaagatgaaatatgaccagagtgagcataaaacaatagctactacctggtacaatgaggtcacatccattcatgggtcagttatgcttgcacaagtttgcttacaagatgcaacccacccaggcatttgccagtctggaaaaggggaagaaggaagggggatctactcacgactaggaagggaccctatcctaaaatctccactcaagaagagttgcaatttaagcacatatcttgtggtcggaaacgtgagaggccaaaatgccacatgaagcataaattggtttccaggttggcagacaagggaggctggagtgtgaaaatctcactgaatgcctcctaaagaagcactgggccagaaaacataaagaatctcctggaagctctgaggcaaggggtgaatttgaaagaaggggaacagctgggtgcggtggctcacgcctgtaaccccagcactttgggagggcgagacgcgtggatcatgaggtcaggagttcaagaccaacctggccaatatggtgaaaccctgtctgtactaaaaatacaaaaattagccgggcatggtggcacgcacctgtagtcccagctactaggaaggctgaggcagaagaatcacttgaacctgggaggcagaggttgcagtgagccgagatcacaccactgcattccagcctgggcaacagagcaagactccgtctcaaaaaaggaaaaggagaacaaaggaaaggtggtggtgaggggagatacccagtggaccgtcttgaaagaggaggctccagatactggaggacaaaagatgcctcattctcccccagtagctccagcagctggaaccagcccagcctgtttttccttccaaaggagtaggggctcacctggggagaggcccagcgctcttccttctgacacccccccccacccaggtccgaggacatctaaaccagatttacaatactttcaggaacccaccacccatccctttggcaaaaacattcctgcacctgctggctgatgcctgaaattccttcagtagaagttttttcatctcaaactggaagatgagaattttaaaatgctaatgactggttaagatattaggtcacctgtttaagtataatctatcagtcaacaaatgtgaatgattattgtcagatcccattgctttttttcttttttttgagacagagtctggctctgtcacctaggctggagtgcggtggcacgatcttggctcactgctacctcggcctcccgggttcaagcaattctcctgcctctgcctcccgagtggctgggattacaggcgtgtgccaccacacccagctaatttttgtattttttaagtagagacggggttttgccatgttggccaggctggtctcgaactcctgacctcaggtaatcagcctgccttagcctcccaaagtgctgggatcataggcgtgagccaccgtgcctggcccccattgctttttttttttttttttttggagacagagtctcactccgtcacccaggctggagtgcagtggcgtgatcttggctcactgcaacctctgcctctggggttcaagcaattctgcctcagcctcccgagtagctgggactacattacctgccaccatgcctggcaaatgttctctattttagtagagatgaagtttcaccatcttgcccaggctggtctcaaactcctgagctcaggcaatccacccgccttggcctcccaaagtgctaggattacagtcatgagccaccgtgctggggcacggcggggggtgggtgggggcgggcattggtttttgataagagggagggttagagaaagggatggataacggaagggtaaggaggtaggggcatggggacttcacagccagcaggaacatttacagcggttgggttgtttaccttcaacagctccgcagaggaatagtcactgtgtggggaggaatttctgtcctgcgcatctgtgtgctcacccagcttagtgggaactctgccactcagacatatgattcacatcaactgtgtttttcatgagttttagagactttttttttttaaagcaaggctgacatcattatgaaggaactttttttttctcataggttccagccgaggtaccactggaaatggcaccagggaagaccttcaaaagaaggttttttttttcccctcccctcctccagaaataggtgagtgaggagacttcctgacttggctaaaataaaaaattatagcactttattgttgactgattatagatgtaacaattctccactggaaaagtttcagaaaatagaaaagtataaactgaagaaaatttatttacttaataaaattagaactgcaattcagaatgagcctcatttacgtttgatgttttccctagtcttttttatcctgaacattatgatgccatgatttatttcaaaatttcagatggtagttttagtgaatcatgctttttaattataaaaatgtttccttgaagtaaaaaattttggttaaaaaatcaaacaacaaaacaaactaggaaaaattctttgtggagaatacagagttttttttggagtttttcttctttctgtgtgttttgttgagtttgccttgtgtttatagttttatatctcttttccttgcttggctctattaccgcacatataagttttgccatagattgtcagaattttaagagaaacgatgctaggccaggcatagtggctcaatcctataatcccagcactttgggaggctgaggtgggtggatcacttgaggtcaggagttcgagaccagcctggccaacatggcgagaccctgtctctactgaaaatacaaaaattagtggggcgtggtggcaggtgcctgtaatcccagctacttgggaggttgaggcaggagaatagcttgaaaccgggaggtggaggttgcagtaagctgagattgcaccactgcactctggggtgacagggcaagactccttctcaaaaaaaaaaaaaaaaagaaagaaagaaaaagaaaaaagaaaagagaaacgatgccaggtggctgttctctttgcacatctggatgaagacccagaggctggggtgacactaaaactccacagcctgagccccatccagctgatggcaaagcagatacttcacaactgcgccttggtgagaagtgagtttggacaccccaaatgaactgcagttgggagcagctcccagctccagctccagctccctgttcattttccaagaggtggcaacagccagaaggagtctgagatgtgactcccagggaggaggggtcgctcctgaggatcagtccaaagttgctacaaggctggacgccctctctccatatagctgtggttaccttaacagtttgcaatgtgtgtattcattttggttgccaagaagactcagctgagtagatgtgggctctgtagacattgtgagaagaagggaggcagggaagtgtgctttgctagtgacttggttcttgaccaccatcacctcagttttgtgacgacttcccggaaatacggccagccttgaactggcagcagtttagtagagtggtatgaaccgagaatgacacttgttagctgtgtgactttggcaaggcatttgccatgcctgagcctcagtttgctgcaacatggtcttaatgatggttacctgcatgattgtcacaaggaccatagaaaacgtatgtacatgcttggcgtatagttggcactgaatgccgtcactgtaattgaatctgacaatgggtgtgagaaccattagggaggggtgaaatgctccccatgcccatgaaaaggtggaggggactcagtgctccggcttctattatgtgatgcgacaataactattactgtgggcatgaccacagcctttctacctttggcagcctgtcaaagggaatcttctggagccagcctcttccctcctttcccacccgagagaggaaacattcttgctgggaatgaggctgtcaatctacctgattaagagtgagagaagagaggtggggtacagcggtgagggctgtagggctggagggggtgggtaggtgtggaggagaagtcttcagaggcatgtgtgggtgagggggagtggaatgagagcaaagagattctaacattctgggctgtgtttataggtcttctttaatatttttcaagatatgaattaagtgaaatttctctttcttggtaaaatatatataacataaaatttacattttaaggctgggtgtggtggctcacgcctgttatcccagcactttgggaggccgaggtgggtggatcatgaggtcaggagttcaagactagcatggccaagatggtgaaactccgtctctactaaaaatacaaaaattagctgggtgtggtggtgggtgcctgtaatcccagctacttgggaggctgaggcagagaattgcttgaacccgggaggcggaggttgcagtgagccgagatccaaacagaaactctgtacccattaaataataacttctcaccctacctcctccagcccctggtaacctctataaccttgattctactttctgtctctacacatttgcttattctctatcctagacatcttatataagtagaatcatacaatatttgtcatttgtgttgagtttatttcgcttagcataatattttcgaggttcattcatgtagtaatatgcatcagaatctcattcctttttaaggctaaataatattccattatatgtacagtcattccttagtatccatgagggattggttccaggatccccgaagatgtcaaaatccaaggatgttcaagtctctgatataaaatggcacagtatttgcatataacctacacctatcctccatatactttaaatcctctctacttatagtacctaatacattgtaaaactatgtaaattattatgctgtatcattatttatttattgttatattgttactttttcattttattttgtcttcaatacatatacttatttttatttatttatttttttttttgagatggagtctcactctgtcgccaaggctagagtgcaacggcacaatctcagctcactgcagcctctgcctcccaggttcaagctattctcccgtcccagcctcctgagtagctgggattacaggcatgtgccaccatgcctggataatttttatagttttagtagagacagggtttcactatgttggccaggctggtcttgtactcctgacttcaagtcatctgcccgctgtggcctcccaaggtgctgggattacaggtgtgggccaccgcgcctggctgtcttcaaatatttttgatctgtggttgcttgcatccctgggtgggaaatcgtgggtacggagagggctgacggtatagtccacgttttgtttctcgattcatctgtcgaggaacatttgggttgtttccaccttttggctattgtgaataatgctgctttgaacactagtgtacaagtatctattcgagtccctgctttccattctttggatagatatttagaagtggaattgctggatcatatggtaattctgtgtttaattttggaatttttctttaagtgcctttggctgtcaaactgcatcttttgttctcacgatggttctcaaatcctttcattctgttatagtttctccccctctttatttcatgccattgatttgttggagacactggctaatttgtctctagagaatgatctaccgcttagatatatttgttccctactcacagtgtcatttaatttgttccctcatcccccatgtttcctgtaaactgaaagttaaatacagtcttcattggattctggttcaagtgtgtgacaggaatagcctatagaagtgctctgtgtttttcactggatcctatcaggagctaccaaaatgtacttctttttttttggagccagggtctcactctgtcttccaggctggactgtagtggcaccaccacagctcaccgcagcttcgacctactgggctcaagtgatccttccacctcagcctcccaagtagctgggactacaggtgcacaggtgtatgccgccatgcctggctatttttttaattttttgtaaagatggggggggggtctcactatgttgcccaggctggtcttgaactcttagactcaagtgatcctcctgccttggccttccaaagtgttgaaattacaggtgtgagaaaccatgcctgacaaaatgtacttcttaaacataaacataaatttactctgagaatgacccacctgggtatgtggggtaaaacctctttattctgtgacatgaattcttaatttatgtttattatttgtttatttatttacttttagagacagggtcttgttttgtcacctaggctggagtgcagtggtgtgatcatggctcactgcagtcttgacctccctggttcaagtgatcctcctgcctcaggctcccaaagtgctgagattacaggcatgagcctgtgattgtgcagtgggatgatctcagcttaccgcaacatctgcctcccgggttcaagtgattctcctgccccagtttgcattcttaatttcattcataatgctctggggtaggtactatcactcccactttatagaagaggagactgaggcttagagagattagataagatgtgcaaaaaaacactgttagtaagtggctgagctgggattcaaaggaagggacttgtggaacatggatttgacgggtcatttcagctttaagggagaggtcagctgtccaagggtccgcagactcagtgcccaggatccaggtccccttgaggaaggattcatggggcctcgtctagtccacagcgctctctagcaagttgtagctgcttcactgtagattttcgtgagatctgcaaggtacagaggatgtagaggagtggttctggcctgggagcttttacaagagaatgatgctctgttcctaaaccagaatctccaggaatggggtctgggcagcgacagttttaaaaagctccccggagactgtgatgcaggtggaggataggatgcaggcaggccttagaggcctgggcagggctgtgactggcccttccttggtgcagaactttccctcagagcaaccagccagggagggtgcagtgactttgctataccttgcttaaaagccatggtctgccgggcgcggtggctcatgcctgtaatcccagcactttgggaggccaaggtgggtggatcacttgaggtcaggagtttgagaccatctggccaacatggtgaaaccccatctgtactaaaaataaaaaaaaaattagtgagatgtgctggcacatccctgtagtcctagctactcgggaggctgaggcaggagaattgcttgaacctgggaggtggaggttgcagttagccgagttcatgccactgcacaccagccttggcgacagagcaagactccgtctaaaaaagaaaaaaaaaaaaaaaggaaaaaaagccgtgatcataatctattatttgtgtccatgagaagaaagattgttctgtggtggtaccagcagcctcaggaatctcctgcggaagcctcctaagccccacacacttgtgggttctgggtaagctgcttatctgtctctgcagtgtgctggggcaattgctgtcaactgccagaaggtaaggccaaagcctttccccttgctgtgcttctgcaggtgccctgcagtcagggatgagagtggaaatagtgatgggggttcgtttaaattagagcaatgccctggatcaacggaggtccttcttctcagttgctagtttcaccatcctttgctccatcggccgctgtctcccaatccctgcctgcacctctgtccctgctgtttgctggtcatctctgactaccagtctctggccacctcctgcacctctgacaagcatctgtcactctggccctcggtgcctgctgctcatgtggggatgacggcccaccctcatccttggtccttgggttgtggggcaatgctcactctttcaccactacctagaactctccccagacttctgggacccacggtcttcctagttccgtttagctttttaagggggaagtgggtgtgtgtgtttcatagcagaattgcttgagctcctaatggtggtcctcccccgcctcccactgggttttactctgcagccttttacagtgaggcacgcctcctcctccttcatcatcaccatcatgaccatgtgctgagtatcccgaactgacagcactgtgatgagagcgtaacatacacgtggtcctcagtaggagcgtaggaggattgatcgtaggaggttgttagcattgccatcccatccctatgttgcagatgaggaaaacaaggtacacagaagttaagtagtattccaagggaatgtggctgagtggattcctcatgagataattgctccccccacctcctgccccttaagctcagatctttgccttccaggagggaggtgagtttggaggattcaggagcagcctcccagagcaccctgattgttctgctgtccctgactgtcactccgaggtgctgagtctggcccacttcctcatgcgtggtgatttctttcttggggtacagtcaccgcacatgttacaggcctccactgggcctctatcccccacccccacccacacccactggagcattatcgctgcctgtgcctgagtgaacctcaatgtgattagggttcaagctgttttccgtcgggcacaaaacacatctcttaatgtctccaagcattttgtgacaacttagttggcacaagggtgtctacagggtggtgtcgcttaactccactggccactgtgtgagtggggtgcggggggtgggggggtggtaaggtaagaagtcaaaatgtcagtcatcatggtctccgagtgccaggattcttgctgaaaactgctgttgtttttcttatagtttttgctataccaaatacttagtacttgcataatcaaagtaaaataaacgtaatctgggaatttttttttttttttttgagacggagttttgctcttgttgccgaggctggagtgcaatggcacaatatcggctcaccacaatctctgcctcccgggttcaagcaattctcctgcttcagcctcccgagtagctgggattacaggcatgccccaccacgcccggctaattttgtatttttagtagagacggggtttctccatgttggtcaggctggtcttgaactccgacctgaggtgatccgccctcctcggcctcccagagtggtgggattacaggcgttaagccacagcaccaggccgggaaaaactttaaaagcatagaagaggcagggcacggtggctcacgcctgtaatcccagcactttgggaggctgaggcgggcagatcacctgaggtcaggagttcgagaccagcctggccaacatggtgaaatgccgtctcgactgaaaatacaaaaattagctgggcctggtggcaggcgcctgtaatcccagctacttgggaggctgaggcaggcgaatcacttgaacccgggaggcagaggttgaagtgagctaagattgtgccgttgcactccagcctgggggacaagagcgagacttctctcaaaaaataaataaatgaataaaataaaattaaaaaataaataaaaatttttaaaaagtacaaagaagaaaatgaaaatctaaaatcttaatacccaggaataactactgttgattttggtataactacctagactcttcctctgctgttatagatatgcatgattggggttatcatgctcttttggtcacaaataacagaaatcatccctaataagattaaccaaaaaggaaaatgtactcagatgatggagggggtttgaagaacgtggggcgcttggccttctgaggctggaaccaggagtcaggaagctgtctctgaacaggactgaggacaatggatttgttgaccgctcctcatgttttccccactctgtcccgctttggggattcctctcccagtccacgtggccctggggactgtcaatcacagagtttccaccccccccaacctgcagattctcacagacatcggggtgttctttggcccacttattaactcagggctgaagcgtgctccgagcgtccgagtcttccttgggataggcccatggacagcatggaaggagttctcatttccctagctggtgatagagtctggcccttctgaaggcttttataattacaatggggcaataactaaatccaagtagggtaaggaagtggagagaggaacaaggcaataccacacctacttagcagctggtaagctcaagtcattcttttttgctcaagctgattggatctgggtttctaccacttgtttctgaataaggcctgaacaataccatttatcttggctcatctgctacagtcccttctttttatttgtttgtttgtttgagatgaactctcactctgtcgcccaggctggagtgcagtggcgcaatctcagttgaccacaacctctgcttcccggttcaagcgattctcttgtctcagcctcttgagtagctgggattacaggcgtgcaccatcacgcctggctaatttttgtatttttagtagcgatggtgtttcaacatgttggcaaggctgttctcgaactcctgacctcaagtgatccacctgcctcagcctcccaaagtgctgggattacaggtgtgagccaccatgcctggccagtcccttgtttttgaatgcaggtctttgctgcttttccaagtccagaagggtgtgtccactgcctggcagtttctagatacccagtcccacccatgctcagagacttgctggttgtgtttgagtcccaaattcccagagaaggaatttgcttagagaatggaatcacacaggaatatgatggctgccaggggcccacctttgtggaggtgtggaagtgtaggtcgggagggatcacagagagagaaagaggactgttctgagccagacaggcctcctggagggatttcttaagcgtcactttgcatatttttgcgtgggcggccgtgatacagtgccactgattccttagtttctcttgccctgaagatgtcaggatctgccttttgctctgggccccctgcctcctgtctcctactctgggcctttctgctccttccctgggctccccctatccaccctttgctctaatcaaggctctgctctggacagactttgcattctttttttttgaggcggagtctcgctctgttgcccaggctggatggagtgcagtggcgcgatctcggctcactgcaagctccgcctcccgggttcaagccattctcctgcctcagcctcccgattagctgggactacaggcgctcaccacacccggcaaattttttgtatttttagtagagacggggtttcaccgtgttaatcaggatggtctcgatctcctgacctcgtgatccgcccgccttggcctcccaaagtgctgggattacaggcatgagccaccgcgcctggcctgcattatcatttagtcagagagacttgaagtatgcagaaaactccgatgacgcggagcgatgtgaggagcagtggggcccctggagatcacggagggagacatgctcccagctaggggaattagggcagatctcatagaggaagtgggtcttgagctgagccttggaggacccctacacgcagacactgcaagtggacggaaggacccagggccctgaggagagtgtggattcagtggggctggaggaggaatatggagtgggaggataaaactggacaggcaggcccggggcggcttgtggagggccctgaatatcatacatatctgcgctagaataaccaggggcctccaaagctcagggctgagaggatggctgggagttacctgtctctgtgggctgataccacactcagatgtgggagagcaggtccgtgcccagggctgggcctcagagggcccagtactttggagtgccttccttgcaatgttctaaacccttcttggatgtctgggctgggccgacagtgctagctgggctgggtgcccagtgcctggacggtctgtgtgggtcatggtttctagaagcctgttcctcaaacatttctctgatgacagaggccagccagagctgccctcctggcagacatgagtctgcccaggccctgtttctctcctttgtggtgttctctgccccctactcagggtgtgaggtcaatctgatgccctgaggagctccagcacgtatgcctattccaggagggaagcctggtgattgaattgctcccgttggcacgcacagtatttcttttgtgggatcatgtgagtttggtccaccttaatttgtcagacacaggatgagttcaaggttctgggctgcagatggtccactaccaactcttggcttgattgtgagtgtgcctaggcatcagccctcccactgcactccagccacagtgctgcctcaggtcgacagtactcgagtgtacccgtgagccctcctcactttgtcaatggcactagggcggccagcccagcccttctgtggtctccacaccacgtcaggcagtcctctgagggtggcccacctatctcctccgagggccctcagcactggctcacaacaccaaggggccttcccatggatgtcctgcttgccttgacagttatgtgagaaccaaggagactgttctctctgtccatgggccccctggccgatccttcctgctggtggtgtgtggagctgtagggggtcagcggggagaaagatcacattctagggattcggcaattatggcctgaagagttctagagcagtcatgtttgggtgatgtgctgttttatgtttatgctctacaattctaaatgatacatttaatataatcagaacacaaagaattgctctttttttttttttttgcatactctgggtgagacttgccttggtaatcattatcgaggaatcaccatcaccacctttgagagagccactggaagccagtcctcaggggctgcactgcggatgatgcagtgtggaattatgatgcaaccagccttaaatacatggtgttaaggaattgcagaggcaaaaaggtctatattgtttcaatataaacaggttttctaaagcaatgacattgtggataattactgtcttgctacctgagatttatgaagttagtcaggaatgacaaatttgatcataacaaatgtgaagagacggggccgggcgtggtggctcacgcctgtaatcccagcactttgggaggccaaggcggcggatcacctgaggtcgggagttcgagaccagcctggccaacatggtgaaaccccatttccactaaaaatacaaaaattagctgggcgtggtgatgtgcgtctataatcccagctacttgggaggctgaggcacgagaatctcttgaacccgggaggcggaggttgcagtgagctgagatcacgccattgcactccagcctgggcaacagagcgagactccatctcaaaaaaataaataaataaattaattaattaattaaataacaaatgtgaagagatggttcctggactcaacaggaaaagatgggtcctgtacattctgaggaatcttcatgttcattgactggacaataaacaaatacaaaaggacctcttcaatcaatctgtatcactcctgtggactcatgactttttgtaatacattataaaatgaaattgttcatgttgacaggagcccacgaaatgtatttgcccagggcctgcagatcctaggagtgcttttgccctgggcagtactggagagaccataggcccctacccgccacccctgtggcagttccatccattctggccttgagggaatggtcacttcccgcccttgggacccaaggctctgcatcctgtgcctgcatgctggcctggccccatgcaccaggtagacacgggggacaagaagtgtgtcatggcataagagacctggcgtggggaaggaaaagtcacaagtcaggaggaagagattggtgggaagagacatacgggtcagtctcttttgaaaccaggtgaacagccctagccaggtgtccaggctgtaagccagggactcgtccttgagtccccccgtccttcacccccacagtcagttagtcactatgtccagccagttctgcctcatatatatggagcttgcatttgccaaggttctccggagaaataggaccaataggaggtacatatgtacatcctattattattattattaattatttgagatggagtcttgctctgtcacccaggctggagtgtggtggtatgatcttggctcactgcgacctccatctttcaggttcaagcgattctcctgcctcagcctcctgagtagctgggactacaggtgcgtgccatcactcccggctaatttttgtatttttagtagagatggggtttcaccatattggccaggctggtctcgaactcctgaccttgtgatctgcccgcctcagcctcccaaagtgctgggattacaggcgtgagccactgtgcccggccgtacaagctattattagatatactacgtattacgggacttggatcatgtgattagggaggtgggaggtcaagaagtcccaccgtctgctctctgcaagctggagacccagaaatgctggagatgtaattaggtctgagttcagctatctgagaaccaagagctctgatgtctgagggtgggggaagatgtcccagctcaagaggagagaggaagaaaatgtgttcttcttccacctttttgttctatttgggccctggggatgacacccacccaccttagtgagggtggtcttccgtgcttagtctactaattccagtgctaatctcttttagaaacaccctcacaggcacacccagcagtaatgttttcttagctatctgggcacctcttagctcagtcaagctcaagcataaccttcaccatcacagagctattctgacttccacctcctcttcctcctattgcccctgcctcagttgaggccttgcggtctctgtcctggaccactgcaataggttcctcattcctcttgctctgatggtgctccctctccccatctcttctagacatttttctctttccatttggtatctatttttttttatgacagctttaaatgcatctagttttttgttttgttttgcttttttgagacagggtctcactctgttacccaggctggagtgcaatggcacaatcttggctcactgcaacctccaccgcccaggttcaagtgattctcctgcctcagcctccctagtagctgggattacaggcgtccaccaccgcgcccagctaatttttgtatttttagtagagatggggtttcaccatcttggccaggctggtctcgaactcctgacctcaggtgatccccctgctttggtctcccaaagtgctgggattacagtgtgagccaccacgcccagtcagttctagtttaaagagtcaagtaactcaagatgactttttaccaaaaacagtagcctcttcccatccttcctcttcaacccctcccccactcaccccaatttactgcttcctataggcaaccactttccactcacagagctgattgctttcctgcttacctgagtgtgtatgtgaggatgaagggaggatgcttcgttgcaagctttgctgcagaatggtctgggctgggccaggcttcttaatgaggagtgtggatgtcagagtctttagggctttctttgtgggctagtcaggttcctgcagatggctcttccagtcctggcagggattagggacctggctgccagtgttggggagaagacagggaagaggctggggacagggcatatttctgtcttcgacttgtaactcctgtttgatcccatttttggtgtggtggccctgccctcactctgcttgatgtgctagttcagagacccccgattttacttttttagaagaaaaacacccaagtctgtgaaggagcaggagaagatgaggtggggggaggagccaatccccagttgtcctgtttttggctccatctttaccggcctcctcttccctgctttcagaggacctggtgccaccaatacctgaaccatttgtgggtctggggtctaaagaaaattggctgtttacttccctcatggttcaggattgagctttcttggttctaatacgttggttgccatttttctagctgctttccagtttcaaaatgttgctatcgatgtctcttcagttctctttttccttatggatttttttgtcttaaaaaaaaaaaaaagaatttcagaaaggagtgaggataaatgtacgtgcccagtccaccactgttaagctactggagagatccttctagcatttcaatctgattatgtcttcctcccgttcaaaatacttccatggtgccccattggcagtaggataaaatatagaagccttgtgaatggcgtttttgggctatgccctaaatcagggctcactcctctcctggactagactgtacttgattctattaattttaatgaaacaaatttcaggacacctagaaacggacagactcaaaacgtttacttttttcccctattaaatggcaacgctagaacaatgcttagctatcaccttgcatgacctttagttctttctcgctgggaaactgtaattgctgagcagttaggaaccctgagatgactgggtttggtttgggttaaagctcaatgccggtgtggggtgtgtgtgtgtgtgtgtgtgtgtgtgtgtggcatgtgtgtgtatatgtgtgtgtgtggcgtgtatgtgtgtgtggggtgtgtgtggtgagtgtgtgtttgtggcacgcgcgtgtatgtgtggcatgtgtgtggtgtgtgtggcatgagtgtgtgtgtggcttgtggtatatgtgtgtgtgtgtggcgtgtgtgtgtatgtgtgtgacgtgtgtatgtgtgtggtgtgtgtggcatgtgtgtttgtggcgcacatgtgtgtatgtgtgtgtggcgtgtgtgtggtgtgtgggtatatgtatgtgtgtgtgtggtgtgtgggtatatgtatgtgtgtgtggtgtgtgtgtatatgtgtgtgtgtggcgtgtgtgtggtgtgtgggtatatgtatgtgtgtgtgtggtgtgtgggtatatgtatgtgcgtgtggtgtatgtgtatatgtgtgtgtgtgtgtgtgtgtcttccttcacacctgcagccttgagcctctgcagggaatttccagtttatgttgccagcaactagaaggcagactcttttttgtattctttccggggcataaattgcagctggtgatgaaatgtattcaatctctctcactactaaatcacatcggaccacacagatacttggcctaggtaatcctattagacctaaaccaaaggggcaggctttcccctagatggatcatgaagacgcaaaaccgtggggtgggctggcagggtcacccgaaagtgaggagcactgccatctgttttctcttccctcttagtgataacatgaaggaattgtcccgaacaagtgcatttcccttcggtaggcctcactaccgaggctattgatcagcttactctattaccacatcaaaggaaaatgccatcatgggtggctccggcagagcatttgggttcttggtgattttgctaagaatctctgaggagaggcaatgaaggctcttaattgcatatttcctgtgtactcatccttcttctccaaaacaaatgacattagctttcttttttttttttcttttttttttttgagatgggagtctctctctgtcacccaggctggagtgctgtggcactatcttggctcactgcaacctccgccccctgggttcaagcaattctcctgtctcagcctcccgagtagctgggactacaggcgcctgccaccatgcccagctaatttttgtgtttttagtagagacggggttttaccatataggtcaggctgctctcgagttcctgacctcaggtgatctgcctgccttggcctcccaaagtgctgggattatatgcgtgagccaccgagcctggcctaactttctatttcaactgcacagaactacccatacgtgtcagcaggggcctactttccttcacattaggttttcacagtcttttccctctgcctggaatacctgctctgccttttctgctccagctaggttggcatatttgcaggtttcaaatctgcctgtcatattccatcctcagagcctttacgatgactgttccgtctgcctggaatgttccgccctgacgtttccgcatggcttgcccttcatttcattcaatctccacatttccactcaaatcctacctctcagccatcactgtcaattgccctccacccgaagaccaccaggatcccacctatagtggagcacttggggtttatggctggttgcagtgaaggggaacgcacgccatggggcactgtgggcgtatcagtgagggggtgtcagaaagaacttgtagggtttgggcttgtttctgtctagttccatcacagccacagagtggccttgtctgatgttgatgttctgtgaaactgtttatgttcaacaggagagcaccatgggcctgcagtgagtgccaggccaaggtctggacagcaagaactgctttactcttcttcaccactgaatccttagtgcatagaacagcagctgcagggagggtggcaggtgtcgaatgaaaacgtatcgaatgaatcgatcaagtctgtctgcctggcaaattcttactccacattcaagtgcccagccagaagcccctcttctgggtgccgtccctgactctcctgggcggaccctgatctgggcccgggctgtgcctgcagagtctcactagagcggctcctgtgagtcatgtcagggggctctgcagccagtctccccactgtgctgcgaatgccttgaaggcagagacacatcccttcccttagaagccccagtgctaaatacagagcaggtgcgccataactttagtgtgactgacagaccagctgcaggcccagctctgctgtgtttgaactgtgcctctggcaggggctccagaattctgtgtgtgttccctgagagtataggacctgtgggccactgggtgggaaatcattaaacaggagaagcccaggccccagcagccagagggtatgtttgtgagtttgtgattctctgggacaccttcagggcctgaggactttggcccccatgtgaggcctctgcagtgtgactccatctgggcctggctcctcctcaaaaaatgcccccaaccaggagcggtggctcacgcatgtaatcccagcactttgggaggccaaggcgggcggatcacctgaggtcaggagtttgagaccagcttggccaacatggtgaaatcccacctttactaaaaatacaaaaattagccaggcatagtggcacacgcctgtagtcccagccactctggaggctgagacgggagaatcacttgaacccaggaggcagagattgcagcaagccaagatcgcaccaccacattccagcttgggtgacagactgactctgtctcaaaaaaaaaaaaaaaaaaaaaaaaagacccccatccctgtcgcccaaggcccagaggaggctgatggaagcccgcagtttccaggaagggcagaggaagaggcagtaagagcccaggcacctccaaaacaggggccatgggcggggggcggagagggaggagggacctggttatctggctctattctcacagcaaccccttaaggtatatacaactattatctttattttacagatgaagaaacagaggcacaaagaggttaagtaacttgcctagagatacacagctaacaagtggcaagtgggatttggactcaggtctatctaatcctcaaacccatgtcctggacccctacacagactgccctccctcagtcctctgtgtggcctcaagaagggtctggacattcaagtttaaaaatccatccaaagaatctatggacccagtggtctctggagtcaatgttctgaggctcagaagggccaggcaggagggagccgcctctacacagtcctgagcagagtgggctgtgtcccggcacagcaggggagatcatagacagaattctgccctgggccctatttaagtaggacctttaggctgccggtgtcatgaccacaggtcccaggtctgcacgattggctgtgtgtggaaaatcttcactccttgcggccttgtccttggcagagagcaccgctgcttcctctgatggccaccagggggaggcgctcccctgggaacggtttgaaggggagcctcaccccacacgtgccttccgtggtacccagcaccagctgctacccatggttacccacaggcccagctctgctctgaggagggaggagtggtggcgatcaggccttgtctgcatcccgtggctgcccctttcttttctttctttctttctttttctttttttttttttttttgagatggagtctcactctgttgcccaggctagagtgcaatggcacagtctcggctcactgcaacctctgcctcccaggttcaagcgattctcctgcctcagcctcccaagtagctgggattacaggcatgcgccaccacgcccagctaatttttgtatttttagtagagacggggtttcaccatgttggccaggctggtcttgaactgctgacctcaggtgatccacccacctcggcctcccgaagtgctgagattacaggcgtgagccaccgcccccagacgtggcctcccctttcaaagaataaccctcagcgtgtgtgtgtgtgtgtgtgtgtgtgtgtgtgtgtgtgtgactggggaacacacgggctcagtctgttatcctgagaggaaattcatagtgaagcataaaagcccctgagtgggctggggacagtggctcacacctgtaatctcagcactttgggaggccaaggtgggcaaatcatttgaggtcaggaattcaagaccagcgtggccaacatggtgagaccctgtctctactaaaaatacaaaacttagccaggtgtagtggcgcatgcctgtcgtcacagctacttgggaggctgaggcaggagaatcgcttgaacctgggagatggaggctgcagtgagccaagatcccaccactgcactccagcatgggcaacagagtgagactccatctttaaaaaaaaaaaatgcctattggattttaatgaaaccatctctcctcttttacctgaatgaaagcagacatgggactttctacaggtacggcagcctcacaattcagtgctggacttccagccaagacggcagagtgggctcacgctgtggcctcctctctctgttccaaacacacagcaatcaggaataaaatagaaaaaatgataaacaaaaggacatagttgggccccaaccaaaatggctatctctgtgtaccacaagcagatcagaaatgcaaattggtgactggggccaggggcctgctggcctcggggtctggaaacagcagtagctgccagacacagagctcctggtaagggagttaaagtgctccatgctacaaaggggccaacagccaggtgtctggaagccagggctcggggaaggttccctctgcttgtgaaaagaatcgggggtggcggggatggagtgaggaagccagctgtccacaaatagcttggggcttgagttgtgggaagatgaggacagactcttgactagatgctgagccaagccaccctctggctacgtgcttgtagctgtggtgtcctcatgccacaacagagtagagccctgcaatgctattgtaagacctcaactgggcctgaggtcctagctcaggatagttagagacagagtgaaaaacagatgtaaaaacaaggtggaaaaccctccaactcactgtaaagttgtaagccaaaatagatgagaaacaatggtaagaaaaacagtcaacaaggccgggcgtggtggctcgtgcctgtaatcccagcactttgggaggtgaaggtgggaggatcacctggggtcaggagttcaagaccagcctggccaacatagtgaaatcccatctttagaaaaaaaaaaaagcaagaaagaaaagcagtcaacagaatcaccatgtggaatatgagttcactgcagattaaattaattttgtgaaagtcttacaaagaattaaaaatgtttaggatgccaaaaatggcaaatgaaggcttaatatccattggaaattaacaagacataaatgaaggcagatcaaaatgaaactagaacaagtagatgtgaaaagaatcaattagaaatcttagaaatagaaagtttgttcattaaaagaaagctcagtagacagaataaatgatgcaaaaagagaattattgagttagaagacattacttaggaattaacatgaatacaatacacaaagattaaaaaatataaaagcagttatgagatatgaaggacagcttgcatgaagggctatgtatgtctaataggagtttcagaggaagagaataaagggaatggcagtgaaaaatacatgaggaaatagtagctgagaaatttccttggggaaattgcagaacatcaagggcaaagagaataaaaccttaccatggacctgagaaaaagacagattacttaaaaagtaatttctggacctcagcaaagactgaggctggggatgagggggtagtatcttcaaagtgccaattggatttttatgcccagctaacttacagtggaaatttaagacaaaaggggcgtttcgatacatgtaaagtgcagcccctcatttaaagaattattataggttatacacttcaggaagaaaaatgaaccagaaaaaaaggggagagcacatgaaacactgttaagcatagaaatagataaaacatgttgataaatttaaatgagtgttgactacaacagaaactcctttattttttatttatttatttttgagaccgagtctctgtcacccaggctggtgtgcagttttgtgatctcggctcactgcaacctctgcctcccgagttcaagcaattctcatgccttggcctcctgagtggctgggacaggcctggctaatttttgctttttttttttttgtttttttgagacgatgtcttgctctgtctccaggcaggagtgcagtggtgctatctcggctcactgcaacctccgcctcctgggttcaaggaattctcctgtctcagcctcccgagtagctgggactataggcacgcaccaccatgcccagctaatttttgtatttttagtatagacggggtttcaccatgttggccaggatggtctcaaactcctgacctcgtgatccgcccgccttggcctcccaaagtgctggcattacaggcgtgagccacagtgcctggcctaatttttgcatttttagtagagatggggtttcaccatgtttgtcaggctgttcttgaacttctgacctcaggtgatccaccctcctcggcctcccaaagtgctgggatttacaggcatgagccaccatgactggccaaaaactcatttaaacttctcatttttattaaagatatacatattcatgtttttttagaactcaaataactctgcagggcttatgtgggagccagcttctggtctggccccagtgatcctcacctcctggtgctcatgcccttgtgtcacacctttccacaatgaatagggctgatctgtgtaaccggtagggtggtgcagaaaataatggtgtgtgacatctcagcttaagtgatgacagacattgcagcttccacctgtttattattgttattattgttattatttttgagataggatctcactctgtcgcccaggctggagtgcagtggcacaatcgtggctcactgcagccttgacctcctgggtgcaagcgatcctcctgcctcagccacctgagtagctgggactagaggtatgtgtcaccactcccagcatattttattgttgtttcaatcagttattgttatttcaatagtaatagagaactgatacactcacttatgaacataaatacaaaagtcataaataaaatatgagcaaaatgaattaactagcctatttttagagtttaatactagaatgtaagaatgtttaacttaatttatgaatactactcaccatattaaaaaattaaaggagaaaatattgatcatcttaatagatgcagaaaattcatgtgataaaaaattatatccattcatggtaaaacttaaccaaatttggaataaaaggaagctttttgaacatgataagggttatctaccaaaaatcaccagcaaacaaactcaaatggcacaaatcttttttttttttttttttttgagatgtagtcttgctctgtcgcccaggctggagtgcagtggtgccatctcagctcactgtaacttttgcctcctgggttcaagtgattctcctgcctcagcctcctgagtagctgagaccacaggcacccaccaccaaacctggctagtttttgtatttttagtagagatggggtttcaccacattggccaggctggtcttgaactcctgacctcaggtgatctgcctgccttggccttctgaagtgctgggattacaggtgtgagccaccacgcccagcccagaagcattcttttaaactcaggagtaaaacaaggatggctgttctcatcacgtcttttccacattggagaacctagcctatgcaataatataagaaaaatggtataagaattggaaaggaagaaatccaaatgtggctaacctcaaaaacataaagttgagcaaaaaatcactttgtatcactttgtaaaatgacatacagaatgtgatacattttatatatagtttgaaaacgtaatgggtatgtagttacatatattttatatagtataaacatacaggagaaagataaatgtcagaattccatagagctgggtgttgggtgcttgggtgtcagatatgttagtgtctttacttttttgtttgaaatattgtaaaaggaataacaatccagatttatgtaacttagttaagaaagaatggcctctgagctccttgtgtgtgcaaatttcatgattctagggttcttgacatccctgtcctgctatattgtgaactccctgaccttaggggcattgtctttttttgctctttatatttctagggcctagcatggtatagatgttcaacctgtgtttgttgactgactgagtgaatggagaaagagggaaatgcaaaagaaagaaggaaaggaggaggatggatatgaactctgagacaattctttgactgcctgcatctgacatggacttgtatggaaagaagcagatgggtttaagcaaaggtagggaaattagctcagctggacttcaggcatgattagaggaagaagtccaggatgttttgtgagcctcccagtagaaggatggcgttgatggcatcaccatctaggtagggagcccagaaggacatgcacgtttaggaggataagtgcagtctaattttagacagggctgtgagacctccaggtgtaaacatccagcttgtactaggatatgtgggtctagtgcttgcgagagaagctggggctagaaatggaaactctattgttataggagaaaggtgataagtagcatggtaatccataagcttctccagggagagtggggaggatgaggagaggaggaggctgctgacagagtcgtggggagcatcaacatgtaaggactgggcagagggaaataactcaggtgaggaggctgagatgagaatccaaagaagtaggagaagaacaggagaggcaaggaaagaaagcttcaggagagagtgagttcagtggggtcagataaggaaaaaagatcaagaaatataaaaactgaagtgtcctttgaatttggcaaatggcggtcacttgtggcctttgctggaagagtttcattagagaagtgggaggagaaacaggttgtgctgtgtcatcagtggtggtgagctaaatccaagtaaatgtgctagactgaatctcgaaacccactttttttcagatgcctagccttgaggggtggagacaggttggccgatgagatcatggggtggatttgggggataggaaatagttgactcaataaactaagagaaggaatctgaagacagatttaattgtgggagaggccaggtatggtggctcatgcctgtaatcccagcactttgtgaggccaaaccaggagaatcacttgaggccaggagtttgggaccaacctgggcaacacagtgagacccctatctctaaaaaaaaaaaaaattgtgggagaaaggggagataatggatgaataaggttttggaggaaatggaagaatgtacaaataccagcaatactgattagtcctgctaatactggtgctagcaaacacttacagagccccttctatgtgctgagagcttttctaagtacttaacatacatttggctcatttaatcttttttttttttgagacagaatcttgctctgttgcccagactggagtgcagtggttcaatctcagctcactgcaacctctgcctccaaggtcaagggattcttgtgcctcagcctcctgagtagctgggattacaggtgcctgccaccatgcctggctaatttttgtattattattaatttttttttgagacagaggcttcactcttgttgcccagactggagtgcaatggtgccatctcagctcaccacaacctctgcctcctgggttcaagtgattctcccgcttcagcttcccaagtagctgagattacaggcatgtgccaccacgcccaactgatattgtatttttagtagagacagggtttctccatgttggtcaggctggtctcgaactcccgacctcaggtgatctgcccaccttggcctccgaaagtgctgggattacaggcgtgagccaccgcgcccggcttaatttttgtatgtttagtagagacagggtttcactatgttggccaggctggtctcaaactcctgacctcaagcaatctacctgcctcagcctcccaaagtgctggaattacaggcgtgagccacagcacccagcctcatttattctttctaacaatcctatgaggtaggtgctgtaatcacctaattttacagttgaggaaacagaggcactgagaagtgaagtaattaccatcattaccatgtattgagctctttctcttttctttttcttttttttttttgagatgaagtctcaccctgtcacccaggctggagtgcagtggtgtgatcttggctcactgcagcctctgcctcccgggttcaagcgattctcctgcctcagcttcccaagtagctgggactacaggtgcacaccaccatgcccggctaatttttgtatttttttttagtagagatggggtttcaccatgttggccaggctggtcttgaactcctgacctcaggtgatctgcccacctcggcctcccaaagtgctgggattacaggcatgagccactgtgcccagccgagctctttgtattgataaggtactacatgaagaattcacaagtcttactcctgacaactctgcgatgtattcggagatgagttttacatagcaggtagagcaaggacacggtgagaggcagtgagaacacagatggagagtttgcctcaggctctgattctagagggagggatggatgtgggttcagagacggttgtggacttcagggagggagggggagaaagcagtaggaatttgaggcagttcagggcaatgggtttgatttctttggtaacgtagagaaggaacacatttattgtagaaaacacaggtagtgataaaagaaaacaagagtattttaatatcaatcccttgtcacaaccactcttaacattttgctgtgtttctttccagaacttttttttttccgagatagagtcttgctctgtcttacccacgctggagtgcagtggcaagatcctggctcactgaagcctccacctccccagttcaagcgattctcctgtctcagactcccgagtagctgggattacaggcacgtgccaccacacgggctaattttgtatttttagtagagatggggtttcacaatgttggacaggctggtctcgaactgctgacctcaggtgatccacccgccttggcttcccaaagttctgggattacaggcacgagccaccatgccaggcctctttccagaactttctttaagaatccatatgcaagtgtatatgcataacagagagaggtcagtccttccttctgatggagaggttaagagtcaaaataaacagacccagaagctgggggtggggtgggagtagggcctcctggcatcactgaggggagcatgtagcagatgggtgcccagtgagtggcccagttgtctgaggaaaatggtgtggggtatgaagactccctttgtgtttagagcatgtagaagaccagcccgcaggtccctgagagaggatataggagagatggaggtgagtggctatgactgcaagaaggggaaggggctggactttgtcctgcccccatacctgtgggtcagccttgggaccctctttgacccttcgaagaacccacaggaatcgatggagccaagcacccaggctgcgcctttacctttcaggcctgttctccagaagcaagatcactgctttgatgaagatgggctcctgctgtccaggcccttcacttaataatgtattgtaaatcttaataatgtattgtaaatcttaataatgtattgtaaatcttgtaaatctttttccatttcattcagtgtttgctgcgcatcaggatgtttggtggacattccattgtggatggaccctggcttcttgcccaaccgcttatgttggaaatgcccaccagactggacctccctggagaccaaacgcagcccatcttgggagctggccagtgccacatcctccccctcttgcagggaccagctgagtcagttgctccatctcgcacctctcaacaccttcctgtgtggcactggaccacctgtggaagccctggcatgccttgctaccatagctcgcagaagttatggagaaaaggaggcccacacagactgagaaaacaccaaggcgagggcatggctgggatcccagcgcaggatccccgttcttctgcagtcacagtcttggctgaactgagccctttcctcccagtgtttggcttggatgctagaccaggtgagtcagccgtcctggcgcactcttttgagctgaaagtcacatccagatggggctcttgccagaagggcagaattatcgatctcgtcttcccagcccgctctctgaaactaggtcccagaacgtgtcctgtggggaagtgggcaatgacaagccataggagctgacatagatcagctctaagtagcacggagcctctcatagtcacccagggtctgggccctcaagcgagagacacacttctctatgtgtcctcagattcttgggcttgagcatgcacctcccagaggatgccagatagacctggttggaatcccagcttcatcactggccagttgggtgaccttggccttacctctctgggccctcagagatgaattattctcatcttaaaaatggaaaatgttgtctgagcttatgaagataaaaaggtcaatgcatataaatagaataatagggccttaaaatttccactagacactaatatgcaccatagatgtgaagatccaaagtgagagcccgagtcaccttatggaagattttctatggaaatgccaaaaaatctgatccaagactttgaaacccctttcccactttgagacactgaaaatgtagacagacaggtgatgggaggatgttgtatggcggacgtccttgaagaaagctgtgctgtgagtcccatcctggggacaggtgagctcctgctcccttacctcacacttggtaagggtgagtgtctgtggggcagcttctttaagagtctaacatgaggccaggtgtggtggctcacacctgtaatcctagcactttgggaggccaagccgggcagatcatgaggtcaggagttcgagaccagcctggccaacatggtgaaaccccatcggtactaaaaatacaaaaattagctaggtgcggtggcacacgcctgtaatcccagcactttgggaggccaagccaggcggatcatgaggtcaggaattctagaccagcctggccaacatggtgaaaccccatctctactaaaaataaaaaaatcagctgggcatggtggcaggcacctgtaatcccagctactcgggaggctgaggcaggagaatcacttgaacccaggaggcggaggttgcagtgagctgagattgcgccactgcactccagcccggatgacagagtgagactccgtctcaaaaaagaaaaagaaaaaacagagcctaacatgagacccctacaactggggagcggggtggcctggggtctagtttcacctgggaaatctggaaggtgacaggagggctcaccagctgctctggtggggctgctgccacctcactgggaccagcctgcaccctcagagttttttctggggtagggaggcaggagagtttcttctgaacagacgtaggtcctgtggcagagagagcctgcaaggactccctgtcttgagtctatgtagagggatcctagcgggagaaggttggaactgaatgcccatgggctgaggatggggtctcagatgaccacccgaaatgagattggacttgagacacatccatagataaaagaggattttgggagaaaggctgaggcggcactcagccggtaacttgagtggagggggtgtaaaatcactccatgaaaaagaggcaaaatttaacatctgcctgccaagacagtctgaagccaattctatggtaactggctcggggaggccaagtggaacgagagagaagacaaagccctctccattgtgtccactggaggttcccagctggccaggcacaagctgggggaagagagaaggatgtaaggtaaaaataagctcagagttttgatgaatacctcacattaaagttccaatttctggcttgagactgcgtttgcaactaaaagcaaccacagactattctaagcatgagcagaaaaatctcaggcctgctgaaattggcatccaggctggggagggtgtcctattctgaataattatggtgcaaagaaatagcacactggttacttaaggctcagcagcttggcagctgggacacgcacagcaatagctctttgtttcactgccccagtcacctgatggtctttggttcacagactactctttctctagctcatagattattccttgaaggatgtttgtctgaatatcaaggtcaagttctcttagcaaacgccacttcttaccactgattatcttgagcctaatttccctagaagtcagatgggccgggtgtggtggctcacacctgtaatcccagcactttgggaggctgaggcgggcagatcacctgaggtcaggagctcaagaccagcctggccaacatggtgaaaccctgtccctactaaaaatacaaaaattagccatggcagtgggagcctgtaatcctagctactcaggaggctgaggcaggagaatcacttgaacccgggaggcggaggttgttgtgagccaagatcgcgccattgcactccagcctgggcaacagagcaaaactccgtctcaaaaacaaaaacaaagaagtcagataacctccctgatggatactatcctgagagagagaagaacatgccatgtttttttctctgttccagacagcggcagtgctacccaagaatcaggccaggagatggaaccaggcaggctggcttctgcctcttagaagtcatgtggccccatggacagacttaagctctctgccctactagctggtcatctgtaaaacagttgatagtaataatgtgtatctcatagggttaagagtatgtaataaaattatctattaggttcaaccctagaaatccctaacattcaaccattttttactctacaaaaatagcagtttctaatgattcatccaaatatgtaaacaatgctttgcaacctctccattgctagttattgtgttagacaaaacaaaacagcagtaacaacaaaatgtttccatccgtgctccgaataatgagtctccagaattctgtttccaggaatgtctcaaggagcctggtgagttgtaaagcagccacgatcgacagctcaagacctgtgaatgctcaagaccttcctggtttccttgctagattttcccagtgcccagagagctcactgtctctcttctgggcctcactgcaaaaacaagcacaacctgtgcctcaaacacaaaaaactctcaatcatattctgaaatttcactacactgcatctcaatggatgtttattgcattcatcctgcttaacatcaagtgcaccctctcaattctaaagactcgcatttttctttgggtttgagaaatattcatttattctttttgttttttgagaatgggtctcactctgtcacccaggctggagtgcagtggcgccatcatgggtcactgcagcctcaacctcccaggctcaagcaatcctcccacctcagcctcccaagtagctgggattacaggcacaagccaccacacccagcgttttgttttttttttgtagaaatgaggtcttgctgtgttgcccaggcttgtcttgaacttctggcctcaagggattctcctttcttggcttcccaaagtgttgggatcacagccttgagccagcacgcctggcctattcatctattctttaaaaactatatcactcgggccaggcgtggtggctcacgcctgtaatcccagcactttgggaggctgaggcggatggatcatgaggtcaggagatcgagactaacacggtgaaaccccatctttactaaaaatacaaaaaattagctggacgtggtggtgggcgcctgtagtctcagctactcgggaggctgaagcaagagaatggcgtgaacctgggaggcggagcttgtggtgatctgagatggggccactgcactccagcctgggtgacagagcaagactctgtctcaaaaaaaaaaaaaaaatgtgtgtgtatatatatatacacattatatatatatacattatatatatatacattatatatatatatacacattatatatatatatggcttgtcaggttgataaatttgactatataaaaattaaaaacttgtgtatgagaaaagactatataaatgcaatagaaaaaagagttaaagaggaagttcacagaaaaagtgtcccaaatgtctaatagaccgtgaaggataatcagccttagcagaaatcagggtcatgcaaattaaaattatagtgaggtataatttctcacctatgaaattggaaaagctaaaaagtctgaaaataataagtattggtgaggataaggaaaataggaagagctgtatactgctcgtggaagtataaatagaagagtaatttggcagaatctagtaaaataggaaatgtgcaaatcctatcattttgtaatttttctagatatacacttggagaaaccttcatctatgtgcagaaggcaatatgtactattattatattgtttcattgtttcgtgatggtaaaaatttggaactactgcataagtccatctataaataaagcactatataaaaatgtggtatagttagttgtacagtgaaatgttctatagcagtgtgcagaaattaactggctgtttataaatgtggagaaagccaaaacttatagtgctgagtgaaaatagctagttgcagaaccctacatacagtatgttattacttaaagccacatacaaaggcatcatatatattatatacattcttatactgtgtattgtattggaaaagtatatacaaatttatgatggtggttgctgccctaagggaaagggaggagattggggtcagtaagaccattagccttgtttgtaatgttttatttcttttaaaacattaattgagctgggcacagtggttcatgcctgtaatcccagcactttgggaggccaaggcaggaggatcacctgaggtctggagttcgagaccagcctggccaacatggtgaagccctgtctctactaaaaactcaaaaattagctgggcatggtggtgtgcatctgtaaccccagctatatgggaggctgaggcacgagaatcgcttgatcccaggaggtggaggtttcagtgagccgagatcatgctaccgcactccagcctgggtgacagagtgagactcggtctcatgaaaaaaaaaaattaattgaagcacatgtagtaaaacaataaattgtcagtattgattggtggtaacatagtattatattatttgctgttctattttgtaactttaacatttaaaaaattctattctgttttcttcttctggaacatccattagagggatgttggaacttcagaatgtatttttcatatctcttaaatatattaatttatatttttcttttctcatgctgcattccagaagggtctctcagctcaattttccagctcagtaattctttttatctaacctcttttttgttttccttttataatactgtttttatcatattgttaaaatagtcactggtcagtgtttgtgtttacaaaaccatttttgttaagactttgtcccctcttttgtctgtctatgtgaagatgttaggaagaaatgaagccggccaggcgcagtggctcacgcctgtaatcccagcactttgtgaggccgaggggggcagatcacaaggtcaggagtttgagaccatcctgaccgatatggtgaaaccctgtctctactaaaaatacaaaaattagccaggtgttgtggctcatgcctgtaatcccagctactgaggaggctgaggcaggagaatcacttgaacctgggaggcagaggttgtagaaagccgagattgcaccactgcactccagcctgggtgacagagtgagactccatctcaaaaaaaagaaagaaatggtctacctcatatatacacacacacacatacacacacacacacacacacacacatagctatatgcttattagaatgtccaagataataatttaaaaaatgaacaatacaaagaaatggtcacaggaactctgaaatactgctcaagggtatgcaaaatgatatggtcattttttttttaaattttactttaagttctgggatacatgtgcagaacatgcaggtttgttacataggtatacatgtgccatggtggtttgctgcacctatcaacccatcatctaggttttaagccccacatgcattagatatttgtcctaatgctctccctcccctttccccccacccaccaacaggccgtggtgtgtgatgttcccctccctgtgtccatgtgttctcattgttcaactcccacttatgagtgagaaaatgtggtgtttggttttctgttcctgcgttagtttgctgaagatgatggtttacagcttcatccaggtccctgcaaaggacatgagctcattcttttttatggctgcatagtattccatggtgtatatgtaccacattttctttatccagtctatcattgatgggcatttgggttggttccaagtctttgctattgtaaataatgctgcaaaaaagtatgtgtgcatgtgtctttatagtagaatgattcatattcctttgggtatatacccagtaatgggattgctgggtcaaatggtatttctggttctagatccttgaggtatttccacactgtcttccacagtgattgaactaatttacactcccaccaacagtgtaaaagccttcctattacttcacatcctcaccagcatctgttgcttccagactttttaatgatcgccattctaactggcatgagaaggtatctcattgtggttttgatttgcatttctctaatgaccagtgatgatgagctttttttcatatgtttgttggccgcataaatgtcttcttttgagacgtgtctgttcatatccttcacctacattttttttttttgagatggagtttttgctcttgtcatccaggctggagtgcgatggcatgatctcggctcactgcaacctccgcctccccagttcaagcgattctcctgcctcagcctcccgagtagctgggattacaggcacccaccatcatgcccagctaattttgtatatttagtagagacggggtttctccatattggtcaggctggtcttgaactcccaacctcaggtgatccacccgcttcagcctcccaaagtgttgggattacagacgtgagccaccacgctggccgtctaacctccacctccatttgtttaaaaaaaatttgttttctaacctccttctttttaaaaaaagaaaaaatttgtcatagaagacttaatattagatctctccccttaactaatttctaagtgtgcagtacctaactgttgactagagattcgatgttgcacagcagatctctagagcttattcatctcgcttgactgaaccctgatgcctactggttagtaagtccccagtccctggtaactgccattccactcttagattccataaatttcaccattttagacatctcatataagtggaatcatgcagtttgtcctgtgacaggattttttttcacttagcctaatgtcctcaagctttatccattttgtcacatattgaagaatgtccttttttttttttttttttttttttttgagatggagtctcactctgtcacccaggctggagtgcagtggtgtgatctcggctcactgcaacctccgcctccaggttcaagtgattcttctgcctcagcctcctgagtagcttggactacaggcatgcgccaccacgcctggctaatttttgtatttttagtagagatggggtttcaccatattgtccaggctggtctcgaactcctgacctcatgatccacctgcctcggcctcccaaagtgttgggattacaggcgtgagccactgtgcccggccagaatgtccttctttttaaaggtttaatagtatttcactatatgtatataccacattctcctcatatattcatctgtcaatagacattaaggttgtttctacatcttgcctattgtgaatagtgctgcagtgaacgtaagagtgctaatatctctttaagatcccgatctcaattcctctgggtaaatatccagaagtaggatgctggattatatggcggttctagttctaatattttgagaaacctccatactgtttttcatagtggctgcacctgcaacattttgcattaccatcaactgtgtgcaagagttctgatttttctacaaccttactaacacttgtctttttattttattttattttattttgagacagagtctcgctctgtcacccaggctggagtgcagtagcatgatctcggctcactgcaagctccgcctcccaggttcacaccattctcctgcctcagcctcccgagctgggactacaagcgcccgccaccatgcccagctaattttttgtatttttagtagagacggggtttcactgtgttcgtcaggatggtttcgatctcctgacctcatgatccgcccaccttggcctcccaaagtgctgggattacaggcatgagccatcacacccggccaacacttgtcttttatgtttttggtaatagccatcctcataggtgtgaggtgatagcttattgctgttttgatttgcctttcccagatgattagtgatgattagtgctcaattagggattgaacattttttcatatacttgttggccatttatatgtcttcttcgtagaaatgtctattcaaatcattagcccattttaaaatcaggttattagttttttctaaactattgagttgtagaagttccctatattttttattttattatattttatttttgagacagagtttcgctcttgtcacccaggctggaatctcagctcactacaacctctgtctcctgggttcatatgattctcctgcctcagactccctggtagctgggattacaggtatgcaccatcacacctggctaatgttgtatttttggtagagatgaggtttcaccatgttagccaggctggtctggaactcctgacctcaggtgatcctcctgcctcggcctcccaaagtgttgggattacaggcgtgagccaccgtgcctggctccttatactttttagagattaacccctcaccagtcatatggtttgaaaatatttcctctcatttcataggttgcctttcattcttgattcttttctttgccatgcagaagctttttagtttgatgtagtcccactttttatatttgcttttgttgtctgtgattttggtgtcatatctgtgaaatcattgcaaagatccatgtcacaaagattttcctcagtgttttcttctaggaattttacagtttcctctttcttttctgatctcacttaactgttttacctttttttctgagttagtctagccaaagatttgtcaattttctttatcttttcaaaaagctaattcttagttttgttcatttttttcttttctttcctttttttttttttttttttttttttgagacggagtcttgctttgttgcccaggctggggtgcaatggcacgatctcggctcgctgcaacatttgcctcccaggttcaagtgattctcctgcctcagcctccgaagtagctgggattacaggcatgcgccaccacacccggctaattttgtatttttagtagagataggatttcgccatgttggtcaggctgatcttgaaccgctgaccacaggtgatcagcccacctcagcctcctaaagtgctgggattacaggtgtgagccaccgtgcccggccgatttttttctattgtttttcttttttcaatcttatctgtgccctaatctttggtatttctttctttctgctaactttgggcttaggttgtcatttttttcccagtcagttgagttgtgaaacttatgagatgcaacaaaagcagtcctaagagggtatagtgatacataccgacatttacagttaaagtaattattgatagaaaaggatttactattgccattttgttagttgttttctgatagcctcgtggggtttttttctgtcttttcccccttgctgtcttcccttgtgttttatttttttgtattgctatgctttgattccttttgtgtgtgtgtatgtgtgtgtgtgtgtaacttcttctttttttttttgaagacggagtctcgctgtgtcacccaggctggagtgaagtggggcaatctcggctcactgcaacctctgccctctgggttcaagtgattctcctgcctcagccttctaagtagctgggattacaggcatgcgccaccatgcccagctaatttttgtatttttagtagaggtgggggtttaccatgttggccaggctggtctcaaactcctgacctcaggtgatccacctgcctcggcctcccaaagtgctaggattacaggggtgagccactatgcctggcccttgtgtaacttctataggtatttattttgtagttaccttggggcttaggtaaaatattttatagttatgacagtttattttaagctgataatttaagtttaatcatgtacaaaagctttacactttaacttctacccccatcacactttatattattgtcataatttatatctcttaattctgtgcatatgccaagacttgaatatttgtgccatcagaaactcatgttgaaacctaatccccagtgtggcagtattgagaggtggggcctttaagaggtgattggatcatgaaggccctaccctcatgagtggattaatccattattggattaatggattaatgggtaaatagattatcacagaagtggaactggtggctttataagcagaggaagagagacctgagctagcgctctcagccccctcaccatgtgatgtcctgtactgtcttgggattatgcagggtgtccccaccagcaagaaggcctccaccagatgtggtcccttgaccttggacttccccaactctagaactttaaacaataaacttctttcatttatagattaccctgtctcaggtattcagttatagcaacagtaaatggattaagagtatattttaatatatttttggttatagttcttttcttttctttcttcttcttctttttttttttttttttttttgacagagtcttgctctgtggtccaggctggagtacagtggtgtgatctcagctcactgcaacctctgtctctggggttcaagcgattctcctgccttggccttcccagtagctgggattacaggcatgtgccaccatgcttggctaattttttatccttttagtggaggtggggtttcaacatgttggccaggctggtttcgaacttctgacctcaagtgatctgcccgccttggcctcccaaagtgttgggattgtaggcatgagccaccatgcctggccagttatagttattttccatcttttttcttttaacttgtataggagaattaaaagtgatttctccatcaccattacagtattacagtattctatatttgtctatacatttacctttactagtgagtttcacactttcttttaatattgtgtggctatttagcatactttcatttcaacttgaagaacttcctttagtatttcttgtaaggcaggtctagtgatgaactctctcagcttttatttgtctggtagtctttatttctctttcatttttgtaggacagttttgtcaggtatagtagtcttggttggcagttttttctttcagtgctttgaatatatcatcctactcacttcctagctcagtaattcttacaaattgtgattattttgttgtcagctcatctgcttaattttttatttccattacaaaatttttgagatgccttattgacttttttttttaaatcacagcttgcctaaatttgtttttatgtcttggctattagaccttcccttattcttccaagtagtcctagctactcgggaggctgaggcaggagaattgcttgaatccaggaggcagagtttgcagtgagctgagatcatgccactgcactccagcctgggcaacagagcaagactccatctcaaaaagaagaagaagaagaagaaggagaaggagaaggagaaggagaaggagaaagggggagggggagaagaaggattacatgaattaagtgtgcctataattttatagtcatttgcagagtgcttggcacacagttgggtgatataaatgctggttaaggggcatttttctacttaaaccctcctatggaatctcctaggtcctgggagaaacctcactcctgggaagctcctgcgtgctacccctgtcagctgggagacagctctgccgcatttttttcagctcctccattgctctgctgattcacagcctccagcttccagaacctttcccctgtcgggacagtagtccaactccgttttcacatgcttgtcctatttgctcgttgggttccaggaggctctctccgtcccctggctctgtgtatggcccatcgtccttaccacactgtcctgcaagtgctcgttaactcacctggcttctccactgccctctctgttccctcaatgaaggaaccctgggatcttgctcgcccctagtatctggcacatagtatacccccaggaagtatttattgtgaaaatcaataaattacttgaattgatatttgttgagcatctgtgtgcgccaggctggtggtaagccttttgcacaatcattccatgcagattgcaaagcccctctctgaggtagcatcgtaacccctgctttcccttcgaagcttgtgctccccagtctcctaccttccggtcctcccgtatctgtcgctgggtcacctcgcttgcccactaaagattttggcatgaattccatggttttccctggcagctcagggcacttcccatgtccttgttgagaaagccccatgctggcttccctgttcttgaggcccctcatctctgggggattgactcacttcagtcacccactcctgaggccacacacaagatacaaactccaaagcccacccccattttgtgccccacacccctgtcctcccctcatgcagacccccactactctccatgtaaacatcattttataacgagtcatctttcagcacaccaacctgccattccctgcaaagctctacacattggttttgtctgcatctgttttttagcaaaaggacttactgccacattttaaaagatccagtcattttacacacaaaaaaaatccagatttatggctttccttagaggagaaaaatcagaagatctgaactcgagccttgcattcctgccagagatcaagcagcctgggctcctctccagtttgcctaatttctaccacaccctcttctcttatttatcttacctgaccggcctgaaggcatctgagtacgtgacctttgtcttgggtggaaaagttttcaaggcaggcaaaaaaatcttatgttggccaacccagaagtttcttggtcataagacagtatggatgacaatgtcccctgtttgttgagcactgactatatgctggcacttcacaggcagtgcgcctcttgatccttacacaaccctaagaggtgcaaattattattcccccaccttttttttttcaggtaagaaaaccaggtgctcagaaagggcaagtaatttgcttactgacacacagctagaaagtagcaagactttgtaggtgcatgaacaaagattgctccaagtaccagaccatttggatcttggtgaaacgtgcaagatatgagtgcagattgtgaggaagcccctgacacctttggccaacaggatctggctttcatagagaaccaaacccttcatagggtttggtatagtcttaaatacagtagacatgctggaagatttttgaagagaaatattttgcttgtaaaactcttggctggctcatgcctgtaatcccagcactttgggaggccgaggcgggtggatcatctgaggtcaggggttcgagaccagcctgaccaatatggtgaaaccctgtctctactaaaaatacaaaaattagccaagcatagtggtgtgtgcctgtaatcccagctactcaggaggcggaggcaagagaattgcttgaacccgggaggcagaggttgcagtgagttgagatcgcaccattgcactccagcctgggcaacgagagtgaaactccatctcaaaaaataaaataaaataaaacaaactctctaatgacctgattggtagggttgggagtgagtgtacgtggttataggtccagaatgatgctccaataaggataggaagcaaaaaggaggaggcccagacccagggggaaatggctgagggcagagaggctgcaggtgagggtggaaaggacaccagtttgcttttgcttccggagacaggaagcagggcccttgcaggctcccggagacaatggcatctctgctgtaggagtttgagggggaagtctggggctgcctcagactctgagatagaggggctgtcaactctgactctcgaaacatgcattcctgctacctatttcttcttcctctttggttcttacctgactctcctgggggtgtgtaccctccctcgcctctacttctgaaacaaatactccattggctctgctgcaacctcatctccctttgggtctgacacaaagtggtccctctgcctggggtttcacttctggggatctgggacttatcacttgtctgaagctctctcaatgacaggttgaatgaaggcccagggtcttcccagacagggcggcacccaggcagccagacaggggagcatggtgcctgggcttctgtgaaggccttttcccacgcggaagggaaacagtggcctcttgtactttgtctttcaaaactctgacaaacatggggtaatgcttatgataggggttaagaaaagcaggattcagtcgtgtaaataccgtgtgagtttagcaatcgagaaaggtacgaggagggagatgtaccaacacatctggagggattatcctatgctggtgccattgtgggagatttatcttctctctccctttcccttccagattttctaccacttccaggtcttctacaatgaacaagtattacttttctttatttttctttttttttttttttgagacagagtcttgcttttgttgtctagtgcagtggtgcccatagctcattgcagcctcaacctcccaggctcaagcgatcctcccacctcagcctcccgagtagctggaactacaggtatgtgccatcatgcctggctaaaggtgttgcttttctaagaaagactttttttttaaagtagtttcatctaaaaatttgtgactgataataagaacgttaatatttaattgaaagcttggaaggaaaaacatccaaaatttcactctgcttctttctggaatctcacctgaccctccaaatagggaacgcccagctcaagtagtgtgtctgtccctcttgccctgtgtattcttcttcatggcgttgtgacgacctgacatactttatgcccatggaatcgcctcttgtctgcttcccccactggcatgtcagcagcacaggaacaaaggcctttctggttgtgttcaccagagtagagttcaccgccatagcccagagtagacctgccagtgagaaggagctctctacacatttgaatgaaggaatagccagcttgtgagcaatttcagtgttcttcttatttatttattttgagacagggtctcactctgttgcccaggctagagtgcagtgacacgatcttggctcactgcaacttccacctcccacgttcaagcaattctcgtgcctcagcctcccaagtaactagaaccacaggcacccaccaccacgcccagctaatttttgtatttttggtagagacggtgcttcatcatgttggccaggctggtctcgaactcctggcctcaagtgatccatccaccttggcctcccaaagagctgggattacaggcatgagccactgcgcccgtcctttagtgttattgttactatatttctgagtttccagctgtttatccaataaactttcattgctttcatgatcagaaaaaaatgaataaatattatttttttcctccatgaaaatagcacaatgaagcaaactctcaattctaacatttgagaatgaagttcttttctattgaagttagcatttatttttatttatttattttttttgagatgcagtctcactctgtcacccaggctggagtgcagtggcgcgatcttggctcactgcaacctccacctcctggttcaagcctttgcttcctgggtagttgtgattacaggcctgtgccaccacgcccagctaatttttgtatttttagtagagacggagtttcaccatgttggccaggctggtctcaaactccggacgtcagacgatccacccacctcggcctctcaaagtgctgggattaaaagcgcgagccaccacgcctggtctgaagttagcattattttaagtctcaaaaatacatgagaaacctgctggtgtgagtcacatgtctgtgtgggcacattcctgctgagctggttgaaagcatagatgtgtggaaaaaagattcctctctatgcaccactctttgcccacagggccatcgatggtcaacaggatagacctgtgtaaatctgcctttccagaagactggctgggaaacccatgtgctgtctctccctcttgccctgtctgttcaccttttggtctttggtcagcaggtgcagggatgtgtttgccaatagggttcctgaaagcttgtctgatttagacctccagagccacctgggggacatgtcagaaggagaggggctgggcctgtccccagatggacccctgctcttctgggaggacaaactggaactggtctggatccagctgcgacgctgctagaggagaacgaggcatcttttgccctccaacatctggagcctgcctctccaggatgggtacaccaggcctctgcctgctccccgttcctttccacattccccttctcttacctgcttgctacccagcttgaagggcctgtttttcctgctcaggaacattacttatttaggtgatattcagagctatcttcaaattacagatcaccttgtctaccatcctggaaaacatctctctcttttttttttttttttttttttttctgagacagagtctcactctgttgccaggctggagtgcagtggcgagatctcagctcactgcaacctctgcctcctgggttcaagtgattctcctgtctcagcctcccaagtagctggaactataggtgcatgccaccacgccgagctaatttttttttttttttttttttgagatggagtcttgctctgtcacccaggctggagtgcagtggcgcaatctaggctcactgcaacctccgcctcccaggttcacgccattctcctgcctcagccttcctagtagctgggaccacaggtgcccaccaccacgcccggctaattttttgtatttttagtagagatggggtttcactatgttagccaggatggtcttgatctcctgacctcatgatccacccgcctcagcctcccaaagtgctgggattacaggcatgagccaccgcgcccaaccaatttttgtatttttagtggagacggggtttcaccatgttggccaggctggtcttgatctcttgatcttgtgatccgcccccctcggcctcctaaagtgctgggattacaggcatgagccaccgcgcccagctggaaaacctctctacgcattatgaagctttctgatctctgataacagcacttcgttcatttatttatttttgtttgtttgataacagcatttctgaccacagactctttcatggaattgtagcagcttcactagtgggaattttactttgtgatactttccctacatcgatggccagcatctcctcccttctctttccttctccagacttctaaacgttgtgcttttccatctcacacaagcaggttcaagccagtggaagaggtggcctgcctcccaattgcaccaagggatgcatatttctacgtagtttgctgtagctctatttcattttatacatcagctaccatcatcgtttatggacacttttctctcctcattctgggagaagcccagaggctttctgaaaatatccatgaactctggggtggatgttctcaggagccgtctgatgagttcctgcatcttcagcactgctgaggtcatttacctcccacatttcatggtgattctttccctttgctcccaccaacccagatacgagccttttctatgtgttcttccagaatcgctcatgcaacacggctggtttagaagcagactttatttttttaattttttgagataaggtcttcctctgttgcccaggctgaaatgcagtgaagattttattgataaggttggatttttttggtcacccaaggcaagccattttagcgttagacagtcctgcttttgagagtgctctgcagccctgctgctggcgactccttgctggtgccctgtctgctcaggctcaggcctctgctaagggccttggctcctccccttgcctagaatctgctgctggactgtagaaaagccatatgccaccctctcccaattttccctcaggggtgaagtgacaaagttagttttgtttgtttttaatttttaattttaatttaattttattattttattttatttttttgatacggagtctcactctgtcaccaggctgtagtgcagtggcacaatctcagctcactgcaacctcctcccctcgggttcaagcaattctcctgcctcagcctcccgagtagctgggactacaggtgcccgccaccacgcccggctaatttttttttttttttttttgtatttttagtagagatggggtttcaccatgttggccaggatggtctcgatctcttgacctcgtgatccgcccaccttggcctcccaaagtgctgggattacaggcgtgagtcaccgtgccaggccattgttttactttattttattttattttattttatttattttattttgagacggagtctcatctgtcacccaggctggagtgcaatggcacaatctcggctcactgcaacctccgcctcctgagtttaagcaattctcctgcctcagcctcccgagtagctgggattactggcgtccgccagcacacccggctaatttttgtatttttagtagcgacaaggttttgccatgttagccaggctgatcttgaactcctgacctcaagtgatccatctgccttggcctcccaaagtgctgggattacaggcgtgagccaccgtgcccagccttgttttgtttttaagagacagtctttctctgccacccaagctacagtgcagtggcatgattgtggctcaccgcagccctgacctcctggtctcaagcaatcctcctgccccagcctcccgagtagctagaactacaggtgcatgccaccatgctcagctaatattttttatttttgtagagacagggtctcactatgttgtccaggctggtctcaagctcctggactcaagcaaccctcccaccttagcttcccaaagtgcagggattacaggtgtgaggcaccatgcccaccagtttattttttaaacaaggtgttaatttgcctacaattaacataaaaaataaaagcaaaaatgaaatggacagagtaaaatgaggaaggctgagatcctgatgatcatacaagggtggatgcgaaccattattatggattccagctctctcatgttaaacatccttaggcacaagcgcatgcagcctttcccaccccagcgacccaaccctgtgcctactcacagctcacatggtttgaaatgggtgtaccttcggtgtgctagaataatgacgaccttggttcacgacacgctcccttcgttggtccttgcttattctttttttttttctttttctttttgagtcggagtctcgctctgtcacccacgctggagtgcagtggcgtgatctcggctcactgcaacctccgcctccttggttcaagcaattctcctgtctcagcctcccatgtagctgggactacaggcacctgccaccatgcccagctaatttttgtatttttgtaattttagtagagatggggttttgccatgttgcccaggctggtcttgaactcctgacctcaggtgatgcacccaccttggcttcccaaagtgctgggattacaggtgtgagccaccatgcccggccagtgcttattcttttattttagtgacctatttatatacccataaacctacccctcattttaagaactaagccattattgagaacctcctcttcctctgagttcccaccatgttctattctgctgcctcccttcctcccctctcctgaggggtgtgtctttctaaattttgtgtctataattgccttactttaaaaaagtagctttatcctcaattttgggaatagccaatctgcttttcaagaacaacaaggaagaggaacctttcctagcagatatcagtgtggaatagagctgggaaacttgactagccacccaatctatgctcacaccctcccagttctccatgctggtacccctcctggatttcagaggtgccagagaaggcacctggctgccctcagagagtcctggaaaccacagccacagaataaaccaggcagacacaaagtctgatagagggacagtgtaaaaaaccatcctaggagctggcaggtttatttggggacaaggaacatggctgcagagatggggatccacactgtggatcccagaacatgacaggatcactcacccagtggcaacctcccaaagcttcttacaggggtagcacagcacagctggggacagaatgacagtctttttttttttttttttttttttttgagacggagtctccctctgtcgcccaggctggagtgcagtggcgtgatctcggctcactgtaagctctgcctcccaggttcatgccattctcctgcctcagcctcctgagtagctgagactacaggcacccaccaccacccctggctaattttttgtattttttagtggagacggggtttcactgtgttagccaggatggtctcaatctcctgaccttgtgatccgcctgccttggcctcccaaagtaacgggattacaggtgttagccactacgcccagccagaatgacagtctttaaatgagatgttttcatcctgcagcatggcctctgccctgagtttcttgagttctcttccactggggtgtgcgaggcacggctggtacctggtccctgggaatgctgtccaggaggagcagtgacagtgccagaggctgcagaggccatagacagcagccagcatggcaatccccaagcccaggtgccagcagaagaagatgatgaggaaggccaggttcttgtagctgactgctcaccagggctgtccggtggggcgtacatcactgaggctccctgaagcaaccaggagccaagcaacaggagcacccaggccttgagaacccagagctggggctggtcagggacccagacctgggggaagtcgggggaagaggatctgctggccccacaggagggctctggacgccatcaccacatagtaaagccccaagtaatagatggtcagtgctggaatcaggtgtcccaggaaagtgcccatgcagcagccggcagtctgcttaggggtggaggagtggggattatgagtgactgtccctactaagagtttgccacctctgaactgtcagggtagtccctgctgacctgcctctgcggcccacacatggggcgggcccaggtgctgtgtaggcccaggtctattttcaggtagctgagaactggctgggctccttcctgccctgcaaaatattgccaactattcagtgctgaaactgagtcatcaagaacttgatagaaactgttctatcaagccagctccttcaggatgatggggaacatgataagaccagtgaattacatgatcatgagtcattgccacacttcttttgttgtaaagtgtttggaaacaatgctgtatggaatttcactggataaggcatactttaagttcacggatggtggttttggcagaagatttgtgagcagggtatgtaaatctgtgtccagagtaagtgtctatcctagcaagaacaaaatgctgcctcttccatgatggaagtggtccaatgtaatcaacctgcgaccagatagtaggctggtcaccgtggagaatggtgccatatcatagactcagtgttggtctctgctgctggcaaactgggcactcagtgatggctgtagccaggtcagccttggtgagtgttagtctacactgctgagcccatgcatcctccatccctgccacaacagtcactttctttttttttgagacggtgtcttgctctgtcgcccaggctggagtgcagtggcccaatctcggctcactggaagctccgcctcctgggttcaggccattctctggtttcagcctcccaagtagctgggactacaggcgcccaccaccatgcccggctaatttttttttttttgtatttttagtagaaatgggttttcaccatgtcagccaggatggtctcgatctcctgacctcgtgatccgcctgccttggcttcccaaagtgctgggattacaggcgtgagccaccgcgcccagccacagacactttcgttatgagcccattaggcaatgacaatgataatgagcccattaggtcatcagatgctgattggtatccatagaacaagtcatcctatttacttgattattaatatccttctctgttgaggttgccttttggtgggcattgacatgggacacaaatgtcttcaggttttttatccattcagagaggtctacccatatatctctttctcagatttccttatcaccaatttttccattcatattctttctgagtccctgaccatccagccaaaccactggccatagtctataaatgggtatataattgcatgtctgaccatttctcctttgaagcaaagtgaacagccagatgcactgctcaaatttctacctgctgggaggattcctcttcatcactgtccttcggaggtgtcccagaaaggaactgtagtgctgcaattgtccaccatcaggtggtgcctgcatattctgcagcaccgtctgggaaccagccccaagtcttctcttcctctgtcaactgatgatagggaactccccatgaggccatagacataggctgggagagagaaggcagggtagcaggagtggaggaccgtgggcttttgggccaattcttcatgtaatttaccaatgcctacagagctttctcaggcccaatcatgtatataccacttccgtttcatgatggagtattgctgtgcacacccaaatttatggcttgatgggtcagataacatccaggtcatgatgggaagctcaggtaacttgatggcccatggttaggcacacagtatctatctaaggcccagtaacaggccaggagccgtttctcaaaaggagagtaatctgtgaaggatggcagagttttgctcccaaatcctaaggaaattcacttgtaggggcctgccaaaggctccagagagcatccctatctgccactgacatttcacgcaccactggatctgctggatcatatggcccaagcagcagagcagcctgcacagcagcctggacctgttgcatgagctactgtgccaggcctggctctgtttttatgattcagattagacttttgttaacttggcttagaacttttctgcttatacggatcaagtaatcagtaggcttcccatctatttcacttctaggaacgccatgcttaacagcctgtgccattggtctgcaggagttggcaattcagctgctgtgactctgctgtccatcaccgtaaccatgttcacctcgcctgtggcagtggagtgctgccacttggtccctgcgccctgagatccatgactcccattacatttaagtttccaaattcagtgactgctgtaagttctgcctacggagacgagggattacaaagctctttcaaggtgctgaggctccatcacaaatttatttctcacagtattggtaaaaagcaggacttctggcctttcccagtaggtctagaagatgtacttttatgtcttagttggtgagtaggtcttaaatgacaaatccccgcgaacatcccatcttcctacgcctttgaatccattctacattaaaccaagtcatgtccatccaccatttccagtttgttcatggtgggtcaccctttttgttttctttttgagacggagtttcactcttgttgcccaggctgtagtgcagtagcatgatcttggctcacttcacctctgccttctgggttcaagtgattctcctgcctcaggctcctgagtagctgggattacaggtgcccaccaacacgcccagctaattttttgtatttttagtacagatggggtttcaccatattggccaggctggtctcaaactcctgacctcaggtgatctgcccacctcagcctcccaaagtgttgggattacaggtgtgagccacagtgcctggccaacagtgggccatctttgatccactcatcagccaaccaaccaaaaactgttagagccttttcttattttctgagctgcaacattaaaatgcaggatctctgcttagtgagcccatgtcaataaattcactctgatacaactttatgttttttctttttctttttttagtttctttcttttcttttctttttttttttttttttttttttttttttttgagacagagttttgctcttgttgcccaggctggagtgcagtggcgtgatctcagctcactgcagccttcacctcctgggttcaagcgattctcccgctcagcctccagagtagctgggattacaggtgtgcaccaccatgccaggctaattttgtatttttagtagagatggcagtctcaccatgttggccaggctggtcttgaactcctgacttcaggtgatccacccgcctcagcctcccaaactgctgggattacaggcgtgaaccactgcaccctgcttgttttttttcactattatctcacatcctcaatatccattcccatacatgttccccagatttctgtctatagaaattagaaaacttaagaagttcttttgaagtatagcacacctcctcacgggtaacctttgtacctcatctgaggggcttgctgggacttgagtctagacttgaagtctagaagcaaaaaggggtggtgggggtggatcctgaagagaatcagcattgttttgcaaaggcaactgactcaagggaggccatcacagtttcctctggcaatgcagagtcagttcgccaggtggaggtggggaggctacttccatggcaaagaagactcataagaatttcggggctctggctgggcgcaatggctcaccacacctgcaatcacagcactttgggaggctgaagcagaaggattgcttgaggccaggagttccagactagactgggcaacatagtgagacccccatctccacacacacacacacacacacacacacacacacacacaattagtgggcatagtgttgtgtgcctgtagtcctagttacttgggaggttgaggcaggattgtcacttgagcccaggagttcaaggctgcagtgagctataattgcaccactgcaccccagcctgtgtgacagagcaagacctgctctctctctctctcttttttttttttttttttttttggatttttaatagagattgggtttcaccatattggccaggctggtctcaaactcctgacctcaggtgatctgcccacagtagcctcccaaagtgctgggattgtaggcatgaaccactgtgcctggccaagacctggtctcttacaaaacaaaacaaaacaaaacaaaacaaaaaaccccgaaaacttagatgttcactgttcccagcttcatcgtgtcttcctacacatccccaccccattcttccccagtcaacaccctcactttcacagcgacacctgttaaagacacctgcgaggctggaagttcagtccatgttgtaatccagccagtcacaggattctctgcctgattttcagtaatctcagcgctttggtgacaggagataagggtctccttcagggcacatgtagtagcttttaggttatttacaccgcgtttgaactaggaatttgaatccctgaactcattcttttctttcacctctttgtccagtgactctaggagcaagtagccaaccttgttatattcattagtttttcaaaaaggttagaaagtatcttatatatagtcacccagctcctggcttcttataagtggttgattaggtgtatccagtgggaatattttgcatatttccattgtcagatcatgccatggacgactagtgctctctttcttactggaaacagagttgttagtctctttaaatttaatcagactagagagacaatgccagaaatcttagaaccaattcagaaagctcattcttaaaattgtttctcacgggaggctgaggcaggagaatcgcttgaacccaggaggcggaggttgcagtgagccgagatcatgccactgcactccagcctggcgacagagcgagactccatctcaaaaaaataaatatatatatatatttaaatatatacatataatatatatttaaatatatacatataatatatatacacatattttatacacacacacacacacacacacacatatatttttttgagcggagtcttgctctgtcgcccaggctggagtgcagtggtgctatctcagctcactgcaagctctgcctcctgggttcaggccattctcctgcctcagcctcccaagtagctgggactacaggcacccgccactgcgcctggctaattttttgtatttttaatagagacagggtttcaccatgttagccaggatggtctcgatctcctgaccttgtgatctgccctcctcggccttccaaagtgctgggattacaggcgtgagccaccgtgcccagccatatatatatatatatttgagacagggtctccctctgtcagccaggctggagtggagtgctgtgatcatagctcatttcaactgtgaactgtgcacaggtgatcctcctgcctcagcttcttgagtagccaggactagaggcatgcaccaccgtgtctggctaatttttaaaattatttgtagagatggaagtatacagctatgttgcccaagctgatctcaaactcttggcctcaagtgattctcctaccttggcctcccaaagtgctgggattacggatgtgagccaccatgtttggccctaaaatctttatgagtcagagttctccagaggaacagaaccaatgggagacagataatagatatatacatatggaggctgagaagatccaccatctatcattgcaagctagagatgtggaaaaactggtggtgtagttccagtctcagtctggaagcctgagaagcaggagagccagcggtgtgggctccagcacaagtctgaaagcctgagaacaagagggctgatggtgtacgttccaaactgagtctgaaagcctgcgaaccaggagcactgatgtgagacccagtctgagggcaggggaagaccattgtcccagctcaaacagtcaggttgagagtgaattctcccttcctccacctttttgttttattcaggtccttggcagagtggatactgtccactcacattgggaagggccatctgtgtactcagtccattgattcaaacactaatctcctccttaagccccctcatagacacacccagagataatgtttaaccaaatacctgggcactctgtgacccagtcaaattgctgtataaaatttaccatcatggcgcggtggttcacgcctgtaatcccagcactttgggaggccaaggcagggcagatcacgaggtcaggagatcgagaccatcctggctaacatggtgaaaccccctctctactaaaaacacaaaaaattagccaggcatggtggcacgcacctgtagtcccagctacttgggaggctgaggcaggagaatagcttgaactggggaggcagaggttgcagtgagccaagattgtgccactgcactctggcctgggagacagagcgagactccatctcaaaaaaaaaaaaaaaaaaaaaaaaattaaccatcacaacaagtctcagcagccttcatgttaaatagatccttctgtgggagagatgtcagatggctctagatatatctgagttttcgctctagagaagtcagaaactatactgtatcttacagatatagatataggggatttaaggttatgtagttgggttgataccagacatgatttttaaaatcctttttctttcttatttaatttatttctcacaactcatgacctaatcaaatatagtttccatttaaattacaaatgacttttcattaaaattacaaagcatataatttttgcgctaaatataaaaacctatcattttgagcagattgcaaggaacgcaaacatccagggtcctcaatgacctttcctgctgaccctctcaattactgctgaattgttcatggtttgcaccaagctggagttaatgtaactatcttaccctttccatccgacagtgaaagtgcttaaaacctttctgggcctttaattagatttgtcaacatacacacatgttgctgcaattctaattatcctagaaaaactaatacaaatcatgatagcactcctatgtgccaaggcactgtgctaagcactttacatatctactaactcatttaattcttcacaacactccctttgatccctcttttatagatgagcaagtgaagcacaaacctgcccaaatcattggttagcggggacctcacctgggctattctctgctaattctggggaaaggtttcccatgcctacccttcatgagtttctgtatccttccccatctgcaagaagaacatagctccaaatatgctacatcagctggtgactgtgtttcagtcacaatctggtttttttttttctgccaaccttttcttctgaaaaattcctgatcccattttagaagtgacctgccatgatgccaaccacctggtgtcctctagtgtggggacatctggcgcctggctcacacccagagggagtgaaccaaaccttggtgggctgctaggggtgacacccaggcacatccttggggatccttgtcccagaaaagggctcagtccaggttgggcaccgtcaggggtcgtcaggaaacagctgggaggatttcatcagatcccctcttagcacatggttgcagcagttaataatgagagggagaattggctggcctggaggccagcagagtcttctggaactctggagagcctcaccccaaggaacagcccagtttggtccatatgaaggtcctagaaaccataaggtctgcatttggagcagcagtagtagaggcaacgttttctctgagctcctcctgtcctgagaggcaagacctgtcttcctacaccatgccccagtccccggcccactcactgggtcttggctctaccttcttgctccttctctgtgcactccctcacccccactccgtgcagggacctgcctggaacagacactggctttgagttcttgacatctagtaaagacaacccatgagcacgtaaaagcctcacaatacagagcaggattaataagaacaaaatgcaaagcaagtggagatcaaggaggaagatattcccagctggggagtcacagcagacctcatagaggagggggcgtttgaattgaactgtgaaggtccagacattgcaagaggagggcctggtgtgggaaatcacaagaggagaatatggttcagtgaggctgaagcaaggtgcacgatgagtggatggcgctggactggcaggtctgggcaacttggatagggccttaactgttggactacccatctctatggggttgcgagctcaagctcaggggtgagagatggcctggactgttatctcgtctaatttctgttacgtataacagaatacttgaaactgggtaatttattttaaaaaggaatttatttcttacagttatgaagactgagaagtccaagatcaaggagccggatctggcgagagccttcttgttggtggggactctttgcagagtcctgaggtggcacagggcatcacatggtgaggggctgagtgtgctagctcaggtgtctcttcctcttcttataaggccaccagccccactcccatgataacccatgaatccattcatccacaaatggattaatccagtcataagggcagagcctcatgacccagtcacttcttaaaggccccacctctcaacactgtcatttggagattaagtttcaacatgagtttaggaggggattaacattcaaaccatagcagcagggactgtaacaagtgagctgtctccagggccatgcctggcagcctctattgggagcctatttctgtgccctcccttgccgtgtgcatcaggtgaataggggtgagggatgtctaatgttgaaagggacctggggtggaggaatagatcacaggtcaaggggaaggggaaattggaggggagaaagcatgtgtgtaggtctcttctgggaccaggtgaacagccagccagatgctcaagtcagaaactagggcatcatcctgggctcctcccttccttcactcctgtattagtttgttttcatgctgctaataaagacatacctgagactgggtaatttatacagaaaagaggtttaatggactcacagttccacatggctggggaggcctcacaatcatggcggaaggcaaggaggagcaagtcacatcttacatggatggcagcaggcaaagagagagcttgtgcagggaaactcccccttataaaaccatcggatttcatgagacttattcactatcacaagaacagcatgggaaagacctgtccccatgattcaattacctcctaccgggtccctcccacaacattcaagaattgtggaagctacaattcaagatgagatttggggccagcgcagtggctcacagcctgtaatcccagcactttgggaggctgaggcaggtggatcacctgaggtcaggagttcgagaccggcctggccaatgctatctctactaaaaatacaaaaattagctaggcatggtggtgcgtgcctgtaatcccagctactcaggaggctgaggcatgagaatcatttgaacctgggaggcagatgttgcagtgagccaagattgtgccactcactccagcctgggtgatggagcaagactccatctcaaaaaaaaaaataaaaagaagatgagatttgggtggggacacagccaaaccatatcaacccctcatggtcaattgctcactgtgttcacccagttctacctgctatggggttatttggactttcctctccattccaccaccccaacttggttctctcctggaccattgcagcatcatcttgactcttcctcacttcatctcctggcttttctcttccatagagaggtcttgttaatattcacatctcatcatgtcatttccctgatgaacattcttcaagttccctgtgtcagctgcaggtggaatctgaacttctttttttttgagacagaatcttgctcttgttgcccaggctggagtgcaatggtgcaatcttggctcaccgcaacctctgcctcccaggttccagcgattctcctgcctcagcctcctgagtacctgggattataggcgtgcaccaccacacctggctaatttttgtatttttttagtagagatggggtttctccatattggtcaggctggtctcgaactgctgacctcaggtgatccacctgcctcagcctcccaaagtgctgggattacaggcatgagccaccgtgcccggcccagaatctgaacttctgtggccaggcagaaaaggtcctgtgttactcgtctcctttatcattcatgtccatattctcccatttgctaacatttatgtttctgctccactggattctttggatttttctagaacatacccatgctttgcattgccttggtctttgaatatttggtccacttttcctgcaaagtcccctctcaccttatcttcctggtaaacttccagccaacacctctttactaaccagagaaacatggttcaactgtgcacaggcttgcacagaaactgttctcatattgtcttgtcattgtcaatgtggcagagatgcaccttagatacctctttgagaaaggactcactgcccagctgcctggcacgtgatgagctgatagctccagctatagactcctttagggtcaacctctgctttccagttgagatcatatcctttgcagggtggcctccccagtgatgactaaggcagtgttacaatggcctagtcatttcctcccaatgctggactcccaatgaaccatctgctccggagcttcccactgggcagtcagagaccttagctagtctgcctccgaatcagagggctctctctgcccactctggcttccgcctctttcttttcacaagtcctactccccagtgaaagttttgaattcctaactccatctcagcatccattttgttttttgtttgtttgtttttttccttttttttgttgagacggagtttcacttttgttgcccagactggagtgcggtggtgcgatctccgcttactgcaacctctgcctcccaggttcaagcgattctcctgcctcagcctcctgagtagctggaattacaagcatgcaccaccatgcctggctaatttttgtatttttagtagagacggggtttcaccacgttggccaggctgatctcgaactctgacctcaggtgatccatctgcctcagcctcccaaagtgctgggattacaggtgtgaaccactgcgcctggctctttttttttttttaggatggagtttcactctattgcccaggctggagttcaatctcggctcaccacaacctccacctccagggttcaagcaattctcctgcctcagcctcccgagtagctgggattacaggtgcatgccaccatgcccagctaatttttgtatttttagtagagatggggtttcaccatgctggccaggctggtcccgaactcctgacctcgtgatccacccgccttggcctctcatagtgctgggattacaggtgtgacccaccgtgccgggcctatgggttttcaatagtggtccaagaaagtagttggtaagacggggtttgggggctggatcactccaccaccaactggcaatgaggccacgccccaggagttaagtgagcatggaaagtccccagcacatgttggtggccctattgttaaacatttcactgatgctgacgtgggagaatgtaccagtgaaggggaatgaactggcttatgtgataagtcaggcatttgaaaggtacacaggggagaaaaacattctatacaatatggatattatatgatgtataatatatatgaatatagaatatatgaattatagatagatacatggaaatgaacaattgcattggtgatctacagacacataatgaaaagctgagggcaattaacaaacaattgaaaactaagtgtgaaagccagaggatttctttggcagctgatgaagaatccttcatgtcctctgctcggtgaagaaaaggaactgaagatgaagccatgagttaatagagtggctgcactccaaagatggctgaatgctctagcgattcagatctctgggaccccgacacatgggatgggacctcgaggtgggtgcccctgaacattctgaagccctgagcttctctggctctcagaacctgcagaggtggctcatcccctacacttgagagtactccctcctcctctgtgttgggggacaatgcagaggtctttttttttttttttttttttttgagatggagtctcactctgtcgcctggctggagtgcagtggtgtgatctcggctcactgcaacctccgcctcctgggttcaagcgattctcctgcctcagtcttcctcagtagctgggactacaggcacgtgccaccacgtccagctaatttttgtatttttaatacagggtttcaccatgttggtcaggatggtcttgatctcttgagcttgtgatccgccctccttggcctcccaaagcactgggattacaggcctgagccatggcacccggcctgacaaggcagaggtctttcccctacaaggcaacaggtgtccctaggcagctgccttcacctcatcctctggctgctagacttaactcctggggtgtggccctcattgccagtgggtagctagactttactactgggttaaatcgttgcgtagtttgcctggggatatgctagttggatacaggaggaaaggtgctatattccaaaggagctgtaagatctagtcaacaggtgccagcagaggctgtgggagtacttgtgggcctggattctgagagcttcatgggactggagaagggagctataaggcacaggatttaaccccctggtaaggaccccagggagggtgcaagataactgctagggtggttcattgaagcctggacaaagtggcaggtcaagctgagtgaggttgaaatatctgaattgccggggaagagggcagagaaagggatcaaaagccttgggaaagtgggtgggcatttggaatggaggcagtatgttaggcaaaagagaataggattctatggggagacaggggaacacaccatttgccacggtcatgactaggttgttcagtgttggccctcccctgcaggccaggactgatgctgggagaggcaggcacagaacttggtttgctgattgtactggagaggatagggctggggcaatagagagcagggcgcagcacttagcggtcagaagacaggggtcagaacaactgtagcagcagagaaggtcagagtgataattacagaggtttgatgttcagacagttatggagatggctaagagaacacagtgtctccagtggaaaagtagacaagcagcccaaagggaactgttatgtatagaagtacagttggccctctgtatccatagattctgcatctgtggattcaaccaattgtgggtggaaaatatatatatattttaaattttgtgtggctgagtgcagtagctcacacctgtaatcccagcactttgggaggccgaggcaggaggattgctggagaccaggcattcaagatcagcctgggcaacatggtgagaccctgttgccacaaaagattgaaaacaaaaattcatctgcaccgaacatgtacagacattttttgttcttgtcattattcccttaaaaatacagtataactactatttacatagcatttacattatattaggtattataagtactcgggattatttattcaggaggatgtgtgtaggtgtgtgcaaataccgtgcctttttttttttctttttttgaaacagagtctcactctgtcgcccaggctagagtgtagtggcgtgatgtcagctcactgcaacctccgcctcccaggttccagtgattctcccgcctcagcctcccaagtaactgggattacaggcgcccaccaccacgcccagctaatttttgtatttttagtagagacggggtttcaccatgttggccaggctggtctctaactcctgacctcgagatccacccacctcgacctcccaaagtgctgggattacaggcatgagccaccatgcctggccaatactgtgccattttattatcagggacttgagcatccatggattttggcatccataggggtcctgtaaccaatactgcacaaataccaagggacaactgtattcaaaaaagaccaaaaattaataagcaggaggctgagggtagttgccccaataaagtcatgatcccttgcccagtgtctgaacctcagccagttttcagactcaggacctattggctgcagaggtggttggaaccataggagaatcctgcaatatcatggcaagtatgcactttaatgatatctgcagtccttccccaaaaggaccttacatttaccatagtgctatgtcctgggtaagagggtaatactcagattttttttttttttttttttagacaacgtcttactgtgttgcccaggctggagtgcagtggcgcgatcttggcttactgcaacctccatctcctgggttcaagtgattctcccacctcagcctctggagtagctgggattacaggtgagcaccaccacacctggctaatttttgtatttttattagagatggggtttcaccatgttggccagggtggtcttgaactcctgacctcaagtgatccacctacctctgcctacctaagtcctgggattacaggcatgtgtcaccacgcccagccaagataatattcagatatttcaaggacagttggacacagagtctgagttgatgttgctgtccagaggcctgaagtgttatcatggtgcctctgttagtttagagcatatggagtcctggccaaaaactctgcttacaggggggttatgatgttcatagactcatctgatggcctgtggaacagagattgacaaacttggtagttggggtaacctccacattggaacctttgcctataggttaagtgccatgagagcggtaaagcccagacacaatcctctgaaactgccactgaccagccagaataaaaacacaaaacagtaaaaaaacagtatatcaaaaacagtatctatcacattctgaggggaaaggtggaaatgaatgccatacttaagaatctgaaggctgcagagatgctggtcctcatcttatcttcacataatcaacagtctggcccctgttcgtcgtagtgataagtgagccccatttgggtaccaagacctctgactttgtggagcccagaggtgcagggatgggaagcacgagttcacccagggggtcattgggagtgatggcaaatgagccactcttactttttttcttaagaaactcacagtctacactcctgctttttaactcctttgttcctaggtccatctgttcttcctactgaggttgtagcaacatataaaggtttctgatccagttagcattctgtgccctggaggatggtgcctccaagccagcactccaactgtgccaccaacaagtcattccaaagagctagcatgccggcagcttctgatggtgtggcaggtgagaccaccagtgatctcatgatcatggccttactttgctgtaaagggaattccctggtcagatgctgcattaactacacgtcctcatcttttgtattcttggtgttctggcatttgggatcttgatcctgcctctctcagggctagctaactcctagaaatagcaaacaacctccctgcaagcacgtccttgataggaaaaccaaccaatccaagtccacatccccaaccgtgtcctttatcaaattctcatatatcaagccaatattcccccgccctaaatcaccccagggccgtgtaccaaacaattggggatcactctttttttttttttttttttcagacagcgtcttcctcttttgcccaggctggagtgcagtgatgcgatctcagctcactgcaagctccgcctcccgggttcacgtcattctcctgcctcagcctcccgagtagctgggactacaggcgtccgccaccacgcccagctaattttttgtatttttagtagagacagggtttcaccgtgttagccaggatggtttcgatctcctgacctcgtgatccgcccgcctcggcctcccaaagtgctgggattacaggcgtgagccaccgcgcccggcagggatcactctttatagcccagggcctgccaaaacgatttcatctctccaatcctggactcagcatacctaccctgccttgtctgctactctccatgagaacccccatagaggctccgggctgcgctctgccctcacctctcttttgcctcctgatcaatcccagtccttcttcacgtggccgtgcatggtgtgctgtgcctcctgtttccaggatctgtgaggatagacttccttcttcattacagtcatttccacgtctgcatatttggccatatctggttaatacgaatcctgggtacatttgcataacagatgctctgttgtgtgggatgacatgcctgtgaatcaggcattccataagcctttggatagcagtgctggttgagaccttatgggaaagaaaggcaaacttatacccagaatagatgtctattctcgtgagaaaaaactgctgaccttctaggatagaagggttccagtgaagacaacttgccaccatgtggctggttggtctctttaagaagtagtgccataccacaggcttagcatggatctctgtgctggcagattggacatgcagaggcagcaagagctggactgaccttgttaagtgggaattcatggtgttgggcccatacatagcctcggtcattgcccattgtgctgggaccggggtaggcactgacaaaggctggctactgtcaactggctgagtcattttgtccactgaaggcctggccacttccatggtggatgctttcttggaccactcccagttccaaatgtttggttgagctctttagaaagcaggtgtgagacagagttaggcagcagacatttgattgaggagtaacacctgtgaagaaaaggagtaaagcaagattgggcgaggggaggctcagatggccatgcaaataagacaaaatctctgccagcccagtggggcggctccaggcaaagactggtaaaggctaggcccttggactgccactgtgctcagttatgggctggggcttgctcccaaaatagggtgaccttggctccaacactgaggcagatcctgacaaagccaacagctggaggctgcctgccaaccacactccttgcagctgggcagcacatctttcctcaaaggagggtctggacaggacattttccttgttaccaggggctcagactcatcaagaatgagggctagggtcaccccacagctagaccatgagggccgacagaggtgggagctgagggcagggcaatttagaaggaatagcggagggagccaagcaccagtggtggccctgaggccagtagcagtgaatgaggtctctatttcatgctcgtaacttccctcttgtacagaggccccccagatccctgggggagctgctccccacatgtgtccacattaccgtgacatgtggactgtggcagacatggggctgctctgctccattctcctttgagaaagtattgctgcccagccgcgaggagtgtgatgagttgacagcctcagcgtctgggctggtgttcaaggtcagctgcagcttttgagctgagatcatgctcttcgaggggtggccccagccagagactgagcttgatgataagggcctggctgcttctgccctgtgaacgactcttctaacagaaagtcttggacacctttgttccagggctcccctggggccggccaagctttgtcacatctgcactgtggtctggcagctccctgccccacccacctttccttccctttcctctcagaggcgttgcttaccaatgaggcgtgggtattcctgactctgtctcagcctctgcttctcagagaactccgctgacacagtctgcatggcacagtcctctctgatctcggaggacacctgtctttttttttttttgagactgagtctcgctctgtctcccaggctagagtgcaggggcgtgatctcggctcactgcaacctccacctcccggtttcaagcgattctcctgcctcagcttcctgagtagctaggattacaggcacgcaccaccatgcccggctactttttgtatttttagtagagacggggtttcaccatgttggtcagattggtcttgaactcctgaccttgtgatccacctgcctcagcttcccaaagtgctgggattacaggcgtgagctaccgcacccagccagacacctgtcttaacagcacgtgtttcctacatgtttgtggtctgacctactgaccagctgaacgcccagctcagctgggtgtgagtatgttctctagagtatgggaccagaattccgagtacgttctctagagtatgggacctgcgggccactgggtgggaaataaacaggagacgcccaggccccagcagccagagggttttcttgtgagtttgtgattctcagggacagctttttggctggaggactttggctgtcaggtgtggactctgccgtgtggactccatgtgggcctggttgtctccacaccacatcctcccctgcttccctaagggtcagatgaagaaagagagacttctagactaggttccagggactgagacagcaagtggtcacagagcccagcacctccaaaacaggagctgcactcggagagcagctggtgcccccagagaccaacagcaaggggcagtgtttcaaggagtgttgggggccgaagagcccttcctgggtcactcttccattaagactgaaagtaggggactgggcgcagtggctgatgcctgtaatcccagcactttgggaggtcaaggcgggtggatcacctgaggtcaggagttcgagaccagcctggccaacatgatgaaaccccatctctatgaaaaatatgaaaattagctaggcacggtggcacgtgcctgtaatcccagctactcaggaggctgagacagtagaatcacttgaacccggggggcagaggttgcagtgagctgagatcaccccattgcactccagcctggagaacaagcgtgaaactccttctcaaaaaaaaaaaaaaaaaaagactgaaagtagggagggcagggatgggcccttttatcagtggcctttatggttacagagggggctccagggagaagactaaacaaccttcctcagcctccgcagcctccgcaggcaaagcatagacaccctttcccagcaagaggagtgaggctcactcccagtgacctgcatcctacttggccgttgattttgtgtgtgtgtggagtcggggggggtctcattatgttgcccaggctggtctcgaacccctggcatcaaacaatcctcccacctcagcctcttgaagtgttgggattacagcaggagccaccatgcccagtaatttttgtcacttgttctattaggggaaatcatgtgaaaccgctatttttataagttgaaaaaacagtgaaatactgccaattttgtatatgcttaatatatagagctgaatttaagttaggaataggtattcccagtttagggtatctatttatgaacctttcccgtagccgccattcctggagcgcctcctacaggtcagccaccaaacagagcacttaccatgtgtgtctgattgtattctcacagcagcccggagtatgcacaattattatccccattttacaggtgaagaaagagaggcacagagagaccaggaacacacagctagtgagtgacagaggtgggacgtagacctacatctctctgaactgtgaacctgtgtctctgaccctggtgcacgctgctctcccagggtcctctgtgtagcctcccggggacggagcggggagtgagcactggaatttgggttaaagaacctattcagggctgggtgcggtggctcacgcctgtaatcccagcactttgggaggccgaggcaggtggatcacccgaggtcaggagttcaagaccagcctggccaacattgtgaaaccccatctctactaaaaatacaaaaattagctgggcgtgttggcaggcacctgtaatcccagctacttgggaggctgagacaagagaatcgcctgaacccaggaggcagaggttgtagtgagccgagagctgagatcacaccactgcactccagcctgggagacagagcgagactctgtctcaaaaaaaaaaagaaagaaagaaagaaagaaaacctattcagagagctctggaccaagtggcccctatgtgacaatcagggtcaaagatagactttttggcgtctaaagcggatataatttgtgggaccctctttaggaaagatgatatgaaaaatcttagttttgcaaattttgcacaaaatatatgtccataatgagcattttgctacgactgctccctggctttagaagggacttgtgtaagggagggatcctgaagcttaagctacattatccaggttctgacatgcagagggtccggggtccgctggtctgtgtgtataaaaccttaactccttgttggccatgtccttggcaaagggaaccgctgcttcctgtcgtggccaccaggtggaggcgctcccttgggaactgtttgcagaggtgcctcaccctcccagttcccttccttggcattctctgcaccagtgtggctccccgctgttaccctcagggccacctctgatctgagggaggagtggtcgctgatgaggccttgtctgcatcctgtggcctccccttgcaaagaataactcgcagggaaaggaaagtacagcagctggaggcagcatgtggattctacctgcattataccaaggaggaaacttttgttcccccaggcatccctgaccttatagaaaattccacaagttaaaagtaggtaggccgggtatggtggcttatgcttgtaatcctagcactttgggaggctgaagtaggcagattgcttgagcccaggagttcaagaccagcctgggtaacatgaagaaaccccatctctacaaaaaatacaaaaacaaaaaaattagcagggtgtagtggtgcgtacctgtagtcccagctactagggaggccgaggtgggagaatcacctgagcctgaggaggttgaggctgcagcgagccacgattgtgccactgtgctccagcttgggcaacagagtgagacttcgtctcaaaaaaaaaaaaaggtagctaaatgtttggactagaaacatataagcccaggcatggtagctcacacctgttatcccagcactttgggaggctgaggcgggcagatcaactgaggttgggagttcgagaccagccttatcaacatggagaaaccccgtctctactaaaaatacaaaattagccaggcgtggtggtgcgtacctgtaatcccagctacttgggaggttgaggcaggagaatcacttgaacctgggaggtggaggttgtggtgagttgagatcgtgccattgtactccagcctgggcaacaggagcaaaattccatctcaaaaacaaaataaaataaaataaaacttatctttaattcagatttaagaatagagggcatgaaactctcgtgtaggtaggtgcatctgggttctgtgctgtaggtttggagaggaagctcccgggagggccatggccctgtacgtggtctctctcctcgcagctgtgagctcctggaactcaggactgatcttcgtctatttgatacccctttatctagcatactgaggttctcggtgtttccagaatgcataagagaacagagtaagagggggatggaaaatgagagggaaggaagtggtgagatatgaaaggaaagactgacactgatacaacttcttcaaaagaattctgggctgggtgcggtggctcatgcctgcaattccagcactttgggaggccaaggtgggcagatcatgaggtcaggagttcaagaccatcctggccaacatggtgaaaccccatctctactaaaaatacaaaaaaataaaataaaattagccagtcgtggtggcagatgcctgtaattccagctactcaggaggctgaggcaggaggatcacctgaacccaggaggtggaggttgcagtgagccgagatcacgccactgcactccagcctgaacgacacagcaagactccatctcgaaaaattacaaacaaacaaaaaagaattctgagtgtctactctttttaggactttagaaataaagagaagaggatataaagataaacaaacagatgttcccacagtcagttaattcactcttttgtgaaaaagaaagatatacaagtcaccagggtactggtttaaaaaactaacaaaacagaaaatgtgaaagaaaatataagatctatagaggatcatcaatcctaggactccaacgtctatagtaattgtagaaactaggaacagaaacatataggggagggaggaattttccaaatataaaacaagaaaacttgctagaactaaagaacatttgacttccatcaaagaataatgaatgaaaaataatttcatcgattggggtattggggtattgggccaagcatatgacacaggacttcctggagggaagcccagcctcctcgccacctggagattttctggtgctcctagaatcaagcatgactagtaaaaatattgagaatcctacatgactcttgttcctttgtaggtgacatgttagtgtgtttgtttatatctctggaatcttgaaaagtctctgaaaccccagcatgttaaacttccatgctgatgatgtgggcgtgcctgggcagagttatttgtcattcattattctttgatggaagtcaaatgttctttggttctaggaagttttcttgttttatattttgaaaattcttgcccctgccccatatgtttctgttcctagtttctggggttactattagtcaggcgttggagttatgaattgatcctctgtagatcttatcttttctttcacattttctgttttgttagtttttaaaatctattttctcatctaccaacccttctatttaagttatttttcagtgattatatttttcacttccgagagctctaggttgcttactaaattttcttattttagagctttctgttcttttttgtgctcgtaatagtttctcaaatttctctgaaaatacaatatgtaaaaaagtatgtaaaaatgaagttttctcttgttcccaagctatccttgttttctttagggtcattcttcctgtttcattttttttctctcagctttttgttttaaaaatgttcaaacacacatataagttgaaagaagagtgcaatggatacttatatatccttttcttaatcgttattaattaatattttgccacatttgctttctttctctctttttggttttttggctgaattgtttgaaaacaactgcagacatcacaacattttactcctaaatatttgtgcatttcctttaagaataaggacattctccttcaggaccacaagattgttatcacaccccaaacacttagtatgaattgaagaatattttctgttgttctttctttctttcttcctttttgttttttttttttttttttttttgagatggagttttgctcttgttgcccaggctggagtgcagtggcatgatctgggctcaccacaacctccacctcccgggttcaagcaatactcctgcctcagcctcctaagtagctgggatttcgggcatgcgccaccatacctagctaattttgtatttttagtagagatggagtttctccatattggtcaggctggtctcaaactcctgacctcaggtgatccacccgcctcggcctcccaaggtgctaggattacaggcgtgagcctccgtgcccggctgaagaatattttctaatatacaattcatatttaagttcctcatttgtgcccactgttactttaatagcatttgtttcagatcctggaaccaatcaagagtacatattatagttcgcgattatgtttccttactcttttttaacctagaacagtccccttcccctgccccttaccaatattttggtggttttttatgtcattacatttctgaagagctcaggctagctctcttgtggaaatttctacactctggatttatctaattgtataaagcaggttcggcatttttctaaagaacacttcctagttaattttaagatggcgtgacatcaggaagcaggtgcttcctcgtgattagatcccgcctgtgcactgtcagcagcaacatcacatgcataaagctgcatccttttcagggcagcacactcagggacccacatgtccgcctgcttttcatggctgatgttgattttgactacccagtcaaggtgctgcctgctttatccacttatttttcccttgcaactaataagccatttggggggagaaatgttaagactatgtagatattctgctcttcgtcaaactttgtactgttgatttatcacccattttcctgacctaggccatatcctgctggttgtaaaatgatggttttcaaatttaaccactccctctacattgatcagcactttctggctctacaagatgttctagactcatcttgtactttccatatcctagtcctagaatcagccacttctccaagaatccctggttctttgaagtggttgcctttattattggaggatactttcactggatattaaataggttataggttggcagtctccactcagcctttggtactttgaagatgttccattgtttcttggcattatttatgatgaggtcagtgttttgtcgtggtttcattaaacttttttttttttttttttgagacagagtctcactccagcccagactggagtgcaggggcacgattttggctcactgaaacctccacctccagggctcaaggaatcctcccaccctaattagcctcctgagtagctgggactacaggcatgtgccaccaggcccagctaatttttgtatcttttgtagagacagggtttcgccatgttgcctaggctggactgaaactcctggactcaagtgatccacctgcctcagcctcccaaaatgctggaattatagatgtgagccacagcaccccgtcctaaacatttttttcgttcgatgtttcatttttctctgaccgcttttacaattgttttacttatcttcggtttttagtatttgagcttcttggatctgtgtggtgatattttttcattatatttcttcaaatacacttttttcctgccacagtgtctcacctcccctactgggacttcagttacacgcatgttagactgcttaatgtcccacaggtcacgaaggctctgttcacttctttgcaatctttttgtttctctccgtgattcactttggatagctctgttgccttcccttcaaatttatggactttttttcctgcagtgtctgatctgcgcttaaactcattcagtaaatgtttcacttctgatactgtattttctaattctagagtatccattttgtccttttccatagtttccatttatctaatcagtttccccatttgtttactatattcagcttttccctttaagtccttaaccatatttgaacatatttataatggatgttttaagatctgtgtctgttaattccagcatctctaacatttcttggtttgtttttctcaacttttttttctcctgattatgtgttacattttactgctagttcacctcttcagtgatttttttttaattgtatgtgttacattatagacgctgtgttgttgggattatgtggttttcctttaaaatgtgttggggtttgttttagcaagcaatcaatttactggtagatcagcatttttttttttttgaggcttgttttaagctatgttagggctgattgagattactcctttcttttactaggaataaccttaggagagaatagctctattcccaagatgtggactttctgaaggtttgaccaaattctgtactgcccagctactctggctagttggaacttccgtgtctctcagtactgtgagaactctgtgtagctcccgactccctaacatctgtcctctaccgtgccttgcacacgaacgcagaaatgagtctgcattctcagttgagtatttagctcaagacttaaggggaatcctatgtcgatttccgcagctccttctctgtgcaactctctcttttcggtatcctgccccacaactttcagctgcctcagaaggcttaaaatcaaatgtctgccttctcagctcaatgagctcactgtgctgtacttgggctctgcctttctgtactgtggtctagaacatggatctcacatggatttctcttttcacagggatcccggttttgtactacctgttgcccaatatctgaaaaaaattttatttatatatgtcatctagtttttattgtttccaatggcaagaaggctagtccagtactagtctctcatgtctagaactgttaagaaattttaaatgccaactactgtacaacttttgaaaaagcacactttttgaattcttatttcttctgttagctttggtaaatttttttagaaagttgactaatttatccaaagtgcaaactatactggtgtaaagttgtttataatatcctcttattatctcttaatgtttgtaggatctgtagtgatttcccgttttttattcctgacattgcttttatgtgtatatgtatttttttttccttttttcttggtcagtgttaccaagagcttactaatcttttcattgaacacttggctttgttggtcttcttcttcctcctcctcctcctcctctgcctcctcctcctcttcttcttcctcctccttctcttcctcctcctcctccccctcttattcttattcttcttcctcttatttttattccatggatttctgctcttatatgtattttctattttctctcttgtacagctattctgttactagtttttgagttggaaacttagatgactggtttttagcctttcttctttcctaacatatgcattccaggctctacattcccctcgaaatgctgcttgagctgaattatgtaagttttggtatgttatattttcattaccattcagtctgaaatattttacaatttttgatgtatttcttctttgatccacagattatttaaaagtatattgcttaatttccaggcaattggaaatatttgaattatctttttgttatggatttttaaagcttaatccactatagttagaaaatatgctctgaatggtttaagtcttttgaaatatattggagaatctgttatggcctagcacgcggtcaatgttaatacattttacatgttcacttgaaaaactacgataagtattttgtcattattgagtgtaaagctctatatgtatcaactgggtcaagtttgtttgtttgtttgtttcccttcttttcctctatgaagaagagtatataagcatgaagactttattgggttattgggtaataattctgcaattcccctctcatgagtgttaaataatttttatgcctttttctttttttaatctgtgtattgtcagttacacagcaactgacaaaccttcagagaataaggggaagctttcctttctctcctacaagtagcactgaagaaccagtttgtaaagttcacataatttttattgttaccttttaaatagtttacagattattctaagaaaatcttttaatgtatctccatgacattttataacacaaaaaagaaaaatgctaattgtatgtatattataaagttttaccatcatttctaaattaaaaagtattaaattgagatcgaaaccacctttgcaaaattatgacactgaagcagtttcattgtctggggtgaatacctggggttcgtcatcttttgttaagaaaatttaggacacaaggagtttaggagcggaggtttaataggcagaagaaagagaaaggagaacagctctctctctagtgagagagaggggctctgggaagggaaagatgactgggtcaagtttttaagtgtgttgttcatacttttatatccttatcagtttttttggtgtgtataccttttctatcaagatgttgagcgagaagtattaaaattttcctctatgactgtgaatttgtctttttctcctttagttctgcctagttttctttatatattttaaagctatgttatcggctacatatagatttacgactgtgatgtcttcctattcaattggccactttatcattatgaaatgaacttatttctactagagcttcatggcttaatgtctacattgcttaacattagtatcactatctttgggtaagcttttatgtggaatataatatttccatccttttgctttcaaccatctgtgtccttctatttagtgtgtgtcttttgtaagcaatacttaattttttttttttttgacggagtcttgcactgtctcctgggctggagtacagtgacgcaatctcggctcactgcaacgtccgcctcccgggttcaattgactctcctgctcagcctcccaagtagctgggattacaggcccttgccaccacacccagctaattttttttgtatttttggtagaaacggggtttcactatgttggccaagccagtctcaaactcctgacctcgtgatctgcccgcctctgcctcccaaagtgctgggattataggtgtgagccaccatggccggccacaaacattttttttaattgaaaggcagtgacattggctaataagcagttttttgttttgtttttttgttttttttggatggagtcttactctgtcatccagcttggagtgctggggcatgatcttggctcactgcaaccgccgtctcccaggttcaagcgattctcctgcctcagcctcccaagtagctgggactacaggtgcctgccaccatgccaggctaatttttttgtgtgttttttagtagagatggggtttcaccaagttgaccaggctgattttgaactcctgacctcaggtgatccacctcccttggcctctcaaagtgctgggattacaggcatgagccactgtgcccagccataagccataggcagtatttttaaaacccagtttgacaacattagccttttacttgcaatatttagtccatttgcatttactgttattccagataaggtttggtttacaattactctctgtttgcatgttatttgacacatctgttttatgtctcttcttttcttcctttcttggcttcttttagattaataaaatattttttataattattttttctcgtattaacttacagttatgcattcttttactattctttgagttttgcactagagattatcacataggatgaccacttgattttctttactttgtatgtgatttggaatttttgctaacagaatgttttctttctgtttataatagctttactcagatatgtctcagaggtggccattctggtcaattttcttgtgtatataaatacattcaacatctagatttagtccttttttaattccagaaagttttcttagattataattttcatggttaaacactttatattttattttatttatttatttattttgagacacagtttcgctcttattatccaggctggagtgcaatggcgcaatctcggctcactggaacctttggctcccaggttcaagcgattctcctgcctcagcctcctgagtagctgggactacaggcaccccaaaccacgcccggctaatttttgtatttttagtagagactgggtttccccttgctgaccaggctagtctcaaactcctgacctcaggtgatctccccaccttggcctcccaaagtgctgggattacagacgtgagccaccacgtccagccaaccttaactactcacgtccagccaaccttaactacttttaagtgtacaatttgatgggttttgacaaataatttatagttgtgtgatcattgccacaatcattattggattatagttttaaatattatttctgtcccatcgttttgttttgctttttaggcaattctaattatatgtacagtatataattttttgtttattttctatagctatcacttttttctctgattgtattttacctgtttatttgtttttgttttcctgcctatatcccttattatattttcagttgaaggtgaatctatttgcctttaggcatcttgtgatttaatctttatttctgaaaaggtttagttttttcttttacttttttcctgagttttattaactcacttcatgagttatttttgtccatttctgtcctgattttttgaattttggtgttcttttatatctgtaaatacctgtctaataatatttaattcatattagacactgtgtcataattttcctgtctcttagttgttttggcaggtaagaaattcattagttgaagatagtagcctctgactttctgttttcttctcatagtggctttgtgtaagtgctgcatgtcatttttgtttactcaaaagtatattgaatttttctggcctatcaataacaagtgtttctttgtgagatggggatgaaggacttgagtggcttactaagattcttcgttcaagaatgccctcttctattggtaccgtgaagttcaattttcatgaatagatggtgcttttgtgagagagaggttggtatgtcttttgattctgattctcttttgtttctgtgcgactctggctttccaccagtttgttcctttcttttctttacctctcagtttctttaccttctacgttgatttcctctccccagacgtggtgactttccaagactgtacttccagtcctgtgcacttccaaagcctcttcctcggggctcctcagcagctagtgctgactcaccagatctattctcagtacttctccactcaagatgagtggatcgcagacctagtagtttcctccactcattgtagcatcctacatggagtgatttgaggaactgctagaagatttcgagcagagagaagtgattttatttgacttgtgttttgaagggatgactctggctgatgggtgaagaacagattggggaggggcaaggatggaagcagaaagtgtagctcgggtggctattacaataatctacatgagaaataacagtggctttgattgggatagtactagtagacgtcatgagattttggattttttttttttttggagacagagtctccttctgtcgcccatgctggggtgcagtggcgctatctcagctcattgcaacctccacctcccgggttcaagtgattctcctgcctcagcctcctgagtagctgagattacaggcatgcatcaccatgcctggctaatttttgtattttcagtagagatggggtttcaccatggtggccaggctggtctcgaactcctgacctctagtgatacacctacctcaatttattctttaagtgtaggagtgtgtgacttcactcttgctgggcatcgccttaggtgctgtttataatgtggtatcttatcgctacaaagagcccgttttgtcaatcttatgatctgtattttaacattaatgctggttagttgtatctaaactgcaaaagggaggggatataatagagcttgtccaacctcacattccatcatggccaggaactcggttttaaggtttttctggggtcctcttggccaagagggtgtctattcagtcaatggtgggagggaggagaaggcctagaattttatttttagtttgcaacggaggaacttctgaactattcaacaggcaggcagggcaggccttggaccatctatttcactgctgagtctggaattggtagagtgtgtatggaaaggaggacctcagggagcagatccagccactcagtggacagggtttagcttgagcaaagcgggctatggtccacagtggagctagtcctgtaaagacactaggcagagtcttggggccaactgcaggggccatgaagcagagctcacacccaggtaaggccctgggggtaggtgattgtgacttgtgggtgaccaggtggcaggccctggggcagttcccttcagagccaaggcccaccaggtcgggagactgcaggctgtcacttgtgggctggtccttttgggatctagagctgcagtgggctcagcaggggatgcagggagctttggctgcaggaaaggaattatcatataaggatactggcagattgcatggaacctaaggataggaagagacgggccctcgggaggattagggaactggaaggcaggcaccaagttcctttctctcattgtggtgcctatgcatcctctgtctccctggctctgccagatctctccagtactcttctgtctgcctgggtcgctaccctttcctttctcttagctttctctactttgcctcaggcccaataaaatctgcctcattctctgagatctacaggtgaagggcccatggagtttatctcagtctcatgagagggaaccagttggtaacatccacaccccatgcattttgcatcctcatattggggaccaggcaatcagtttgagaggtgaccttgtccagtcatggcccccagggttgtgggagaaggaatctctaagaagagggcatggtcaggagaaacgatgagtggttttagtttttgatccacttcgggcagtttgcagagtaagaatctctgcccaggccccactgggttcaccagcttagaatcccttttactgtcttattaaattaacttttattttgtcgtagctttttgtagacatatcaattacatcaataagatgcatccattttaagtgcataattcaaaaaggaaaatcacccaggaaaagcagagctcgtgtgttcatctgtttcctgttggttatagcaaaacacctgaaacaggaaatttataaagaaaagaaatttatttcttacagttctggaggctaagttcaagactgaagggccacatctggtgagggccttcttgctggtggtgactctccatagagtcccaaggtggcacagggcatctcatagtgagggggctgagcatgccagctcagatctcacttcctcttcttataaagccaccagtcccactcccatgataacccattaagctatgaatagattaatccacccatgagggcagagtcctcatgatctaatcacctcttaagagccccacctctcgatgctgccacattggggattaagtttcaacatgagttttgcaggggatgttactaccatagcagctggtaagaccaggcactgagaaaatcgtcctgtttcctctggagttcccatcgagagcagctccccgaagttgtctgtgctataatgaaagtctgagatcttaatctggctctggaataggataacagcagctgaaggggaaaaaccagtacctgccgtctcctgccggataggagctggatggcaggacaagtggaaacctgctgaggttccttcactgggaagggagtgtcatgcaagagacacagaagccccaaagggcccacacggagccactaatagcaggatgggggcagaagctttggagacataaagaccaggactggattttcaactccccctttccctaggcatgaaacactggaaaattcactcagtcatctgacaccgggtacctcacataaaaattaagataacaacatcttacagagtgggcgctaaaattagagataatgtttgcatgaatcacggtgctctaaaagctggccatcgtcatcattttggtccgcgcacacacacacacgcacgcacatacacacgcacacattaaaaaatagacagagagataaagtgagtgcctccgtgggtctccccgaggcatgaaggtgctggattgaatgtgcgtggagaatctcaggcaatgctcttacaggtaatggtactgggggccacgggcctttcaagggccttaagataatgtttcacacctcaaattaaatgattgactcaaaatacaaaataaaaactctacaattaaaattgatgaaggcgaagtcatctccaatgcgacaaactcataaatgatactttatccttagatgtaaactctacaagagttatataggctgtagtatgttggtgtcagagttctaagctttatattttggctccaccactgtgtggttctgggcaagtcactgaacctctctgtgcctttttccttatctgtaaaatgggaataataatagtgcgtacttcaaatagttattgtaaagtacttaaaatggtgtctggcacataacaagcctggctattattatatttattaggatgaaggtgcattttaatatgcttgatataattggggtagggcttccagaagtaaaagggtctgagcctcataaaggccttaaaacaactctgatcacttctatgtgactgtatttttatgtaaatcaggtataactcagattgtaaactacagagtgtgattgcatctttataaaaattaatggttctctgcaggatggtactgctcccagaggtattttggagatttgcatggctttttcttttgtcatcatgaacaggggttactgctggcatttagttgggtcagactagtacaacaaagatttctcgtgtgtccctcaggacttttatttatattttatttatttatttattttgagacggaatctcgctctgtcacccaggctggagtgcaatggcgcgatctcagctcactgcaaactccgcctcccgggttcaagtgattctctcacctcagccttctgagtagctgagattacaggtaggcgccacgatgccctgctaattttcatatttttagtagagacggggtttcgccctgttggtcagtctggcctcaaactccagacctcaagagatctgcccgcctctgctttccaaagtgctgggattataggtgtgagccaccgctcctggttcctcaggacttttaatacaacaaacctgaccggacatggtggctcacgctggtaatttcagcactttgagaggctgaggtgggtagatcactggaggtcaggagtttgagaccagcctaggcaaaaccccgtctctactaaacatacaaaaattagttgagaatggtggtgtgtgcctatagccctagctactcgggaggctgaggcaggagaatcgcttgaacctggggggtggaggttgcagtgactgagatcttgccactgcactctagcctgggtgacagagcaagactctgtctcaaaaaataataaataaataaataaataaataaatacaacaaacctatttatgacaatccaatttaaaatctaactgaacctagaattatataggtgaaaaacctgcttctaattatttgagcctagaacgaattccattttataagtgaatacaaagtgggttttttttgtcaaggtttagtaagtactaaatttcctaggaagcatcaaatgcatacatcaaggaaatacggcgcagtgctttatttgaaaatttgtcaagagttcaccattttgaaaagtcacggatggcgatcctgcttatattattggcatcatctaattagtgtccattgtaactgtcctcttcatggctactacctctacacaggaatatactgatttagcctctatggcaaaatgtcaaatatggaggaaaagggtgagtattattcagctgaatgttaaaaacttggtttttatatcttcccacatgtggagagttgtcaatatgcctactctacacttcttttaaaataaacagtgaccacaagaagacagaaaataaagattgtataaagaaatacatttataaagttggcagcatatcatacttctgagatttaaagaagtttgaaactagaatagccacggaatgttaaagaaaaatctctgagtagaaggtaaagttgttgctaattctttcagcataatataaatgattgcagaatatggtaagcagtataatattatagaaaaaactcaaattaccagtggtttataggttattagaatgataggaaaaaatccaactgaaatttttttcttcactgaattctgatgatactgttgtaagaaaaatcaatgagatggtgaaactggtgaatatcagctgtgtaatgagaccagtggagcacattttcgttactagtggataagatctcccagtggaacgaggaagctctcctgttcacatggataaggttaagaaatgaaaaaagccacagtgaaaatttattttcaaaattactggcaatgtatacaaaggcactgacagcatccaaaacccttggaatgtatttcacagaaaaaagtaattccctttcccattgtcattatattgtacgtgccacagattgagcctcaactagaatttcttggcaacatgggtttgtaggccattaaaaaaattagcaccagatgtttagcacgttgagaagacaaacattttgtgaaaattgtatgttattttatttattttgaattccttgttgtttttcaagattttcagtgttgcaatgatctgcctttgaaggcttaacctctctgagacctcttgtagtctcttattttacagtttcttcttccaacttagcctttattctccaccacctgatgaaataaaataaccctagaccacaatgaaataaacagggtccaaaacttcatcacgtaaaatgtacagttgcattctttcaatgttgatttaaaaaaatgtctttcaggaggcttgtactatcaaaaaaaggcacaaaggtaaaaatattgaagcatattatatacaattatccatatatccaactgagcaagtcccaattacgttattttatttcatttttattcattacttttcaacttttattttcgattcagtgggtacatgtgcaggtctgttaccagggtatattgtacaatgctgaggtctggggtaacaatgatcccgacacgcagctactgagcatagtacccaacagtttttcaaccttgccccactctctccctccccactcagtggtccccagtgtctattattaccatctttatctccatgattacccaatgtttaactctcacttataagtgagaacatatggtacttgtttttctgttcctgcattcatttgcttaggataatgacctccagctgcatcaatgttgctgcaaagaacatgattttgttcttttttatggctgcatagtattcctggggagagagatatagtattttcctttatattatatataacatatacatatagaatataatattatgtgtatataataatatataatatcatatataattatattatgtattatagaatacataatattatataatataattataatataatatattataattataatataattcatttatatattttatacacacacacacacacacacacacacacacacacacacacacgtattttctttatccagtccactattgattggcatctaggttgattccatgtctttgctgttgtgacagtgctgtgatgaacacgtgagtgcctgtgtctttttggtagaacgatttttctttttaatatatacccaataatgagattgctgggttgaatggtaactctaagttctctgagaaacctccacactgctttccacagtggctgaactaatttacattcccaccagcagagtataagcattccctgttctctgcagctttgctggcatctgttgttttttgattttttaacaagccatttaataattgccatctggtgtgagatggtatctcattgtggttttgacttgcatttctctgatgatcagggatgcagagcattatttcacatgcttgttggctgcttgtatgtcctcttttgagaagggtctgttcatgtcttttgcccactttttaatggggtttattttttatttgttgaaccatttaagttccttatagattccctccctccctcccttcccctgctttcttttttagttccttactttttttttttttgagacggagtctagttctttccctcaggctggagtgcagtggcgtgatctcggctcactgcaagctccacctcccgggttcacgccattctcctgcctcagcatcccgagtagctgggactacaggcgcccaccaccacgcctggctatttttggtagagactgggttgcactgtgttagccaggatggtctcgatctcctgacctgattatccgcccatctaggcctcccaaagtgctgagattacaggtgtgagccaccacacccagcctctttctttcttctttctttttttcttcaggatttcattcctgttgcccagattggagtgcagtggcacgatctcagctcactgcaacatctgcctcctgagctcgagcaattctcctgccttagcctcccaagaggctggtactacaggcacgcaccactgcgcccagctaagttttgtaatttttctagaggtggggttttgccatgttgcccaggctggtcttgaactcctgagctcaagcgatctgcctaccagacctcccaaagcgctaggattacaggtgtgagccacctggcccggccagattctgtatattagacctttgctgggtgcatagcttggaaacattttctcccattctgtaggttgtctgtttactctttagtttaattaggtttactctttagctaaattagaagctctagtttaattaggtgtcacttgtcaatttttgtttttgttgcaactgcttttgaggacttagtcataaattcttccccaaggccaatgtccaaaatggtgtttcctaggttttcttctaggattcttatattttgaggtattacatttaaatctttaatccagcttgagttaatttttgtatgtagtgaaaagtaggggtccaatttcattcttttgcatatggctaaccggccatccaagcaccatttattcaataggaagtcctttccccattgcttatttttgttaactttgttgaagatctgatggttataggtgtgtggctttatttctggattctctattctgttccattggtctatatgtctgtttttgtaccagtaccatgatgttttggttaccgtagccttatagttagtttgaagtcaggtaatatgatgcctctggctttgttctttttgcttaacgttgctttggctatttgggcttttcatattattattatcactattactagaggtagagtctttctctgttacccaggctggagtgcagtgacaccaccatagctcacagcagccttgaacttctgggctcaagcatcatcccacctcagcctcctgagtagctggaactataggtgtgtgccaccatgcctggctactttttaaaatttttttttgtgtcagactcagggaaaaaagaaaaaattttaaaactaaatataagaccaaaataaaaaaaagagaaaacaaatttttgtagagatggggtctcactgtgtttcccaggctggtctcgaactcctggcctcaggtgatcttcccatctcaacttcccaaagtgctgggattacagccatgaaccactgtgcctggcctcaattcagttacttcagaacatgtcccctgtgtcccctgtttccccctagtactgagcctgcactattacctgcaatagctgtgcctgcgattctcctgccaacatgatcacacacattcaatccagtaccttcaatgcaaccaggcagaccgacgcaggcactcaccctctctttctgtgtgcgtgcagaccaaattgatggcaatggccagctttcagagccccataagctgtgcatatcccaaacattacctctaatcgaagcacccaccctgtagggtaagtgttattatccctttagtttgcttcagtttgagactcacgtttgagaactgaggcaaggcaagaacccggagtgcacctcatcacatgaaaatatgcattatcttgtaggttactgaatatggccttccaggtcttttgaagtagcaggatgcatatcttgaatgagtattggaatttcaaaaagggagataagattgctgaggtatttaatcgttacctgttccacatcatagagggacgttttcaacattactcttataaatgaggccagtgttattctgagaatattattctttcttacttttcctctttgacagactgttatttgcttggcatgttattcctgtttctattaaggttattccctctttggtttatagactaatgagcctggtatgtttttatgtatctgaacactaattttaattctgatgttaactggaacctcttgtctttcattcttcagtatttgtgtaaagaaatgctttcaatattcttacttctaaatccaaactgactcatgcaaccatatgatctattatgtattctagtaaaactgttctggatcatttacatatgaagatgcatattattttgttatgatcatttcatttctccttttatgacagagtgtgagaaaaagcagtccctgacacccaagttggcttggcactcacttgtggggtttttctgttacatgtaaacaattccacagaacaccggtattggataaggccacccagatggggatggctctagataaaaacaagaacattccctaatcacgtctgaacatagacaaaacatgaacattctccaaaccacagagatgaccaaacctccccgtatcctggctaataggagtgactgctgctttttcacattgatagctttagcctggctctagtcttccctccttctagatgaagttaattaaaatacccaaccatagaactgctcccacttcttgacagcatccaatccaaagcaaagcaccgctttcacaaatctttccaaaagctgccccccaaaccctaaatccgatagtaagtcctttctaataccctcttaccaagacatcctgcatttccccgtggcgtgcattctccctccttgcaatgtgcaataaactgaacttgttcaactgcaagtgtgttcccaagggtctttggctgggaggcgttgatagatataatgatgtttttggaattatgtatacagatagattatattatctatgaattccatttcaagatagtaaatgggctttgcaaagcatttgctacaaaaagtgggtattgaatttggtaggatcattgataacaattttctgatcatgaccctgcctagggctaaatcctaaatcctggtagattgctacatttgcatagaaatcctgcttgtgaaggtaaggtttgcttgaggatgccacttaaatgattggttagtattaaatcaccccacccttcccatgcccaaattgtcctcaaactaaatacagaacaagctattctgctttacagcttaagaaaaatgagtagggagggactgctccaggtcagtcttgtcttccggactctggctttgatcccctttgtcatataggatactattgtctgggcattattaggtcttgttatgctcatttaggacactcatgtatccctatcatttgttcttcagatgtgtgctttttcttctgccagcacttctggcatctcaatcgtgttgcaggaactgttaaagtaaatgagtggataaaagtgtttttatgaccttgcagaatgaaactaacatcctttcttacttttcaaaaactagctgctttaaaagggaggaataggcacttaggaaattctgagacgccccaatgattaagataaatgctgcttcataaataaaaaaaaaattagctacatatgtaagcattgtttcccaacgacataccctctccatctcggcatacttttgccacttgctgtgcctgggtgcatgatgaagaccaacttgtcaaagaagtgttgcttttaagaatgtgggaggaggtagtttagattacttagggctaatcattaatatatgatttagtaagttcattgtttattttttatccaaccatacctccaccccaggtccatgagggcggggacttttgattggtttgctgttgcctgtcaagagctttaaaaatgcgaaataaatatttactccgtgcacaaatgactgaatcagtccagccctcagtgattcatctgttttccctcttccttttcccatatcgggtgtgcgaacctctgctcaccaagtaccagtcgggtccttctcctgcccacgtgaaggaagaaggcgcagtggggctgaggcctcactagggcacccacacggagcgctgcgctcagccttctggacccggtacctccccaggctctgaggacagcagcagccccaggacggacgggtacgccaagtcctggggaccctctcccaagctctgtcagggcggcggggtggcgcgcgctcctccctcgggcgctagctctggaaatcgcgctaggcagaggtgggcttgtgtccgcacccgcagcctccgcgtcaacaccctaggggagagggacgcgggcaggggtgccgggcccaggctccccagccattctcaggccagaaccccctttttaacaagacatggccttggtgtgtcgcggactctgccggggacagtctggcagaactgggctccttgcgctccccagtataccggctaattccgtgccctttgcaaacttcatattttgatttcaaatttaaaaataatcaataggccgggtgcggtagctagctcctgtaatcccagcactttgggaggccgaggcggacagatcgcctgaggtcaggagttcgagagcagcctggccaacacggtgaaacaccctctactaaaactacaaaaaaattgccgggcatggtggcaggcgcctgtaatcccagctactcgggaggctaaggcaggagaatcgcttgaacctggaggcggaggttgcagtgagccgagatcgggccactgcactccagtctgggcaacaaaagcgaaactctgtctcaaataataataataataataataataataataataataataataataataaacaaatataaaaataatcaatagcattacccatatcctttcttttgtccgtggtaaaacaatcaaaagtattttttaaaaagtgaaaatgaagtctccctcccagtccccacgcccccaggttcagtccggggcgcctggacaggttggcattggaaagcgtgaggaagcagccacacccagagcgcactgcggctatcagagatggggtctccggatctgcgacttccacgaggcgctcgcgagggggaagttaggaactggtttcgcaaggaaggatgcggttggcacacagtgcgaggagaaaggggttcttcgggctgagcgcgggctcgctcagctcagcgtcatcaaagaattgcaaagtagagaagaaagcggctgattaccaaggacgccttgggcagtgaggaagggggagggtgaaggggagccaatatatgtgggctcccagggtagccagaaggcggccctcagcagtatctagggagcgggagagagggacagggggtcgggggagagagaggaggagagaagagagaggggaggacggagagagagaaacctgtgaggattcagaccgatgcctgggtgagactttgagggctggggaccgtgaatatggctcgctagccttcctgtggtcccttttgcactcacaggctagtgagcagagagggaactggattttcttttcttttcttttcttttttttttttttttttgatacggagtctaactgtgtagcccaggctggagtgcagtggcgcgatctcggctcactgcaagctccgcctcccgggttcacgccattctcctgcctcagcctcccgagtagctgggactacaggcgcccgccaccacccctggctaattttttgtatttttagtagagacggggtttcaccatgttagccaggatggtctcgatctcctgacctcgtgatccacccgcctcagcctcccaaagtgctgggattacaggcgtgagccaccgcgcccggccggaattggattttcgatttccatctagtgtatgataagccctcaataaccatggcgaatgaactaaataactacctcacatactctcattagacagaataatgctcaacgtggtcccgggattaacctcagtcccaccttaagatattggcaaaatccttagttgggtaagactcagggaaagtccttgtcttcagaacattcatctcttcttttcattcatttttcccttcttctttctttcagcctgggtgacagtctcactctgtcacccaggctggagtgcagtggcgtccagtccagtgtattctgcagacagtgccaaggccagcacttggttaatgaagcttgggcaacaccatggggcaaagcaggaccagtttcattagacttgagcaaatctgcgtttccttcacagggtaggaaaggaaggaggaagggagaaataaggaaggagcctttgctgtctactcccggtcctgaaacagggccaatctttagtatctgcgttaaaacatgttcctggctttccttctacacctggctgctttttcttggtctgctcccaagtgcctctctttcctttcccaactatatgtgggtgcctcccagagttctaagccctcctccttgcaccctgtctctcgtggcctcaacccatctccatggatttaatggccattcactcatgcatgatgcccggatttccctctctacccatccctttctctggagctccagactcatacatctagttgcttccagaacacctcaaactgcatctctccatccagaattcatctcttgctctccacctccctgccctggttttcatgatctcagcgattgtgtccactttcctcccagctgcccagcctgtggctccttccccctcttgttcagcccaccagtctcaagccccgacatcccgtcaggagccatttaaatcagctctccaatgcatgcaatttcctctttccccttatctggccaccatcacctgttagattccacactggttcctaagtttccaggtttgctctgcttctggcctcattccacatgaagccatattccaaaatgggtatttgataattacttcaggataagtgcaaagttacttcatgtggcccagaaggacactgacccttgtctgcttttccgtggcaccactcccagctcaaacaccaagttcagccatctcgcttttgttcacatccttgaatgttcatgctctctgtggtctggcaacctgcttgtggccctttctttccctctcccccagtttttctccacttggtctggccatactcatgcttcaggcccctgtggaaacatcacttttctcagatatgttccctgacttccaagtctggttagctggccctcgtcacagcccttttcatactgcgctcggcttactgtttatttgcctttctcctcccactggactataatcagcctaaagtcagggaccctagcatctgggtcacttcattattctcagggcctagcatggagtctggcatataatagatgcttaataaatattgaatacctacttagatgaataaagggaagaattgaattgctggaaataaatgaagatcaaccaaatgagaacaagcaaagacgattgattcagagcttgctatagcaagggagttggccaccatcacttgtgttttgacagagaatccaaagcaggtagaggagtgggaaagctttatagtggaaaaaagggaaaggcttcatgtatgccctggttgaggctgttggcctctaaatattattttttaatctttaaaaataagtgtcactggccgggcgtggtggctcacgcctgtaattacagcatgctgggaggctgaggctggcagatcacctgaggtcaagacgtcgggaccagtctggccaatatggagaaaccccatttctactaaaaatataaaattagccaggcatggtggtgcatgcctgtaatcccagctactcaggaggctgaggcagaagaatcgcttgaacccaggaggcagaggttacggtgagccaagatcgcaccattgcactccagcctgggcaacatgagtgaaactccatctcaaaaataaataaataagtaagtaagtgtcacttacctgcacacccagcactctctctcgcactagggagaatatgtaagggaagaggtccatatagtattatacagtcagaactgcagttagaacttatagtgattaaattccctttttttttttttttttttgagacagagtctcgctctgttgcccaggctggagtgcagcaatctcggcttactgcaacctccgcctccagggttctgcctcagcctcccgagtagctgggattacaggcacctgccaccacactgggccttttttttttttttttttttgtatttttagtagagatgggattttaccttcttggccaggctgatcttgaactcctgacctcttgatctacaagcctctgcctcccatagtgctggaattacaagcatgagccaccatgcctggccttaagttcctttaaagtgaagttattggccgggcacggtggttcacacatgtaatcccagcactttgggaggctgacgtgggtggatcacctgaggtcaggagtttgagaccagcctggccaacatggtgaaaccccatctctactaaaaatacaaaaattagccaggtgtggtggtgggtgcctataattccagctactcaggaggctgaggcaggagaatcgcttgaacgcgggaagcagaggttgtggtgagcccagatcttgccactgcactccagcctgggtgatggagtgagactccatctcaaaaataaataaataagtaaaaatgaattattattattattatggaagggctccaaaaatcacgacaaatacaattgatggaaatcatgccggagtggtcatactccaatatgcaggatatgaaggataattttatgtgtcaacttgtctaggctctggcacccaattgtttggtgaaacatcagtctagatgttgccataaaggtatttttgggttataattaatgtttaaatcagtagactttgagtaagcctattaccctctataatgtgcatgggtctcatgcagtcagttgaaggccttagagaaaagataaggtctcctaaggaagaagggattctgcctccagactgccttcagactcaagactgcaacatcacccttcactgttctcccatccgctggcctgccctgcagattttggacttgccagccccaacaatcgcatgagatggttccttaagatccctattaactaccagcaattgcatgagcctgccccttaaaatccctgttgtctatctactcatccattcatctatctacacatcctgttggttttgtttctctgaaaaaccctaatacactgggcaagggccagatgtgcagacaaaaattctccccacaacagcacaagtgagtgtatgcaggactaacctctttacctcactcccacctttccctctagtcttctgcaactctaattcctctttatcaattcagacctaggatcatataacacttattcacattttttgtcagagggattatactatagccgttgattttcagccagtgtttgaggtcattaacgttataagtatcttgttttcaagttgaagaaggaaggattctctaacaaagaatgttccatgaacaggtgaagggatgtgtttatcataaagcatcctgaagtatatctgtggtaagcctccagggtgagggcagagccaggctttgtgaggccgaatgcttacacaatttaaaggaccctctttaggaaaaaagaatacacaaaaatagtacatttgcaaattctcagtgatatgcggatcatgcgaacaccttgctaaagcctctcccagggccttggacaggatgagtaaggtgaagggccttgaagcttaaacttaattagttccggtatatctggctctgcttcagggctttttggggtggggagagaaagacaggtgctggcctctccctgggttggttcttcctcctctggggaggaaagttggggctggcctggttccagctgcttgagagacacatttgttttcctctaagatccagagtcttccctcccatccaagccctgccagtgtgagtggccagatttttggctccttctttatccctttcccttctccccttctctaatatcaaccccttgtcccagagtctccacggcctgttttctgtgctcttgtgtactgcttctttagagtgcacccaattgtcttgtcccttcttttcttttctttcttcctccctccctccctcccccccttctttccttcctctctctctctctctcatttatttatttatttatttatttatttatttatttatttatttttgagtcagggtctcactctttcacccaggctggagtgtactggcatgattacgactcactgcagcctctacctcccaagctcaagtgatcctcccacctcagcctcctgagtagctgggaccacaggtctgtgccaccacacctggctatttttttttttgtatgtttttagagacagggttttgccatattgtccaggctggtctcaaactcctgacctcaagagatctgcccacctctgcctcccaaagtgctgggattataggtgtgagccactgcgcctggtctacaccgattctttagagtgcatccaatgatattttcaaataacagtgtgcagtctgtcttgtctgccatcctgcaaacctctctgtgcttcttgaagcttctcatggtctgaggagagcattccaggctgcacacggggtgttgtaattgcagcagcttcatcatggggacttttctctatggttctttctccacatctatggccagcatctcttttctttttgcctcttcagatttctaaatgctgggtgtgtccatctcacttaagctgactcatactattagaagcaatggcttcctaactgtacccagagatatgtaattttatataatttgctttcatatatttcaccaaatatgtgaatttattagcatcccattctgagagaagaccaaagatctgaaaatattcctgcacattccaggggactgacaccctcagattctctctcagctctgagttcctgtgtcttcagaagcactgagatcacttgcaccccatttcatggcaattctttccccctcctccgtgttcttttcctgtcaattgagatatgggctctttctctggcttccctcagaatcactcacatgagacgtgtacacatgtaatagactttactgaatgagttggaacaatggagttgttttgtatcacagaaaaacacaaacaatttaaaatcatatttaaatcaccttcatttctgacaagcagctttggaattcctccgtggcctcctttctccctcttcttgatcccctgctaaattgattggaaccacacccccctgcaactgcccaagcttctcattccttcctctctcataaggcagaagtggcctcatttagtttaggtttaaaacacaaaaaatggccgggtgcggtggctcatgcctgtaatcccagcactttggcaggctgaggtgggaggatcgcctgaggtcaggagtttgagaccagcctggccaacgtgttgaaaccccgtctctactaaaaatgcaaaaattagctgggcatggtggtgggtgcctgtagtcccagctactcaggaggctgaggcaggagaattgcttgaacctaggagacggaggttgcagtgagccgagaccaagtcactgcactccagcctgggtgacagagtgagactccatctcgaaaacaaacaaaaaacaaacatgaaaattcctcatactgccatactgagagtgaataaaaaacagagaaattgagaaaacagaagacttcaccattatggaaaaacggaccccctgtctttcacacattgagagacttcatttgcaggcatacccgtgcataccgtagtcctgccccatctaagaaatatggtgtctacgggcgctctttcctctctgtctacttcctcaattcatttcctcctcttggatcctgaaaactgccagaaaaaagcagcactcctgttctcatttcatgtatgtgcttggccagaataatgagagagaaaagagacagacctggagagaagagaatgatggatgagaagttaccccaggggctggcaggtttatttgggaacgagaaagatggctcccgagatagaagctagcctgtgaattctaaggcatttccatgctatgcgtgctgtgggcacccttgaaactctcattacaaaaggcatagaacaaagacagtttctgtacctagacgcctccatccagcagcacagcctctgccctgagcttctcaagctcttcaccactggaattggtgaggcacggctagtacctggcccctggtaacgctgtccaggaggagcagtgacggtgccagaggctgcagaggccatagacagcagccagcacggcagcccccaagcccaggtgccaggagaagaagcgagtgaggaaggcaaggtccatggggttctccacctgcagggctgtccggagggaggcgcaaacatcagcacacacagctgcagcatccagttgctgagccccagccccacccaggtcttgagcacccagagctggggctggtcagggacccagaccttgatggtgagcaccagggagaccaggaaggggggcacgctgaagagctcacgcacacggatctccagggtgcccttgttctcaatgtgggctgccatcagtagtgccagcacataggagcccaaggccttgactgcttgctctagcttcatattctaccattcctgacacgactggcttacaatgtccaccacgccagtgagcataaagaactcgtacatggtgatgtgctgccagctgtccttgaacacgaatggccaccgcggatcctcccagtctaccaccatcagccgatttactccagacgggtagaataacttgggtaagatgccagccagggtgatgaccaccttcaccacaccttctagtggcaccagctaccaccacctgtgtcctcacttctccctggagggcagagggagtttgaggagcctctgttcctgtagcagggccagagacaccagcaccatatagtagagtgagtagagaaggaagaacattgctggcagcaggtgtccctcgagggtgcccatggctttagtgtgtgtgttggggccaacggggcgagagctggtagatgagcagcaacctcacacacacatgaccggcatcctcacaggcaggagtggctgcctctgaaccacggagagatcatgctgacgagccccacccctgcctcccacacacagaaaggaataggtcttgttgcagaaacctgagccacaccccagggtgggacgcctttaagagggtcctccagggtgggaccgctgcagccaccttgctctgctccttacttaaatcggctaggcccagcatttcaatctgtgcacctcactgcagatgtcagtttcacagatgctgattcagcgtttctttcaccagcccctctgccacagcgccctacccctgcagagaggaaacaaagagagtgaaggagctccagcaaagaggagtagggctgactctcaggctgacttttctctcagtgcttggcacagtacatacttttctctcatttaacaactctatgagggaggtgttattaggtgaaattttacaagtgaaatgaaggtccagagcggtgcagagacatgcacaaagtggtccatctgccagctggcacagcagagccaggacgtggacccgggtctgctcatccaacaaagcctgaagtttatgcacagcaaaactactgacattcacttccaaccccgtaatcatgactgtggggaatttacttggtcttcttgagtctcagcttcctgatgtgtagaatgggaataataattacttcatagatttgttatgagaattaaatgggattatatataaagtgtctgatacatagtgaataatgatggtgattatgaataatttagctttttttttttttttttgagatggagtctggctctgtcacccaggctggagtgcagtggcacgatcttggctcactgcaagctccgcttcttgggttcacaccattctcctgcctcagcctcctgagtagctgggactacagacgcccgccaccgtgcccagctaatttttgtatttttagtagagacggggtttcaccgtgttagccaggatggtctcgacctcctgacctcttgatccccccacctcggcctcccaaagtgttgggattacaggcgtgagccactgcgcccggccctcctattgttattactagcagtccttgctaaatttctatgatcctgaagtttttaaagtatttctttgaatgataccaaagcaagagtcataaagaaaaacagtaacatatttaattatattaaaaattgtaagttatttattaataaaaattaaacatgtactgattaaaattacagtttaaaattttcaaaagaaaaacaaaataaaattgtgccccatatgtaagaaagtgttagtctccttacaacatagaaagcacttacaaagaaaaaagttaaaaatatggccaggtgccgtggctcacacctgtaacaccagcactttgggaggccaaggagggcagaccgctaggtcaggtattcgagactagcatggccaacatggtcaaatcttgtctctactaaaaatacaaaaattagccaggcatggtggtgcgtgcctattatctcagctacttgggaggctgaggcaggagaattgcttgaacccaggaggcagaagttgcagtgagctgagatcatgccactgcactacagcctaggtgacagagcaagactccatttaaaaaataataaaaaataaaaaataaataaacacctcaggagaaaaatggacaaaggacagaaagtggctattcgtgccaagggaactatagatgcctcataaacatgaaaggcaaaaaaattgggggctgtagcattcttggttgacaggctttcctttttcttttagcactttgaatatatcagccccctgccttccggtctccaaactttctgatgagaaatctgctagtaatcttattgaggatcccttgtatatgacaagtggcttccctcttgctgctttcaagagtcgctctttgtctttgtcttttgatggtttaatgatgatgtaccttaatgtagatctctaagttcatcctacttgttgaacttcttagatatttatgttcatgtctttcatcaaatttggaatgttttcagctatttccttaaatactctctctgcccttctctctctcttctccactggctgcggcaaggacttttcattaacacagagacatagaattgctgctacagaggaggtagagaggtgtggctgaaatccagaggaggtagataggtgtggctgaaatccagaggagacagaggggtgtggctgaaatccagaggaggtagagaggcgtggatgaaatccagaggaggtagagaggtgtggctgaaatccagaggagacagaggggtgtggctgaaatccagaggaggtagagaggcgtggatgaaatccagaggaggtagataggtgtggccaaaatccagaggagacagaggggtgtggctgaaatccagaggaggtagagaggcgtggatgaaatccagaggaggtagagaggtgtggctgaaatccagaggaggtagagaggcgtgactgaaatccagaggaggtagagaggcgtggatgaaatccagaggaggtagagaggtgtggctgaaatccagaggacgtagagaggtgtggctgaaatccagaggaggtagagaggtgtggccaaaatccagaggaggtagagaggtgtggctgaaatccagaggaggtagagaggtgtggccgaaatccagaggaggcagaggggtgtggccgaaatccaggtgcttcaccaggttgttttcttaggcttgggtccagtggtagttaaagaaagacacttccataatcctaagtaggcatgatcactaaaggatatttgatttatttatttattcaataataaaacttccaaattccagacatttttctaggccccgaggatacaataatgaaaaagacagggaagaaacaaataaatgcacaattaaaaaagaaaaaatgatagagaatgataaataataatggcaaactccctcctccctgccaaaaaatacttaaattaaggctattgaaatagcgagtagctctttcagattgaaccatcagagacgatgtctaagaaagtaacatttaatccaagattaaattagcattagaggccagccataccatatccgactgcatgtgtgagtcactccatcacataaaaaacaaaggaggagctcaataaaagccaagaccctgataacctctgttgatggaatatgttatttttaatattttcagtgttttggtctgttttgtgctgctataacagaatgcctgagactgggtaatttataaagaacagaaatttatttcttagagttcttcgggctgggaagtccaagatcaaggcactaccatgtgatgcaggcagaaggtggaaggacaaaagggaagaaacctcatgtccccacatggtggaaaagcagaagtgcaagagagaaccaggtttttctgtcaagcacctttataaggattcttaatcccattcatgaggagtatcacggactagtcacctcttaaaggccccatctcttaatactatcacactggcaaaagctgaattttggaggggacacattcaaatcataacattcagtaattgtcttcctagccagaatctgattttgttttttgccatgatgaaccatagtggggcactccaggtaataaggcaatggggtaatgtatctttccttatccatctttttctgcattttgcaatgaataagtattacctttgtaattagggactatgtgaaaacttgaaatcaatgacacaattatttaatgcatggagaagtaagtaggatatgaagacaccaaaatgtggcaatttctgtctacgcttttttgtatttttcaaatgttctgaaactttattaattttatttttatggtaaaattattaatatgaaactctttataagagctcttctcagtcatcaaagtatttcttttctttttacttttttttttttttttttttgagacaggatcttactttgtcacccaggctggaatgcagtggcccaatcatggcttactgcagcctcgacctcctgcactcaagcgatcctcccacctcagcgtctggagtagctgggaccacaggcgtgtgccatcacaccttacaaatttttgtgtattttgtacagatggggcttcaccatgttgctcaggctggtctcaaactcctgggctaaaacaatctgtctgcctcagccttccaaagtgctgagattacaggcatgagccacagtgcctggccaaagtatttctttatacatgtgtctttatgtgtatgattatttatatacctatatatataatactgacaactgttaaagataccaaaaagcacaaagacgagtaaaaagagtgaatataacacaacaaatgccaactcagagagaacaagtgttaacattttgtcctgcttgtttccagggttttaaaaaactaagtaaataaaacattcaaattcttctgatcccattcccatacctcccttcctccactgggagaaccaatatcatgatttggtgtggatctttcttatcattttgtcactttgtatacatttgcctgtctctttatctgtttatctacctacctatctatctgcctatcatctatctatctgatcattctctgtatatttctaattctgcagaaagaaggaacagaaggagctcttgcttgagtaaggcactggtcatgcctcaattagaacccatgtaagtgaagttcctttgtaatgaagtcagtgcagttaaatgaaaaaaagttggggggggggcgaaattcaagaatcatgcaaaaatacagttgatgggaaccatatgtccgagtggccgcattccaatgaacaaggcaaatccacagatgtgctggtcgtaaattcctcccaaatcctattgtgtccacaaggtaactaaaggtaaataggactaacctttatcactgctccctaaaaagcggccatgggtcccagtgtgtctgtctctccccatctcccaaatcagcagtcacttaccatctgctactctgagccctcccagtttccagaaggagacagtgtctcataataatcacttacccctcttgactggtagattaatctttagcacatgagtttcagtcgctgtgatacccgaatacgtcattttaagcctctcatctccagttgaagaaggagaacccttagctttacccacagctaaaggaatctggggaatcagccagcaggtgctgaggtgtgtttgtcatgggggaggggttcttgagtgcaaatctgatttagatcttctgacccatgggtgcccattagaatcaccggtgagcttttaaaaataacagcaattacttgggctttccccccagaaattctgatttaattagcttggggttgggcttgggcattcatgcttttaaaacttcccctgcagacactaaaggaaaaatactgtatgattccatttatatagggtacccagagtagtcaaattcatagaggaagaaaatagattggtggttgccagggggctgagtagaagggagtgaattgtggcctaatgtacagagtttcagtctgggaagatggaagagttctgaagacggacgatgatgatgattgcacagcaatggtgatgtatttaatgccaatgaactgtatacctaatagtggtaaaagtggtcagttttatgtcacatatatttcaccacactaaacaaagtgaagtatgtaagctcctgtggtgattctactgtgaaatcctgtccagagctgccttatactacctgtgatgactgttgaaagggagggtcctcttgatgagttgggtcctccttcttcccaccctgctgccccgggaggctcagctgagtgcccttctggtttcagcttttgctgctattggagggcaaaggagttcacttttcttttaagatttggcctgtcagctgcccaagactggttctggaaaccctctcgatgccccctgtaagcgtctctgcatccagtagcaacttttcacaatagagagtagaatggcaatctcataccagaaggggttttatttattctctggtctcttctgatatctatggctggagcctcctccccttcctctctttttccagacttacgcatgcttcgtttgattcaatcacataatctgactcatgaaggtataaatcatgcaagaataaccagccagttaatgtcaaatagggacgaccatatgtccatggggatgactagttctttgtatcttttccagtgaaatgtgcttatctagtttataattccattgttagtggaaagtatatgaatttgactcagcccctgtcctaccttctgaggggaagtccaatgctctgcccaatgttccccctcccgtctggcttggagtgtctgaatctgctcaagcggtgccttacttgcaaacacattctgcagaagctccctttgctccgtttctgcactgacccagatgggagactcggctcctttccacggattgtcacctctaatatctggaaaacaaaacaaaacaaagcaaaacaaaaacacatgcaaaagacatttgttcgctcagcaggctttattatgtgtatgaggatgatgatatcatcccaaagcaaagttctcaatattgggtattcaatatttctgttcttaaaagtccttcagtaatatcagatgattctattcctataaagtccccaactggtgaaaggaagctaaggtattagaagtcaggtgagtggttagcatggtgggggagtgactgagtggaagcattagggggcttctggtgttctagtagagttcaatttcttgattagatgctagttacacatgtgattttggaaaagccactgaactcgtgatttgtgctcttctctgtatttatgttatgcttcaataataaagtttatgttaaaaactaaagaaaagataagaagtctccaaccacctcatgtgcaggcaggttactcaactctgcagagagggacagaagggtcttctaccaacccagcatctgcacccctgaagtcagacatggctgtggtcgcttttgggttttgacctgttagcaatgttttcaaaaaggaccaagagaatgcaggcatacaagcactttgtggatggtgggccctgtgcagatttggcctgtcacaaaccctgcttcatacacatcctcatagcaatcacagcagtgaaaactgggaagactcgcccaggtgcccgctccccactggcccgcccttactccctccacctctccacagcaactcatcctttggaccacccaaacctgtcagaagagtgtctccgtctccatttttgactttccagagaggtctgaagccacctccacacagtgaggtggcagacttgtggacaggtcctgaagccataccaggagctgaccagccccagaaaatgaggacatggctgcagggatagaaagccaaactgtgggtcaaggggacttcagcctgtccatctgggggcacgcttaaaggtctatgatggggccaaaaagaaaggtgcaggctaaggacagaaggacagctcagcctgaacagccccatcctgcagcccaccccagccctgagcctctggaactctatcactgcatcctggggcacctgccccccaagcccccaccccaggaagagtatctatgctgtcagaggctgcagacggtgccagcagaaggtggagaggaagcttggggcctttggtgggtgggacgcatcaacacacacagccgcagcagctgcacatagatcaacaggccatccgtgcctcgaacacctacatcaacggccaaggccttggccaccctgcccagctccgtgcaccgctagttgccttggtggatcacagccgctccacgctccacaggaagaatcccaaacccggtgaccggctgccccagcattccaagtaagaccagttcctcaaggtcctccctgttcttcctcaccatctgttttgtccttggaggatgaaagaacttagcaaggatgatattaaggagacaaccgctttctctgtctcttccacaggtacctgctgctgatacctctacccttggttagacacaattccagcagggcaggaccacttgccctgaggagaagagcccagggactcgtcacaggcagggaaccactgcctcttctatcctgcctggagcataacggcggtccaatgagtagacaggtggactcaccactcaggtaagtgcttcccggggcagcaggaggtgcctcaataatggcattttgcccttgtgccttcagtcacacccgtctgctctgcccaggcataaagctgatacatgggaatggtgtgtgccatggcaatgaagatcatcattatgaccatggtgcccgcatgccaggactctgcggcctggaactacaagtccagtctgattcacaggagcatccacattctgacgcctcttagcccccacctgatcacagaggctcttagggtcttgcagagtttcccttcagcacctgcgctgagggagactctggaatctcaccggcccaagaatcagtccttgtggctgctctggcagtgggttgctggtcaggtgcaaaggtattgcccgtgctgacggctgggcactgatcccacactcgccaccctccacagctcccagggaagctgcagctggctgggtggagccctcttgacctcaggtggcctggagtgctgccatcgccatgggggacgctcttactaccggctgggctgggtctctgagcctgggtctccactgacagcagcctccacagctgtccctgcatggtttcagatctctgccagtctctgtagggaatgatgcttatgccaagagggagggaagcagctcttttatccctggagggtggtggggggtacacaggaacgttctttgagttctgcaggattctacctttctcctccaccctccacccagacgatcatcttcccaaagcacgttcgtgctgctgtggtaggctgggttggggtcgggttgaggatcagcctcccagagtttctgaaaccccaaagtcacttaggccctaagagtggggagacgaatgtggattgtaacaggagatacctttgtccggtaaagtaagtgttctctttggttccatgctgtttcttcttacaatggcttgtatcagggatgcccagggtatcagttgtctctgaactgtgactattaacaaagttcaaattctttgaacagcccccacacagttcagcaggtacagaccttatgggagaggaggggccttgtggacatagttattctgtttggctgttcagcatctgagccttgttcctctatctaaggaattccccatctcataagcaggtaggaggcagagctcagttctgcataataccccaccatgggcaccttgttacattttaccactccattctccccgcaatgggcactcaggtgatcttcaactccctgccaccataaaaaacaagcagtgataacatcttcatatgtgctccctatgggtccgcatgagaacttccctggggtattatgcagagactagacgccttgaattagatgtcacactgcaacgtggttgggtgttaaaaatataaaaaggaggaaacagaataagacctatcatgtggtagctttcaaacaggttttttaaatgtatgcaaataaatcaacagtacacatttgcaagaacacattcaaataaagttgcccattaacatggtaaaatagctacctgtggaggaaggggaatgagaatagggactagagataaaagagaagtcagtcaatacaataatgaaatggctttgtgcaacccaagaataattatacatcgtgggtatagaaactggaataattcaaaccccttccacccaggcgaacaaatgaaacaaacaaaaacaacaggtacatgatatgtacataacatctcgattctataagatggagtgtgagaaatggccacatgagacaaggcagggagagaccctgcctgtgttaggagaatcagagcaggcttaacaaagaggcatcatgtttgagttaatgtaatgatctaagaacaggccttttccaggtggctcacatcggagaggtctactcaaagaggaatttgtccacccacttatagagaccttgggaccaaatccatatctgattaccactgggaagcccagtcatcagagatgccttcatacatgggtggatggtcatggagacaggaagatggcctcgaagctgggcccagtggcatgggctaggtcataggccatagggagtggctggttataaattgctctctgtattataatgcattatttagtccccttataaaactcaactgtgggtgaataaaaggaaggatctaagttcagccaggaaagaagtggtaccaaggggcattagagattccctgccaactgtttccagtaatggtagactaagggataaatcaccattacttctaaagacagctacaaaagttagaggagatatcaaactatcttcttaatagcactgcaggcctcattaatagagccgaacagggaggggtaagagcctaaactggttacttgggatgtgttcacttcctgggagaaggcagctgacatgccaaggtccttgggtgagtgtgaggggtcatattgcattacatagtgtcctggagatgtgcaagtcacttgtaccccactgatatgtttaccctgggctgtctgccaatcctcagaaccatgtgaggtgagcagggtgaacagtacttttggggggctccctagagctggaggaacagttggtgtctactgttagtaaagaaggaaacttagtatgagcccactatgtgctctgagtagtggccccaaagggctgcatctggaaaagggggtgggtactggccctgtggacatacagaacagcctcaagccttattcccggactgctagttccctcaggtgttggaaaaaaggaaaaaaaaaatcctctttggaagaggatcctagatttcaaattaactctcaaaagagccatttcaaataaattgtccagaaagcacagaggcacaagagctacatgagacaaaacaccacaagtcagaatcaacagaaactgtggaccatagaaatagacccaccggatcccagatattagaataactcgatacaacctgtaatgaaaccgtgcttactgtgttcatggagataaaaattgaatttaaaattttatgtaaggatataaaaattttgaaagcaacggtgaagattttaaaaagaaccatttgatattatagaactgaaaagtatgataactcaataaagaactctatagaagagttaagagctaataattggtggaaaggaagataagtcagaagaaactatccagaatgaagtccagagaggcataaagatggaaaatacagataagaagataaataaaatagaagacacagggagataatccaatatacgtttaattggagttctagaagagaggagagagagaatggagcagaggcaatatttgaagagataatggctgagaattttccaaaattgatgaaataacacaatccactgattcaggaaaccaaaggagagattcctacaagaactaggaagcttcaggaaccaggcatttgttaaagcataaatgtctcctgtggaagttcccttttcatgacaagggaagaaagcacttgagggagccggtgggtttctttgcagaagagtttttggttttgttgtttgcttgtttttgaagataggagagatttgattatgttgaaaagctgagagaataaaccaattgagagggagaggctgaagccacaggagagaggaggagtaattcatgaagcatgaagaagtttttagagggcacagggaccgaaactatgaaaataataacagctatcctttactgagcattacatgtcagagctctctcaggaaattggtcacacattgatactaattcttataatcgttaacgatgagtatttctattcaaatatccttatgttaattgatgttctaaagagagagagagaaaaaatcttggtcatatagctagtaagtggtggcagtgggatcaaaatctggtctgacttactccaaagcctgtgccctttccactctaccagctgcttccagagctccagctggcctcctctttgtctgagataggatgcaaggaagagaggatgagtgtggaagtgaagatgtttggagatattgtagaatacaggaagttgaagtaattcaggctggaggctaggtcattcccaggaaaatgtaagggattctacctgcagagttcgaaggatgtgggaattcaacagaggagctaccaaggaagggccgaccaggggagagggagaggaaagtagccaaggtgaggcgagccaagtgcccaaaccatcaatggcagcatgtagcggtgctccagaggcagagagaggagatcaagaaacgtggggcggagaggagaggggaagagtttgagaagaaacagaatacgtcacagtctcaaagcatctccccccaaatatttattaattacaaagggaaaactagtcattttacagtggggaaaccagcagacatcactataacaaagtgatctcaaaatattgtttattaaaagagacaatgagacgaagctcctggcaaggaataagtgactaaaccatggctgttctgtggtctttgcagtaataacaatatcctaaatgacctgcggccaaaagatctccccacctcatcccacctcagtgccaggttcatctgtgctaatgtatcaccgagtcctaaaggatgactgagtcgtccttgggtaacacgtggttaacgcgtgtgcatttgacaggggtcttctgtaataatggggtgattctcacgcgtgggcgggattcaggcacggcagcagcattgggagaagtgctttggggctggggtgagaggagtttgggatctccacgggtactaggtgcccccgctgtcctctatggttgggctcttgcgtgcggcggcagatcccgggcggcgcttcggcagatcctggatggcgcttcggcagatcctggatggcgcttcggcagatcccggacggcgcttcggcagatcctggacggcgcttcggcggggctggcctcccgcacacactcgggtctccagagtcgggtgtgcgcgttggggacgcttcgtcctgcagttgaacgccctgaagcgggagaatcagcggcctccccgaccctgactgcgctgtagggtctatgagctcctctgcagcgcccgacctccttcgccagcagccccagccccctgcgcagaaccagtctacgcggacgccggagtccccctgggctgctggagagcccgaaagctcccggggccgtgtcttctgggaaacgcgccaatgccctctagtgggcgagctttgaacttccctgaggccctacactgacctgagcaggggaattaaatctccggagcgtcacccgtgtcttgccgagagcggggcgcagtgcagccctggaagggcggagagagtgaggatggtgcacacccgaaccagctgggtcgagtcagccccctcccaggagggcggcgtggtctcctcctgcctcatcgtccccctccccgtccttcactcctcccagctagaattggcaccatccactcttcactctccttgagcgaaaagaagggagacttgaacacatctatgcgccaggcagcttcacttcttcatctggaagctatttctaaaaaggatttgaagtgatcacaaaggcttacaagggaactaaagaaagatggggaaacaaagacgcacgggctagcactgaaaatgtcttaagaccctgaacggtcactagacccggagtagagataggacgttaaacttccaaacccttagagcgttaagaaagacgagaccgggaaaactccaacagtccttcaggaatcaggaacaaaagaccaaggcaaggggaagcaaaagaggaaggggcagggaagccatggtaactaaaaatagaaaggaaggacaaaaggagaaaccacagaacagagcaaaattactgcagacggattaaactcccctattaaaaaaaaaaaagtaaaaagcctaaaacggcctatctacctagcttctaagatacatagctgtaacaaagtgacatttagagtttcaaaataaagaggtcagtgaggatataccaggaaagggctaacatctgtacatccctccagttgggggcctaactctaaaatacagctcacttccacccgtgtgtcttcttcgccccggtgccacttcctaaggcacaccacagtgacttcccacctgtcccatagctatagctttctaattggcgtccttagccccccttgccttcctccctacaaagcacatataatattctttcaaaaacataaataagaagctgggcgtggtggctcacgcctgtaatcctagcactttgggaggccaaggtgggtggatcaccggaggtcaagggttcgagactatcctggcgaacacggtgaaaccccatctccaccaaaaaatacaaaaaattaggtaagtgtggtggcaggcacctgtaatcgcagctactcgggaggctgaggcaggagaaccgcttgaacctgggaggtagaggttgcagtaagccaagatcctgccactgcactccagcctcggcgacagagccagactccatctcaaaaaaaaaaaaaaaaaaaaaaaaaaaaagcataaatctggctaaagtccttcaatgtcttcttatggcatttagagtcaagttcaacctttttactctggcctacagcccccacaccaccccactttctctcacaacaccctcttcccttctagctgctgtcccagtggccttcttgctgttcttcaaacccaccctggcacacactgttccctctggctggaatgccgttcttggagctcttcctctccttgcctgggtcctagcttcaggatctcccctggaggaaatcctttcctggccactgtgtctggagtgaggccctttgcctagctactcttcatcactgctctgtttatttcctgcagagtactttttacagtctgtgaatatcttgtttatttatttgcttatttatgtcttctctagtagaatgtttactgcagtcttttgggttcttctccatgtataatcatagtatctgcaggtaaatataactttttctgctgttagaattcgttcttatactttcttttttccccaataatgcaattgagcctttaaaacatgttgaataataatgatcatggtaagcatcccttctttgtactttcctaatttaatggaaatagcttgagggtttcatggttttagtaagaaagatatttgctattgacttctggtaaatatttttcatcatatttaagaaatgtctttctattcctacattacttttacttttccaatttcttcctgggtaactgacctatttaaattttcaatctcttttgatatcagtttatgtttttctaggaattcaacaattcctagatttgttgaaacaaatctctagattttcaagttgggtgccctagggttgtatgtaatattgtcttataattatttttctctctttttgtatctggcattatatcaccctcttaatttctaatattgcttgcatttgatttctttcatttgttcctaatggtcggcaggggatatctatttatcttacaaaaattagatttggcataaaactactgtatgatccagaaattctgctcctatgtatatatgcaagagaattgaaagcaggaacttcaacagatatttgtacactcatgttcatagcagcattattcacagtagtcaaaaggtgaaagcaatctaagagttcatcagcagatgaatagataaacaaaatgtggtataaacagagatagaacattattcagccataaaaagaaatgaaattttgatatatgctgtaacatgagtatgtctttttttttttttgagacagagtcttgctctgtcgccaggctggagtgcagtggcgcaggctggagtgcagtggtgcgatctcggctcactgcaacctccacctcccgggttcaagcgattctcctgcctcagcctcctgagtagctgggactacaggcgcgtgccaccacgcccagctaatttttgaatttttagtagagacggggtttcaccatgttggccaagatggtgtaacatgaatatatcttaaacattatgctatgcgcaattaaccagacacagaagaacaactattgtatcactgtagaaagtaaaatagaggttaccactggtgggcagagggaggaagggtgagttattgttttaatgcatacagagtttttactgggaatcataaaaaagttttgggtatagataatggtgatggttatacaacattgtgaatgtatttaatgccacttaattgtacatctatgaaaggttaaaatgacaaatatgtatattttaccaccataaaaagttagatttcggatttttttaaaaaattctttccatttatttttgacactttcactagttttggcatttacttttgctaattaccatgactgaagtatttgttccatttttaattttctaaaatgagttccatattcctttaatttcagttttctttaacaatgaaggcatttaagactgtgatttttccttcgaatatgagtttagcataccaaaaaataggattcattgctttctagatagtttttattccaattttgatttatgtattgatccagggtttttttattctaagcagttaatagtttagtggtcatctttttattattattctcttatattctaaaatatttatcagaaaataccctgcaaaaatcttcacttttttgaatttttcaagctttgtttgtggccaagtacatgactgatgtctatctatctgtctatccatctatctatctatctatcatatctatccatctatatctatcatctaccaatgtgttatttacataagaaaaaagcatcttctatatttgcatgtttcacagttctatacacatctattaaattgagctggttgattgtaatactcagaccttctatgtcctggctaatttttatcttctagatctgtcagattttgaaagatgtagattagaatcttccaccgcagtttacgtgtgcatgtttttaaataacattctccacgtttctaacagtttttgccttatagatttgactgccatgatgtttagtgtttagagatttacgtttaacatcttcttaaagtgtgccttttatcattacatattatctctgtctcatttaatacttttaaccttcaatttcatgttgtcattttagctttttctttgtatttgcctggtatttctttttttctttcagaaaacatttgctttattcatttgttaaattcttatgggttgtcattcataaggcacatagatgtaggtattgtggacaccagcatatgttgattttacaatattctgggaaacaaataaataaatcaataattacaatatcctgagacgtggatatgacaatttggtaaaaatgctagaccacatagaaagggcatcttaagcaggcagaggggctcaaagaaatctccccagacgagggcaactttgagctgagacaagattaatgtgaaaaaggactttcttcctaagtggttctgttttatgatggaaaactttctttaaaaaaattttgaagattcataaatgactgcagagcatttccttatggaactactatggataatacagatattgtagcatagtatctatattaatctatatcatctatggcagttccacagggaaatgccctgaggtcatttatcagatatcacaatatatgtatgcctggtatttctttaaccatcactttgttttagatgtgcttcctacaaaaattatacattttaatttggtttttcaatccaacctgagagtctttatctttcatatgaatattcagctctttcacacttagtgtaacagccgatatatttgattttattctttccatctttttttatttttactatttgtcttaatttttatctttttcctcttttctaatgtattttcattactattcatttctttctccccctttgttaaattagaagcactcatgggctttcctaatcaaaactagatttatttactgttgtatcaaaacatggcaacaacctgctgccacacccccaggtgctcactgcttgggcgccctcctcccagtgagataaatcctttaaaacacctttgcttcctcactgttcccaaatattctcaactccttgtttttttcaaagacggttcagtgttcctgacttataactaatattaagtttgtcccttatgataaaaccgttcttacttcacactcatattacaaattttcgcactattctcatccatttaaatctaacaatatataatgcaaacatcatttctcagtaactgtctccctttctttctcatatttccttttgttgaagtctctagattcatttcttatttggttattcttggcatctttcttttacttgacaggtaagtggtcttttacctgtgtataagattcataggtccctgtcctttctcttaatatctgtagttattagtctatcatcccttagaccctagggctgtggcaaaacaaaacaaaacaaaaacaaacaaacaaacaaaaacctcctatcaagctagtaatataaggaaacttccttaatacagtaaggttacctacaaaaaaaacttatcacaaacatcataattaatggtacaatgctgaaacttttcacctttaggtcaggaatgaggcaaggatgctcaatttcactatttccacttaacatattattgtatatcgaagccggtgagagaaggcaaaacaaagacataaaaaattatattatttaggccgggcacggtggctcacatctgtaatcccagcactttgggaggctgaggcgggtggatcacgaggtcaggagattgagaccatcctggccaacacggtgaaaccctgtctccactaaaaatataaaaaagtagccaggcatggtggcaggcgcctgtagtcccagctactccacaggctgaggcagaagaatggcgtgaaccctggaggcggagcttgcagtaagctgagattgcaccactgcactccagcctgggggacagagagagactccatctcaaaaaatatatatataaaataaaataaaaattgtattatttaaaagaaggaaataaaactatcattagctgtaggcagtgtgactgtgtatgtaaacattctagaacaatctaaagataatatgtttaatttaatgaatggatttaacaagaatgctggctccaaggttgatataccaaatatagcactgatttgtagctcactattattgccacgtgtaacaacaggaaataatcccacaaacataatacagagagaaaggagcaaaggattaaaacaaatacagcatcatctcattcttttttttttttttttttttgagacggatctcgttctgttgcccaggctggagtgcagtggtgcgatcttagctcactgaagtctctgcctcctgggttcaagctattctcgggcctcagcctcccaagcagctgggactacaagtgtgcaccaccatgcctggctaatttttgtatttttagtagagacggggtttcaccatgttggccaggctggtctctaactcctgacctcaggtgatctgccggcctcggcctcccaaagtgctgggattacagacgtgagccaccacacccagcctcattctatttgaataatatatttttttaaactaagatatattgtttagagatatacatatactgtttattacagaaatcaggcatttcagaaattagaaatccctccctggtggggagggagattattgtctataaggggcacaatggagcaggaggagcagttctaaggtgttgacaatggtttttttttttttttgagacggagtctcgctctgtcgcccaggctggagttcagtggcgcgatctcggctcaccacaacctccacctcctgggttcacgccattctcctgcctcagcctcctgagtagctgagactacaggcgcccgccaccatgcccggctaattttttttgtatttttagtagagacggggtttcaccgtgttagccaggatggtctcgatctcctgacctcgcaatccgcctgccttggcctcccaaaatgctgggattacaggcgtgagccaccgcgcccggcccgacaatattttatttctctacctgggttgtagttacacaactgttcactttatatttatcataagccatatatatgtgtgtatatatatatgcgtatgtataaaatcctagttttctatatagagatatataccatgtttatcaataggaagactcaatatcataaagttgtctacttccccaaattagtctatgaagttactggttttttggtttgtttgtttttgagatagcatctcaccctgtcacccagactagagtgcagtggcgtgagcatggctcactgcagccttaaactcctgggctcaagccaccctcccacctcagcctctggagcagctgggactacaggtgaacgccaccaagccaggctaagtttttttttttttttaatttttgtagagatggggccttgctatgttgcacagactggccttgaactcctggcctcaaatgatccttctgcctcggcctcccaaagtgctgggattataggtgtgagctaccgtgcctggccctgaagttactgggttttttttttctttttcttttttattattattatttttttaccgcttatcctcaagttctatgaagttactgttttaatcaaaattcccaacaaagatttttatagaactggtatgctaactttaaaaaaatgtacatttcacaataaaaatgcatgtaaagtactataataaaagatgaaacaattttaaaaatagaactcttggagtggggaaagcctttctaagtaaaggacaaaactcagaagacaaaaaaggaaaaatagaacatgtgcaaatacattaaagcaaaattctgtatggaaaaaacaaaaaaagtaaaaaaaaatgaaaagttagaaaaaatacggcaactcatatgttatataaatagctaatttcctcaatatatagttagctcttactatcaacataggaataaatacagcccaaaagaaaatcagcatacagcaagaaaagatgtataaatggcttaaagacatacaaaaagatgggttctatttcaaccataattaagaaaatgcatattaaagaaaaaataagttcttcattttaaaatttgataatataaagtgttagcgtgaatgagggcaatgcagataggcaattctcatgcgtttgttggaattgtaaattgttgcaatctttttagagagcgatttggcagtctatcaaaattacacatgcatttattctctgcccattcctatagggatgctcccattgttgtaaagctgtatgtataagaatgatgattgcagtgttgtttgttattgcaaaagactggacacaagttaacagggaactggaaaatgaactgtgtagttatttttaaaatgagctaaactttatgcactaacatgggaagattacaaagggaaaagcaaagtgctgaactgtattttatactttaattggtgtcaaaaaaatggatgggatagatttggagagaatataatcatatgcataattgtaggagactacaatatttctggaaggctacacaagaacctgtaagcagcggaagcctgctggtgggggagccgataacctgaggtgggcaggtgggcagctgagttccatttgtacgctttgtactttttttttaagagatggggatcttgctgtgttacccaggctgaagtgcagtggctattcacaggcgccatcatggtgcactacagcctcaaactcctaggcttaagtgatcctcctgcctcagctttctaacgtgactacactgtgctcatgtcattttccattttttataaatctattgccctatattctcgctctgtctctctgtctccgtttctatttgcctctctattacacacacataaactttgtaaattcttaagtgcataaaaattctcctgctttcttcctttctccaaaggttctaatactttttgtcaaactggagaaaactcactgtagaggccatcttcccatgaccccaatctgcatgttgatacaaatcattaaatacttttaaggattataactgaaaaggtttacaattaaaaccatacgtaaaggtgttgttttccaattatgaaagtaaatcctggagactgctgaaattttatagaaatcaagtatctaggaataaatgtaacaaaagatgttagatatatatgaaaaactttattgaaggattttgaagaagacctaaataaatgagacatattccatggttatcaataggaagactcaatatcatgaagatgtcagtttccctaaattaacctaggaagtcattgtttaaatcaaaatcccaacaaaatgtttatagaactgacaagctaattctaaaatatgtatgaaaatgcagagaactccaaatagttgagatagtcttgaaaaaaaaatgtatgaatacatgctcatccagaaatcaagacttattatcaagttatagtatgtgagagtgcagtattgctagaggacagaacaatgtaacaaaatagagaacccagaaacagaccaccacttactgggaaatttgatttatggcaaagccagcattgcagatgactggaaaaggatgagctgtccaataaatgctttgacaattattatccaaggagaaagatgatctctccaccacacctttacaaagaatcaaatccagatagatgtaagaccaaatataaaacgacaaaatttaaaaacttttagaagaaagtgtagggaaacttatatcttggaagaggaaaaggtactttaaccatgtcaaccaaagtacaaactttaaagaaagaggtaaattagaatatgtgcagatgtaaattttctgtgtcttgaaagacatcacaaatagttataagataagccatggagtgaatgacaatatttgcaactcatccatctgatgaaagattaagatacaaaatttataaagaattcttaaaaaccaacaagaaaatgtcaacaaccaatagaaaaataggaaaaagttatgatcaagactttacagtataaaaaataccaataaacataggaacaaatgcctgacctctaaccccatggtaattagggaaatgcaaatttaaaccatgagaagtaaccacacccattacactggaaaagaactgacgtgatgagaggcagtgttgagggctgggagtgttactacaatgactcatctgctgctggcaagatcgctttggagaacgactgggcagtaatttgtagcactgaagttaggcatcccttgcaatgtctgtggccaatgctaggtgcactccatagaaactcacatgtgcacaagaagacacagaccagaatgttcatcgcggcactgtttgtaataagaacaaaatggaaacattctaaattttcacagcaggagaatggatcaatacatttagtatgatattaacaagtctactatactgcagtgaaaatgattttttatttcttaaaaaacaacaaacatatgtagtgccatgtgccaggctctgctctacgtttttgagaaatattaagtcatatttactgaatgaaccagagccagattcatcaacatgagtcgacatggatgaatccccagagcaccaagttgacttaaaaaagcaagtcaaaggagtgtgcataatactttgtcatatatgtcaagtttgaaatacttatataatgtttaggaatccactcatatgtaataaagatagtgagaagtcacctcagggatgagggtgaggaaggtggtgaagagggtccctaaggggcttcagcagtgaggttgctccattccccatgattattgatgggtaagttcttctctataccttgatatgtatctgaaatagttcataaaaaagttttttcaaaagaaaaaaaaagcacccattcctatttaaaatgtatttcttccagtctttccactatgcttagtttatatacttgtgattatcttgtgtatacaaactcaccttgtgccttttacagaatgagaaaatttccttatactatcgaaaacttttcagaaatgttatcaatgacagaatgatatcacaactgtggatacaccataatgtatttatcagtgcccaactagttgattccaattttagataattttttttctcatttttcagtgcaaagaatgtctgtgtccataaaagctttgggggaatatttgggattatttcttctgatgcatgaccactactagaaccacaatatcaaacagtgtgagcattcaaagactctaactctgtattattacattttgccaaaacagctagaccagttccgcccccctcccccgtccctgactgtgcccggatcactccacttcctctgtagctctgtcagccctaaacagtttccttttaaaaagcccttactattttgatcggtgacaatggaagcttatttgtattgttttgagaacaccccccacaaacgcacgtaaaacctctataaagggagaaccgccttgctgctgagggcgcggtgggacccgtcgcagggccagctgctccggcaggtgcccccaaagggtcccgcaggtgatcctcggggactgagcgcccatcgcccttcctacgcactcagatccgccgagcccagcgcccgccagagcccagagagtcctcggggtcagagtggtcacgtcaccgtcattcttttcctgcccgactagtcgctctgggctccccggggccgggggccgggggccgagccgccgccccgattccggcttcacccgcccgcagcgcgcggcgccccgcgctccattcgcgctacctggcggctggcaggctgccccaccccaccgcgggccacacacagccagggtgggaccccggccgctttctctttcccagggagaggactggaatttgggggggaggtgggaattgaggaagtcgggaagggaggagtagagaggtgggtgagaagggggaggatgcttctagaaggcgggtgagggagctggggaggccaggaaggggaggaaggggtaagaggtgcgggagggcctaacggggagactccgggggcaatcagtgggtattcacagggagctgggcgcgagcatcagcgggatgaaaggcaggtcagggcttgcccgtcaggtccggactgcgccctggaggggctcccagtagagcctgcgcaggagcgcggggagcgcgcagcccaggcctctggccaggtggagcaagaggagggcggaggtggacagcgcatctcgcccgtggaggacgggcaaggacgccgcctgcccagctgttggagtctcctgggcacggactgagggggagggtctgaagagcccagagatcccagagggaccagcttcttgttacagggaaaatcctcaccaccgagagatgcaatgagtgaatcacggtctagccctgtttgggagactctgtggccattaaaaatggcgatgctccccagagtgtgtggggcacaggaatcctctagggggcttacgaaaatgcagattccggttcgggcctgacattctgctcttctcacaagccccctggctcctgctattgatgtagagctagctttagattgtacggtaaagggaaaaccagtaggtgtgggatgagcccattttggttctttgaaaaatgtgtttcttacacaaacacacaaacacatatacatatgcaggaaataagatgcaaaaaacaagaaaacaccaactatgtttttccctaagagatgggattctagtcgatctaaattttctactttttgcttatctctatttcctgaattttcttcagtaaacatacattcctattgtaagaaaaaagattctcgcaaaaccgtagaagttacttatttcaaggagagtgtaggagtcaagggaaagcctcctttgaaggtttactaaaaatcactgacaaaaggcagattaacgggaaaaaatgcatacaaatttatttgatcacagtttatgtgacatgggagcctttagaatgacaacccaaagatacaagagaagctgttttttgtttttgtttttgagacggagtctctctgtcgccaggctggagtgcagtggtgcgatctcggcgcactgcaacctctgcctcccaggttcaagcgattctcctgcctcagcctccttagtagctgggactacaggtgcgcgccaccacgcccagctaatttatttctgtattttttagtagagacggggtttcaccatattggtcaggctggtctcaaactcctgacctttccttctggggatggggcagggcccctctttggaatggggtcctatgaactacaatcaaacaaagtagtccaggcacggtggctcacacctgtaatcccacaccagcactttggaaggctgaggagggtggatcacttgaggtcaggagttcaagaccattctgaccaatatagtgaaaccctgtctctactaaaatacaacattagccgggtgtggtggcacatgcctgtaatttcagctactcaggaggctgaggcaagataattacttgaactcaggaggcagagattacagtgagccgagattgcgccattgcactccagcctgggcaacaagagcgaaactcatgtctcaacaaaacaaaacaaacaaacaagaaaaaaacagtaggttagatcatttctttttgttttatcttttgagacggagtctctctccgttgcccagcctggagtgcagtgttgccatctcagctcattgcaacctccacctcccaggttcaagtgattctcctgcctcagcctcccgagtagctgggattataggcacccaacaccatgcctggctcatttttcatatctttagtagagatggggtttcaccatgttggccaggctggtctcaaactcctgaactcaggtgatccacatgcctcggcctctcaaagtgctgggattacaggcgtgaaccactgggcccggccacatctctggtttctatgatctgtcttggggaagaaagattctagtttctagggctagctgcaggggagaatgaggggccagagacaggaggacaggagaagatcagagaaaaacttttgcatctgaggccttcatttaggctcattttgttttctgatccccaatgagagaaatcaggcagacgtttccagatttccctcaattggaattaattgctcctcctgtgccctatactcctctgcctcccaggttcaagcgattctcctgcctcagcctccggagtagctgggattacaggcgcacgccaccacgcccagctaatttttgtatatttggtagagacagggcttcaccacattggccaggctggtctcgaactcctgacctcaggtgatccgcttgcctcggcctcccaaagtgctgggattatatgcatgagccactgcgccgagcctctagcacctaatttcttaatttagaaacttaactttcttattatcaataaaacactagcttcaaattcagaagcccactcttccagttccacatcactgaaactctgttttctcatgtatgagcttggggtggtggaatctctcttgtacagctcaagctccagtgaggggagagatgggttctctatgagtgaagccaggtgcatggggtgggtgatggtgaggatggtggtggggatgtgatgatggtgatgttgactgtatttgtttaaatgaagggctgataatgtgaataagaaatctagaacctgattcctgggaattaactggttatccctgaaatggtctttttcttctctggacatctctatacaatacaaaacacttttggccgggtgtggtggctcatgcctgtaatcccagcactttgggaggctgaggtgggtagatcgcttgagcccaggagcttgagaccatcctggaaaaaatggcaaaaccctgtctctacaaaaaatacaaaattagccgggcatggtggcacgtgcctatagtcccagctattcaggaggctgaggcaggaggatcgcttgagcctgggaggtgaagactgcagtgagcagtgtgcagtgatcacaccaccacactccagcctgggtgacagagcaagaccctgtctggaaaagaaagaaagaaagaaagaaaacagttttattaagttccccctcggtcttcggaaagttttagtctatcagacaagtggcattttttaactcataatttttcatatttttattaatcaaagtcatttgtaactaccagagcttttagtcaacctgaaatgcaatataaccacactgagcaggtgcaattctatgcaaaagaaaattgacattttagttgacctgtgcagctttgtaagaggtaattctttcattgttgtaaaggcttttaaaatggtgaaaaaggcccatggattccctaagaatctatccttaaagaaactgtgcattgcagaagataaaatgtatttacagagatgtttgctgcattatttattatgacttaaacagtagaaacacactaaatattcatctgtaaataaattagggcttatttgcatatttgcacaatggcatgctttgcagccattaaaagttatgttcggtcttagggtggagaaagatttccaatgcggggcaccaaacccagaagccattagggaaaagctgacagatttgacaccataaatattaaaaagcttgtccttgaaagacatcataaacaaagtaaaaatacaagtgccaaactgagataaaatatgcaagaggaaaaatattaaatccacatatttttattttccctgtaaatcacactctttcagcttctcctccccaaggctgagccatgaagctcattgcccagggaaagaagggcaggtactgcctgggacagaggcacccttgagagactttcttaactttccttaacccatttagcaagaccagaggctcaaatgcaagcctttatggaaaaaagaaaaggaatgattttgattttatcctgaagctcgtcctctaatagatcaaggctcaaccttggtggactttttttttgagacagagtctcactctgtcgcccaggctggagtgcaatggagtgatcccggctcactgcaacttctttttttttttttaattatactttaagttctagggtacatgtgcacaacgtgcaggtttgttacatatgtatacatgtgccatgttggtgtgctgcacccattaattcactgcaacttctgccacccacgttcaagcaattctcctgcctcagcctcccgagtagctgggattacaggcatgcgccaccatgcctggctaatttttattttagtagagatgcggtttcgctatgtgggtcaggctggtctggaactcctgacttcaggtgatctgcccgcctcagcctcccaaagtgctgggattacaggcgtgagccgccgcacctggccaaccttggtagatttaatcatgaaagtccacatgggagatgcgctatcaagaggaagtggaaaaatgcccccccttccctgggagggttgtagggggaggaggaagatggaggggggaggaggaagatggaggggggaggaggaagatggaagggggaagaggaagatggagcagggagaagcagttgtgagagatgtgtcctgacagccccagttctagacacaggcagattgaaagaaacaccgaaagcagaagagaagcctctgactctgtttcaatttgggcttctgggaagagaagcctcaccaggtacctgccctgtatcaatctgtctgcctattaggcagagacaagaccaacaattagctgcccattcattggcatgaaaagtgtcgagaatttcctggatactcttgcaggggaagagcttctgtgaggagaggtgaccctatagttgacggctgggtggtcactcaggctgggagcctaatggaagttccctgagggggatcaagcacagtagtaggaccaaagtggagaagaatcaattgaaaggacccctggactcggaggagctagagtttctcagctatcaacgtaagcaacagatgtcagcgagattcatgccctgtgatggggtcaacatgaaactggctacagaaatcagaggaggtatagggcagcacatgaatctgtgctcaggaactgaggcctgttcttcaccttcaccactagaccagctaagacccacctcccacaccccaaatgccatctcagagaataagcagcaggaggaggatgagctgagatcatgggtcgggtagccgcaacaaaaagatcttgaagatggtggcttaaaaaataggagctggtttctctctcagataaaagtgcaggtgggctgggcgcagtagctcacacttgtaatcccagaactttgggaggccggggcaggcagatcacttgaggtcaggggttcgagaccagcctggccaacatggcaaaaccccctctctactaaaaatacaaaaattagccaggcatggtggcgcatgcctgtaatcccaccagctactctggaggctgaggcacgagaatcgcttgaacccaggagatggaggttgcagtgagccgagatcgcagcactgcactccagcctggatgacagagtgagactgtgtctcaaaaacaaaaaaacaaaaaaacaaaaaacaggccaggtggtgggcaatgcagactaggcatggcagctggatggggtcagggactgaagctctatgtgcttttcgcaacgtgggacttctagctcgtgctctaagatacctgctgtagctcctatcattatgtttggattctagctggtgggaagagggaaaacaataaatcaagacaaactcctcccgattccctttaagagcatgacccggaagtagcacacatcacatatgctcccattccattgtctagaactaggtaactttgctacatccagctggaaaggagcctgggcagccacccaaatgtccgtctgtctcactcacagaacacacttgctcctccccaaggaagacaggtctacagtgatggcatctgtgcaaagtgcagactctctggatcctctcccaaaggtccagatgtgactctctctctgctgacctataaaccaaaagaaaagttacttctcttgcttcttatgacatataaacccagtatgcgctgggggagaaggaacaggataactaataaaaactttcagaaaagggaagaacggaaaacatgcattagtcactggttcatagcgataatgagatcctacaaagactcccttcccttgcatggagtcaccactggcatcgctgtctgggagcaagtcccttgtccactggccccagagaggacgggcttgttttctgggaggttattctctgtcagttgttttttctggccacatctcaagtgggcactggagactatatcctttgaggaagggggagctcataggttccacaacctctttcagcctgtgctgtctggggaccctagagttactttaggagtcaaaaccatcccaggcttttgtagaccatatctgtggtttctttttttctttttctttttcttttttttttttttgagacggagttttgctcttgttgtccaggctgcagtgcaatggtgtggtctccgctcactgcaaactctttctcgcaggttcaagccatcctcctgcctcggcctcccaaatagctgggattacaggcacccgccaccatgccctgctaatttttgtatttttagtagagacagggtttcatcatgttggcaggctggtctcgaactcccgacctcaggggatccacccacctcagcctcccaaagtgctgggattacaggcatgagccaccatgcccagccatatccatggtttctttggcaataaaatttcttccaaaagttagtaggttctgtgttgctaccacgtgcaagtaaccacagttgcagctcttcgttaggcacagcttttgcactggaaaagtctgttctttaatttactgactttgactctgccccttttattctggtaggtggttaaattaccagtggatcttattgatcccgcaggcttggtctgttttggttttgtccttagtcttaggaattggtccttactctagacagaacatggtccttactcctaactatggattggccggaactcccaacactgtgccacctctggcattcccatccagctctgagccctatccagctcttagcagccttcttctagacttcacggtgtcttgctggcatgtgctcagccaagccctcagccaaaggtcattggagaaacccaaagtagactggaagcaccctcacccccatgcagatcctcctttctgttgtattgccctgcaaattccagccaattcggcagcaccaaactccaatttctgcctcttgagctcagcaagaatgtgttgctctgtgtaagcttcatctccccatactgtgactcagaaacgcccccagaaagaaagccagggccaatatagaattcacctcgtacgtttcgtttcctttctctcaagggtcacagtctggtatcgcctgttgcccagtgcctgaaaacagttgtctcaaatattttgtctgattttatagttgtttatggtggtgatggtgggaacctggtatcagttactccctcagagctataattggaagtcttttccccttccttctgtaactagggaatttattcagttcccagctgtccagggtgctggccaatagaatatgagcagtagcaaaggagtgtgtctctgcttccctttgttttctttttctactggtgggaatgttatggctgtgattgctagttttctatgaaaatctcttctgcataattaacagatttaaagcagagatctcaaaaagaaaagagacaaagaggatgggatagaataaaaagcatacaaaggaataatgaccaaattttcccaacatttagtgaaaacatcaacctacagatgcaagaagttcagtgaactcccaggattaaaaaagaaaaaaaagaaagaaaaagaaaaaaaaaactatacttgggctcattacagtcaaactgctgaaaatcaaatataaagaaaaaaccttgactcagcgcagtggctcacagctataatcccagcactttgggaggccaaagcgggcagatcacgaggtcaggagtttgagaccagcctggccaacatgatgaaaccccatctctactgaaaatataaaaattagccagatgtggtggcgggcgcctgtagtcccagctatttgggaggctgaggcaggagaatcacttaaacctgggaggtggaggttgtagtgagccgagatctcaccattgtactccagcctgggtgacagagcaagactccatctcaaaaaataaataaataaaaataaaaataaagaagaagagaaagtcttaaaattagccagataaaagacacgttatatataagggatgacatgaatgaaggctgacttctcttgaagagcaagggagaggctgggagcggtggctcatgcctctaatcccagcactttgggaggccaaggcgggatcacaaggtcaggagatcgagaccatcctggctaacacggtgaaaccccatctctacaaaaaatacaaaaaattagccaggcgtagtggtgggtgcctgtagtcccagctacttgggaggctgaggcaggagaatggcgtgaacccgggaggcggagcttgcagtgagctaagatggcgccactgcactccagcctgggggacagagcgagactccgtctcaaaaaaaaaagaaaaagaaaaagaaaagaaaagcaagggaggccacaagacaataggagaacagcttcacattgctgaccgaaaaaactaacaacccatggttttatattctgtgaaaagatccctcaaacatatgggtaaaagaaagacattttggctaagtgcagtggctcctgcctataactccagcactttgggaggccaaggtgggaagatggcttgaggtcaggagtttgagaccagcctgggcaacataggaagacaaaactgaagggagaaatagacaaatccacaattatagttggaaattttaacatctttctgtcagtaattgataaaataactagacaaaaaaaatcagtaagaatatagatctgaatgatactagcaacaggacctaactgacatatataggacaatatgcccaacaactgcactttcttctcaagtgcatacagattattcccaggataggccatatgctggaggataatatgtctcaatatatttcagaagactgaaatttcacagtgtatgttttctgactacaatacaattaaattagaaatcaggccgggagcgatggctcatgcctgtaatcccagcactttgggaggccgaggtggatcacctgaggtcagaccagcctggccaacatgatgaaaccccgtctctactaaaaatacaaaaattagccaggtgtagtggtgcatgcctgtaatcccagctacttgggaggctgaggcaggagaatcgcttgaacccaggaggtagagtttgctgtgagctgaggtcacaccactgcactccagcctaggcgacagagtgagactctgtctcaaaaaaaaaaaaaaaaaaaaaaaaaaagaatagttgtacatgaatgaatatttgtaataccttcttcacaatagttaaaactagaaataacccaaatgtctatcaataggagaatggacgaattgtggcatatttaagcaatggaatacaatttaacaattaaaatgaataaacgactgataggtgtgacgtgtgaatctcaaagatattatgctgagtgacacaaatgagtacacaatgtattatcccattcatatgatgttcaagaaggggcgaaactaatttgtagtgatagaaattggaatgatggttgcctgtaagcgttgggcataagggaattttctagggtaatgaaaatacattttgacttgtgtgttggttacataggtgtaattcatcaaaaccttttgtgtcatacactaagatctttgcgtttcactcacagtacataagtattcctcaatgaaaagaagggaagaacaaatattgaggggctaactcagtttctggtctatcattaaatatcctttattttttcacttaatattaaaaaattcctttgtgcagtactcaatgtttgctgctgtaattgataaatccctaaatcccactgccttagcacaaaaatgtttctcattcacatgaggcccctaatgggtgctcatgatccatagggagttctccaagtgttgacttaactcacgcctgtaatctcagcaatttgggaggccgaggggatggatcacctgaggctaggagttcgagactagcctggtcaacatggggagaccctgtctttactaaaaatacaaaaattagctaagcgtggtggcaggcacctgtaatcccagctacttgggaggctgagatgggagaatcgcttgaatctgggaggaggaggttgcagtgagccaagatcgcaccattgcactccagcctgggtgacaagagtgaaactccatctcaaaaaagaaaaaaaaaaaagaatctatcatggcctccaccatctccataacatggcttccaaattcattgcctttgtctacattaagcaagaagggaggttgaagcttagagcttgtgcatagaatgttttcatgggccaggcctgatgggctcacatcacttccactctcatcctgtggcgttgagtttagtcaagtggttacacctcactgaaagagaggctgggaaccgtagtctagctaggagctctagaagaagagaacatgatttgatattgttagcagtctctgccacactgttattaaaatatcacgaaagctaacttgtattaaacactactcactagcaactgttctaaaaactttacatgtcgtcttcaacaactctttgaggtacatactagtttaatctctgttttacaagcgaggaaactgaggcatagagaaatcaaggagttgtccaaggcacagtgctggtaagatgaagcctgggtttgaactcaggcagcctaactccagagcaggtgtttgtaaccactactccatgctgcagccatgtaaggattgcataatcttccaaatttttggatgagccaaattttatttaacctttttcatatcgctagagatgtagattacatcttgactggggctctgcaaataatgcattgctaacatctttgtttgtttgtttgtttgtttgagacagagtcttactctctctccaggctgaagtacagtggcacgatctcggctcacttgcaacctctgcctcctgggttcaagcaattatcctgcctcacagcctcctaagtagctgggattgcagggatgcaccaccatgcccagctaatttttgtatttttagtagagacggggtttcaccgtgttggccaggctggtctcaaactcctgacctcgaatgatctgcctgccttcgcctcccaaagtgctgggattatgggtgtgagccaccgcacccaggccatagctaacatcttaaagtttttttctccctatgttatgaattgattccttaggattaattttttagttcttaaagttcacaaaattaggctgaaaaagtctatttcctctccgaattatgtactgcatggaaatgatctcgttattgacaagacattcatcattagatattaaatattttggttcatctatctcagcttgcaaatgattctgtataaaatattaatctctttttgttgatgtttgaaccctcatgatatttgagtagatagacatgagtttctcatcctaggcaagagagaaacagaatttttcactggaaaaggatctcacagcttatctggtccaattccttagccactggagaaagatagttctaaaaacagctgaacgaaaatagaaattttataaattgaatcacatttatttttacttatgcagcacacttgctctcaaagagagcctacgacaaatgcttcagtaagtgaaaatttagcttgtgaacaattagcagccattaaagctgagatgcagaaaaggatgaaaactgcaagctgacaaattgggcctcagcttctgaagtgatttggctgtttccaaatcatagttaacatttactgagtgcttaactgcgcatcagacaccgtgctcagcactttacagacttcctgtcattgaatccttgcagcccatctagggggtgcatactgctaatatctctattgtacaaaggaggaaacgagcttagggaggttaaataaggatgacttttaaaagcagaaaacaccccgacgaaatagttcatgcaatccattaacatcatttgtatcttagattctttgacaaggttggagatggcgtggggattccactcaggtaaataattcccaaattctaaaattaatagtttctcaggttaaaaaaaaggataatatagaaggctaacaagtatggtgaaaacctagattttcttgaaagctgaggttggaaaggacatttgattgattgattgattgattgattgatgagccttcgagaagaggcccccaggaagtctattgtagagtttcattctctgtcacttgcttgttctctatttcaaagccctcccaccaagtgtcgggatccctccctccttccttttctttctcccctcttcccacatgctctcccagagcctcttcccaggcccagccttccctacctacctcagtccttccctgccattcaagccacaaacctgtggaaccttcttgaactcagaaaggagaggctgacttccaaagggttccaactatttaaatgagcagttcctccccagacgccaacccttatcccaggagcacagcactcgtgccttgcgtggaggagaagtgtgccccatgggcggttgattggcctgatgactgtccttcagctcaggcaccactggaggctgagctctcactgggaggcagtcacaggtgcaggcaggctccggggataaggagctgtggtgtctttccagtgctcctgtgtgtacttggtggagctgagaacagccagacactggatgagagcttggctttaggataacgccctacatttggggccccatgttctctggtgtccccacctggattgtggcagcctactctggggcaggggaggagattccaggaaaaacagggccagagtgtgccgtgaggtggaggtgctgtggaagggggccttggttccagccacacgagcctccctccacttgtcactgaggagtcattggcaccttagctcttggcgcagggaggttggcagcaggcatcacaggctgcctccctcagggagctcacagtctccatagaaagacgtgcaggtgcacgctggctcacacacacacacagcacatgcacacacgcagcacataacgagaactaacaactggcaaactcaagagctgtggtggctccagcagtgccgctgctgcttgtgggtgggagatgtgggggcatgcataggctgattttgcaggtggctttggagcagtggttcaggcaaaggcgttacaggacctagagctgggcccaggtggaatcattgtcttattgggtgactttagccaaactaggagtcttaatgctaccttacaggttttgtgtttttgtttagaattaaaagaggcagggccaggcgaggtggctcacgcctgtaatcccggcactttgggaggccgaggtgggtggatcacctgaggtcgggagttcgaaaccagcctgaccaacatggagaaaccccgtctctactaaaaatacaaaattagctgggtgtggtggcgcatgcctgtaatcccagctactcaggaggctgaggcaggagaatcgctcgaacctgggaggcggagtttgcggtgagccaagattgtgccattgcactccagcctgggcaacaagagcgaatctctgtctcaaaagagaaaaaaaaaaatagtggcaatatcggtgtaagagcctaccatagagaagtgcttcatggcagctgaacctgaacctggcacatcctgggacgcctgtggccgcaggggaaccgcctggcccagcagagctcgctgtttgatatgaacacggatcacacaagacaactggtaacagcagtggcctcctgggaggggaaaggcttaccacgggcaagacagggagggacatttgtttttttaaattttgtacacgatacatctatttcttggttcaaaagtatgtcaaccattttccaccttggcctgcacgcagtggggtgctgtgaacgttcaacaaggggctctggggcagcctggtaccagcaggctccagcgcccccaccggttgcacaggtgtggtaaggccaaagcttaaggactgatgactaaggttgctgttctccctcagtgggagggaaaccaaggtccagagaaagccgaggctctctcttaggaccaaaaatccagcggtggcaaaattgagtctgaatccaagtcatttgacttggaagggcccgggttcaggtccagcctctctgtccagctgtgacctgaaacaagttggctaacgtgtctgagcctgtattttcttgaggatgataatatccacttctcaagattgttttgcagcttcactacaaaaaaaaaaaaaaaacaaaaaaacaaaaaaactacctgagggtgctttgaaaaccttgaaaccctggccaggcgcggtgactcacacctgtaatcccagcactttgggaggccgaggcaggtggatcacctgaggtcaggagttcgagaccagcctggccaacatggtgaaaccctgtctcactaaaactacaaaattagctgggcatggtggcaggcgccggtaatctcagctacttgggaggctgaggcaggagaattgcttgaaccagggaggtagaggttgcagtgagccgagattgcgccattgcactccagcctgggcaaaaagagcaaaactccgtctaaaaggaaagaaagaaaaagaaagaaagaaagaagaaagaaagagaaagagagagagaaagaaagaaagaaagaagaaagagaaagaaagaaagaccttaaaactctaatacaatataatgggtttttaaataaaaaagaaaatagaaatcaccttttcctctagcccctcagttcagcattagtcaagctttttaacctactcttgaacgtatcaagagccttctttacttggcccaccctgggtagaactgggattctccccagttcctgaagtttccatggctctactctgtaacaaggaaaagggaaacatgcgtcctccctccgctggagtttctccacaggtgagtcctttgctgccaaaggttgtacctgttctgccaccgccccctgctggtgactcttacaaggcgccctgtcttcactggcatccgagcaggttggaatttaagggaagtatctagatccacctagatggggcttggtgaggaggaatcaagctgctgggtctcgagtagcctccatctctgcaccgtggccactgtgcccatcatgccggcaatgggctgtccaatggcaaaggaaggctgatggaggttgaccaggtcattttgtctagttggttgttcagtgcctgtccgcagtggatgctctctggcagctgtgaacatgcgctacaaagaccttcacacttgggcccactcccaaatgtccagacacatcctccagcccagacctgctgctcctcatcttccagcctttttccttcaggtcccagcctccaaccactcagctgagccatcagccactacccatgagttgtacatatcttaactttgggacccttctctttccacacaaaggggatgattagctgcaccatctgaaactccgcctatttattggaggattttctccaataattttggagaaatagtttccaaaattattggaaaattattccaaaataattccaaaactattggaaaattccaaaatgatttccaataattttttccaatccacccctgagtgaggctgccatcatttttagtttgcacatacatgtggagctgacccatctgtaccccaagttcaggcttttcctccccgctttggctggttggacaggaacccatagaatcatgggcatgagctggggtgggggccctgcggcttgctgtccactcacttcaatcctggaggacgcacctccatcttacaacgggctgctgctgagcctgcttggccttacagcttgggaggacgacgagacccagctcacaatgggaccgacgagacccagctcacaatgggcagttctggttgcacagtcacttggtcctccgtggcagtttcttattttatttaatttattttttggcatgtagtcctcgctgcagctggcatggccttgctagagatctcagagggctcgctgtgagtctcccacccgagcctgcacaatcgccacaggcgtctttccccgccattgatctttcagcaccataatatctgctgggccagaggtttcaggcgacaggctgcatctgtagatgacacaaggctacctggagtcattagggtagggcagcctgagcaggggctgccacttccttctcaggggaagctcttgtgaatgcaaatggggcatgttaagtcctggaaggagagaaagagagagagagggagagagacagaggtggggggggggggggcggggagagagagagagacagacgagagagacagacagacagggcaaggggagagagagagaggtagaaagagagagaaacagatgggagaaggggggaggggggagagagagagacagagaggggagagagagaagggaaggaaggaaggaaagaaggaaggaaggaagggaaggagggagggagggaaagaaagggagaagagaaagaaaggggaggaagaaagaaaatgaagttgctctttgttagatgctcttgtgtcgtttagggtctttttctgtatacattgccccaactaactgtgagttccttcggggcagagttagaatcccagctcctccacctactagctatgtgatcctgggcaagccacttcacttctctgagccttggtgtcctcctctgtaaaatggggataatttttttttttttttttttttttttggagatggagtctcactctgtcacccaggctggagtgtagtgatgtgatctcagctcactgtaacctccgcctcccaggttcaagcgattctcctgcctcagcctcccaagaaactgcaattacaggcgcgcaccaccacacctggctaatttttgtatttttggtagaaacggggtttcaccacgttggtcaggctggtcttgaactcctgacctcgtgatctgcccaccttggcctcccaaagtgctggtattacaggcatgagccaccatgcccagccccaaatggggataatattttagcccacagcacagtggtctgtgagcattaagagaaggaaagcacccctccccaccagcacagtgtctgcacccaatcagcactccttaaacgctggctagcattctcctcccctgtgaccctctggcaaaagattccccaccccaacctcagcgcccagcaaatctgtgctaatgtgcgagtgggtatcgatgagttcatataacccttgggtagcatgtggttaacatgtgtgcgttttaatagggctattttacagcaactctaatgatgtgtggattgtctgggggccatgggggttgttttctcaagctataaactcaccgatgctctgctccacattctcctcagagtctctaccctacctcctctgtggcccagggtctgcccacagctggcccctcacaggtgcccagggctgcagggtgtgtgtatgtggcttgtgtggtgtgtgtatgtgtgtgtgtgtgtgttgtttgtgtggtgtgagtgtgggtgttgctcatatgtgtgttgtctacttggtgtatgtatgtgttgtgtggttgtacgtatgcgtgtgtcctataattaaagtccccagaagcagggcaccctgcctgggtgccaccttctcacccctctccaggggctctgagcacccccccacccccgcgacgtggcagtgggcagcacctgtgccctgatctttgcatctcagcctctcgcccagggctttgtgctaacgggtgctcaatacggtagtgctttgctaattgggaaaaagcggtcgcgggatgttctttccagggcagtgctgcagtgccctctggtggattttctctgaacttctctaggtttgaggttccgcttgtccttgacaggtaagccggccctgagaatccaaccgcctggccttcttcgcttttggtcagccctccgccttgcagagagtggggctcagtgggagctgaggctgtgtgagggtgaggctggggtcaggctggggaggagactgatgttgggagtccggaggtacagttattcctgtacctctagcaataagaactgtgaggtggaaatgcccatttcagtgatggtggagagaaaccaatggaacctgaatataggcagcgaccccttaggaagcatctcctcctcctcttcctcctccccctcctcctcctcctccccctcctcctcctccccctcctccccctcctcctcctccttctccccctcctactcctccccctcctactcctcctcctccccctcctactcctcctcccctcctcctccttctccccctcctcctcctccccctcctactcctcctcctccccctcctcctccttctcctcctccttctccccctcctgctcctccccctcctactcctcttcctcctactcctcctgttcccccctcctccctctcctcctcctcccccctcctcctcctctccccttcctcctcctcctctgcttctcttcctcctccccctcctcctcctctccccttcctcctcctcctctgctttctcttcttttcaggcagaaatgcctccacagattcccttattatccatgtagaaagggaagaaagacatgaatgcttgtatgtcagatatgttacaagtaacttgtttaaaaggggaaaagaaaataggggaagagataagaaacaagacaataaatctagaaaatcaggaatgagaataaagataacaaccagaaaagcaacaacaacgcagagatagaaatcaaaacaaaagcgatctcagtaatcatgaatagattaaattatccatcctctgcatacgaaaatacgaatattttaaatttagctatttcttgttaataaagatgacacataaggccaagattctcttatactaggcaaatactagcatatgcacatccaatccatcagcaagtcttgctggctctgtacccaaaacacatcccaaatccatcttccctgctagcaccactgcccaagctaccatcatctcttgtttgaatgattccaggagcttcccaacccatcggctgggttctcctgttactcccctgtaatccagattccacacagtaacacagtgggtttcttttcttttctttttccttttttgagacagagtcttgctcttgttgcccaggctgaagtgcaatggtgcaatctcagctcactgcaacccccgcctcctgggttcaagcgattctcctgcctcagcctcccaagtagctgggattacaggtgcccgccaccacacccagataattttttgtatttagtagagacggtgtttcaccatgttggccaagctggtctcgaacacctgacctcaggtgatccacccgcctcagcctctcaaagtgctgggattacaggtaggagccaccgcacctggcccacagtgttcttttgaaatcagaaatcaaatcacgttgccatccctgccccctggtttaatgatacttcatgtggcccccatttcacttgacataaaatccaaagtcctttctgcagcctatgcaaccctatgagtgggatgaaggaatgatgccactccagagggcagaaccagggccaaatgacaggagttgcagagcatgaaccttgacccaagaaaggaggaattttctagtcatcagagctgtccaagctgacttcgcgatgtggaataaggtccccactacagagaggatggagctgcagctgaggggatttctgcacagggttggctggaggctgaagtagatttccctgttgctttcctgtaggagactctgtgcctctaggaataagaactgtgaggtggaaatgctcactttggtgatggtggagagaaacaaatagaatctgaacataggcagtagtcccttaggaagcatcagcttctgcttcttcttgattacttcttccagtggggagctcaatacatggtgggcagcccttcctttcggtcaacacttcatgtattgggcaggccaagtctgtctgcctccccgaaacttcctcatctcagtctcagttcctctctcttgcagagttctaagcactcttccaaaagtgtgccagagattgtgctgcatgttggggacataaagatgaaaaacgtgaactctgctgtcaggaagttcacagactagagggagctggctcattcatagcaggagcgccacgaggacaacggggtattgcaaagggcagagcatgcaggaactggagtgtaggagagctcagccctggctgggcatcagcattacccagggaggtctgaaaactcccacacccacggggtcagagtatccagagattgtgagggcagggcccaggctttggggtttcttttttctttgttttttgttgttgttgttgtttgtttgtttgttttttgttttgagacagagtctcgctctgttccccaggctggagtgcagtggcacaatctcggctcacagcaagctccgtccgcctcctgggttcacgccattctcctgcctcagcctcctgagtagctgagactacaggcgcccgccaccacgcctggctaattttttgtatttttagtagagacgggtttcaccgtgttagccagcatggtctcgatctcctgacctcgtgatctgcctgccttggcctcccaaagtgctgggattacaggcgtgagccaccgcgcccggcggctttggtgtttcttaaagattcccaggtagttaggtgactacagtcatgggcccctggcttagttgggaagtgcttcatctctgagacaccaggattcgaatccccagttttgccgcttaacagcttggtggccatggatctgcctctctagtcctgtgaatgagcaggagaaaaaagaaggagggagtgagagaaagggaaacaaggagaaatagtttgagcagtgcacctggccataaaacaccagggcggggctgggggtgtctttgcaaatggtcacgtcacaccaggcctagctgcaccccagtacaccaggccaccagtacagctgtggcacccgctcagtcgtcttcctttgcggagcacctgctgtcagggtttattgcagaaggagccaagatcacacctttatgtaggcaacaaaataaatccttacaaaacatgaaaggatttttacagccaccctatgaaatgggaactgagtacccccattacagagaaggaaacggttacatagtctatctaaggccatgtgaaatgaaggactggactggaactagaatgcagacctagctcatacaaaagcctggaatgagtcttgcatatccactgcccaagtgaaaaaggaaactattggccgggcactgtggctcatgcctgtaatcccagcactctgggaggccaaggtgggcggatcacctgaggtcaggagttcaagaccagccggccatgatgaaaccctgtctctactaaaaatacaaaaaattagctaggcgtggtggtgcatgcctgtaatcccagctactggggaggctgaggcaagagaatcgcttgaacctgggaggtgaaggttgcagtgagccgagattgcgccattgcactccagcctgggcaacaagaacaaaactccatctcaaaaaaaaaaaaaaagaaaaaaggaaaaggaaattattagagtatagctgtctgtattcccccctgatcctcttcacctctctcccctccaaccactgtcctgaatttgtgttgatcattttcatctatgtctatatacctttgccatacatgcaagattccatacccagtacgttgcatctgatggcatgtttttcagccttgtagagacagcatcatgggaaagaaatcctcctcctgcatcttgtttttgtctcttaaaattgtctgtgacgtttatccatgtgaatacatatatctctaatttgtgtattgttactgcttttcaaaatccatgactctgctgatgaagtttcaggttgtttcccgttttttttttttgagacagagtcttgctctctcccaggctggggtgcagtggtgcaatctcggctcactgcaagctccgcctctggggttcacgccattctcctgcctcagcctcccaagtagctgggactacaggcgcccgccaccgcgtccggctaattttttgtattttcagtagagacggggtttcaccgtgttggccaggatggtctcgatctcctgacctcgtgatccgcccgcctcggcctcccaaagtgctgggattacaggcatgagccaccgcgtccggccttgcttcccgttttttactgttatagataatgctgctacaacgatttttgttctgatatcctgcacatgtgtgagactttcccaagggtgtacacccggggtggttactgggctgagggtatggtgcttttcccgtctgtcatgcaggttaccctcatgccagcgtgtgccagtttctgttgctctgtgccctcactcacacttagtatagccacatttcacatgtacaagcctacattcttttttttttttttttttgagacagagtcttgctctgtctcccaggctggagtgcagtggtacggtctcggctcactgcaacctctgtctcctgggttcaaacaattctcctgcctcagcctccagagtagctgggattacaggtgcccgccaccatgccctgctaatttttgtatttttttttttttagtagagatgggatttcaccatgttggccaggccggtctcaaactcctgatctcaggtgatccgtctgcctcggcctcccaaagtgctgggattacaggcatgagccactgcacccagccacaagcctatattctttatacagtccctaacaaccttttgggagaatagttgcacagagaactacagctagaccatgttcttggctgtgacatcctcggcaaagcctggatggaggtcactgaggcaaagctgagccaatattgattcagaacatcctgttgcaaaacatggagtgaaagacatgaagcaaaagaggcctttggaaaggtttcttggccatctccaccaacaatctgcctcaaggcatcatcctttcgtcttgaccttttgtttaaaggactaagtagggagcccaaactcctagatttgcccaaggtggtcccaattcaggccagttgtcccagtgtaattattaatagcaccacctttgactcttcaaggtgttcaggcttgaaagataatttatatggccacctactgtaggagggtgggaattcacatcaatttcctatccacagatactctgctgtggccaacgtggggaagactgaatgatggagagcctgttatacaaaccacaggggaacacttgccattgtttctgctattgtcccacagttgtttaagatggaagcaggagcccctggaagctttcagagaagaagctagccagaaactcacaagccctttccttgagaagctctggccccatcactgcggagtgctggccatgctccctggtcactgcccatgggacggccagctcccgggcaggtggtgctaagcaggttggcgggtgttacccctcccagtctcctcaagattagaatctgttccaggccaccagacagagctccctgccaacgctctcactagaactgttcctggatgtgcttcgagagctgtggccaagctcttgtgacaacacctcctggaataacaaagggatcctttgtgggcaatcggctccagctaacagcttgcggatggctggactccctctggcattttcttttcaagacagccgcccccccattcccatccattcagctcaagacaatctgagatcgtacacagataattgggccatttgttcaacctgaagaggtaggtcaggtcggccttccaacattgaaacttccggaggaaatgatgggacacaatgggaatctgtgggggtgacagctcagggcatccgcattcgatggttcccttccagtattgtgccacctctgagagaaggccttcagctcagcagtgtgctcatgtgacaagggcttattcttagcaacaggtccacaaaggatttccaactaagcagctttggaaacctaggctcttacttggaagggcaggcccattgaggattgctcttgccaatggagcttcaagactcctctggggccaccaactccatgaagtctttgtggagccaccgcctcccagatgtttgcccagatgagagttgcacacttttgcttttgtgccccatgtgttacccccatgagtgtgtgcatatgtgtatctgcatccatgcacatgtacatatgtctgtcacagcacaatcactcccccaaggacagtgacactaccttactcttctgcattctccttcctgcactgggagctcagtaaaagcttgtgaaataaagaacggagtcagtctttcacctggaggtggttgggcccagaagcagactggatggaggaattcagatgatattgtctcatctctttttgtccctgaattcttctctgtttcttttcttttctgttactgtagatgaatgttctccatgttagggaagatggtcaccagcaatccaactggcaacattgcagctctggaaatgaaggcagctccacggtctcttcccccatcccttgattacccgtgtggccacagggtggggtacagtgactagagagtccactagaatgccatgattggagtgagggtacagcagttccccaaagtggggcaattgaggtggccctgaagaggaaaaaacaacagacatccaggagaaaatcactggagcttgaggggcctctaggaggacacattctgacctggagacctggagggctcccgtgagaggaacaactgaaatctccaacaaccacaggctgaggagcttgggctgggcaggtttacaaagaccactgcctcagaaaggaccgcgagcggttgatctgcaggctctgagcatgaggcagcagcaaatggaccctcactggggacacccagaggccaggtcccgtgcaggaccaggagtcagcagccaacccctgctcatctgctgggggtccgtggtccgctaagcggccccacagagggccctctcccatcaggctggctctgggatgactgggtggtggccctcacagcagtagctaacattctgggaaccagactccctgggcactgccccactgcctcctgccaacagtgctgttatgtggattttaggctttagaatcagaaacaggccctaaattaagcacagaaagagagaaagggtgggagggaaagagaagaggagagactgaggagataaagggaggcagagagagaaagtgttggaaggacacgggacagttgaaggaaaagacgaacagccgctttcgggatagactggggcaggaccaaagcctgctgctctgccgacccaggaccaacccccttcagtccctgtgactgccccggaagtccagttcccaggactaacgcgggccggtacctgcccctgggatcagggatcaggttctgtgattgaccaccccaccatgcggagctgaggaggggccactaactcaaaggaagggtgagaaggagggaagtatattttggacagacaaaaccagcagctctcaggcaccactagctccattttccaggtgaggagacaggcttagggagggggcaggacttgtcaacatcacagtgacagtgagtgacaggacttcagcccaactagcttgactgcagtaccacatcttaatcactgtgtttgctccccacccaatcacgatgggtgcctggtggggacacctcatttgatcacaaatcgtaatttaacaaaataacacagtggttaagagtttggggacctgttagaaggtcactacagtcaaacaggcaagagaggaaaggactagcctgtcccaagacagtagatacgatgacaggaggacatgaatcagtagatgccagagagtgtgagaagaaatctgtcacgattgagaactcacaggactgggaagggaggaaggagtggggtctacattggcctcaggcttctggtttgggcagtgggtggatggaactgtccttcactgaggtgcaaagcccaggaggaggaagcggtggcagtggaggtgggagagagaggagtttcattttggaaatgttggatttgaggtgcctgcaggacacccaagtggaaacgcccagtgttcagtgggtccgtggggtgtggagcatgggagagagccataggtggagctggtattcccccaatggcgtggtatagtatgaggctggcaaaggcctgaggacggagcctgggcatcatggcatttaggggcagggaagccttctcaagtgagaaagcatcagtagctcattctttccttgcatgagtctgattctgtctgcctcttccttccctgtctactcccccaactttgccttacccaggtaagtcattgtttttttttttttttagatgagtttcactattgtcactcaggctggagtacaatggctcaatctcagctcactgtaaccttcgcctgcctagttcaagcgattcttctgcctcagcctcccaagcatctgggattacaggtgcccaccaccaagcccagctaattttttatttttagtagagacggggtttcaccatattggccaggctggtctcgacctcaggtgatccgtccgcctcagcctcccaaagggctgggattacaggcatgagccaccacgcccggccagggtaagtcattcttaacattttagcatccacagccgttcctcggcacagccttgcctggcctcccaagaatgttttcataggctcccacacttttccaggacaggacttcttaccttgcaataacaaaatcatgtccgtgacgatcgcccctgctggactgtaagctccctgaaaacagggaccatgcccaccatgctcactgttgtatccctgtaggaggtgtagaaactccccctctcactctcttcctgtgccccaccttttccagggatgtggattgactgtgagtttccaaggcgtagacagggacagaatcacaatcagtgtatgaaactgacccacatttctgtggtccttcttcagcttccttcatcaggcccactgggttaggaagacagactgggctctcttgcaagctggcatcttctctctcttgtcttcccacagagtgcctgggcacttggcagggatcctcatttgggctgcagtccttggtaagacccaatctgggctgtgaggctgaagcacatggcccaccctgtgccaaaagcagcctgccttggggaatcacacagtcactcaaacttgtaacaaaggggcgctttggtttctcgtttatttttaccctcacagccttgggaagtttacggaaagagggatcactggaggccaagatttggccattcccaggtcctctggtgaaatcccactgaatagatgctttcccttgtttaacccctgctcagtgaatgaaggaaaggaggaaagagatgcacagagcagagcttcgactctagagtcatgatcacttacgagcgtctgtccctggggagatctagtcctagaccattcagatactatatggatctagggctttgctcctatggcgctgcatggcagacgatggggcctgttacagcagttcccaggcttcaccctcatgcatttagaagacttctttgtcaatctgccagtcaggcagtggtgtaaacctctgcaaccaaagcacaggttgggctgggtcagcagctcagacctgtaatcacagcactttgaggggctgaggcggaggatcacttgaggtcaggagttggagaccagcctggccaacatggtgaaaccccctctctactgaaaatacaaaaatgatctgggcctggtgccgggtgcctgtaatcccagctacctgggaggctgaggcacaagaatcgcttgaaactgaggttgcagtgatctgagatcacaccactgcactccagcctgggtgacagagcaagactcagtctcaaaaaataaaaataaaaactaagcgcaggtcggaacggctgctgggtctgttggatattcagcattttcttggcccataagtagcctccagatctaataaaatgtctttaaaagtctctgaaactgcctacgtgctggaattcacatcagccctacaagctggttggcccatcgtattttacaaaagggaacataagctcaaagaaatcctatcattggcaaagcacccagcacgagtaacaataattaacagtaatgaatgatagtaaattgtgctaccattgcctgaagacctactatgtgctaggtactccattcaggcttctacatgtttctctcactcattcttcgcagttgtccagtgaggttggtgccattattttacaaatgaggaaactgagaatgagagagataggtgacttgctggagttcacaaagctaatgggaaatggggtcaaggactcgaacccaaatccctctctaaggccttcttcctttcactgtgctgttctccttccagctggtggcaggaggtgcagcgaagattctgtgtgtagcaggagggacccagacaggcccgacaaaaggcattctgaaggaagaggctgttaggcctggcccaggaggggcagcttcagaaaccagggtaaaggaattgcctcatttgtactgcgcgctgggccaggtcatgtgccagccacttctggctgttctgggaaagaaacccagggggcggccaggtgtggttgttcaagcctgtaatcccagcactttgcggggccgaggcggggggatcacttgaggtcaggagtttgagaccagcctggccaacatagtgaagacccatttctactaaaaatacaaaaattagccaggcgtggtggtgggtgccactgtagtcccagctactcaggaggcagaagcaggagaatcacttgaatccaggaggcagaggttgcagtgagccaagattgcgccactgcactccagcctgggcgacaagagcaaaactccatctcaaaaaagaaaaaaaaaagaaacccagggggaacctggccagacctaggacctgggcagaggggggacaaaaggggagaaggggcccaacattcagatggccattccccactggaagcaggtgcaaaggacccgtgctgcccagagacacagggcagggcctggcaaaggccttagctctgcagaggaaaggagaagccccgaggaggcctcctttgggaaggagatgaaccaggagaccttgaaggtccagttggccctggtggccctgagtgaacctctctccagggatcttctgcatcagtagtgggagagggagggagaagaaagaggtaactgagattttcctaaaaggttttgttttataaagcattgtgactgactgaggcctctgcttgaaatcttaaaacccatcgaggagttcgtgtctctcttgggctgaactggaaactcctaacacagctaataaagccctgtgcgctgtggccgctgctaagcccacctgactgtccctgtctccaacacgtacctcatgatgcagtggttctcgagacttcccttccccttccccccagagtcagaaccaccttgggggctttggaaacgcacccctgcccagggcctactgcagaccagtatctctgcgggtggcgtccttcttcctaaaaacctccccaggtgattccgtgcgtgtttagggctgagacccctgccgctcggccttctccgtcatcctctcctgcccaagtcctcctattctccaggcctcagccaggtctctgtgcggggtctattccagaggaaaccctccctgacccctctcccagagttgtatttggcacaatgggttgggtagcccatctgtgcctgtgttcccatggcaccctgtgattgtccggaaatgcctgacactcacctttctccctgtgactgtgatctccctgaggacaggggccttatctagcggttcacagttgcattcctgcacctgacatatgatgaccgttcaataaatgggctgaaatattaagtatcaagttaaaatctgtcttcctaaaaatttcccttagttcccgatgttcccatcttcctaattaaacatgaaagcccacgtcttttccatttttaaactttccccaaatgtccatggatattggcccttaattagcgctttttgaatccctctggatcctccctgtcctcctgagcagggagctggctttctgttcctgcagacattagtgtttccccaaatagctcctagaaaaggaagcacggcttctccacaagaaaagacagtttgcaaacaagggctctgcgcaggcaggctcaaaggcaactgaagcggttccctctctgggagatgtttaaagcaccttcatttaagatcacagagaagtttagtcaatactcacccatttcctcctccacccttccttaagggaagccagaactgagctcttgtcagagagggtaccgaccgcagaacggcttcaatagagtagaggggatgatacatactggagtggaagaagatgaaggtgagaagctgccaacagggcattaattggctttggaacagctaagagcctcaccctggcccaaaaaccctgaggcaatttccgaaagcaacggtggaggaagaggcctgccccttttctcacctccttggaatgggcagctcggaagtgggaaagagggccaggaatccatagggcatcattctcccgccagctgcctggggcctggaggggggccaggcggctcacctcctggggtttgggaatgtgcccgggtgtaaggagctgcagcccccatctccccattactgagaggaggtgttgagaggtgccccggcagagctgggggacagcgatggctgctgctgaagtgttgggtgtggacaagtggtctctgctgagtttctggctccattgacgtttcttcttagctcagtttccttatctgaaaatgagagtttttttggaccacatatcaaaggtctcttcagcactgccttctggggctggtgagaaaacagggaagcaggagaggaaagcccaggagtggttgtaactcaaagacgggcaccgagcccctgtgtgggggatagggcatgtcctcacagtggtatccaggctctagactgggggcccagatataaaaggggtggcaggtctacccctacatcttgtatgattcatcacatgagggaatcgaggcccaacgagctttaaaagactcacacaaggtcacacaggtagtgagcatggaagctttctctaccacagcgatggcaggtagatttaacttcatgcccaactctgatagattggcaagggctgtcgggagcatcacgtggaggaaagagtctttgatctattagcaatgtctggcacacacttgggaagaggaaatggcagcaagaccaccacatatttactgtaactactaattatttattaaattgttattgagaggctccttcatgtagggcactggtccttatactggagattcagtgataaacaagagcagctcctgctctcaggaagtttccattctagaaggagagacaaacaatatatatgtgaacaaatgactaaataatataatcccagctagtcctaagaagtataaggaaaataaaatagtgcaatgggataggcagtgatggtgtgggagaggagggaggagatcaaggcagccagcaggcaacatttaggctgagacctagatactgagaaggaggcctccttgtgaggatggaggaagagcgtcccagcagagggaacagccaatgcaaagactctccaagagacagagagaccagagttgaggctgtttagagggcaagcaagggggccagtggagagggtgggagcagcgagaaagccagctgcctgctcagtgtgagcatttggatgtctgacaggcctccccaacttagccagtccagcacgacactctcagtcccccctcccaatcacccctgcttcacgcacaacaaaacctgctcctccccaagtctttcccttcccttcccagcaaatgacatctttgcccaccctattgcttggtccactgtgctacaaccctggccacgtcaccatcaactctctcctgcagcctccccctaatcctctacagaagcccccaaagcactcatcaaaccaatcccctcattgcttattgcccaaggctctcttcctcccagttttgtcttttttgcagctgtccctaacccatgaacccacgaacccagggatagatactttatcatctttttaaaaagagaatctgaagttggttatagccatgagagcgctaagcaccaattcaatccacacacattcctctagttgcccccaaacagacagtgtttccagagtggatatgaggactgggtattaatgatcacaggaccatttatcaggctcctgcagtgctcctggctccctggccagagcatcacaatagccctgcagggacggcatgattaccatcccactttcattcatgcggagatttagactcagaaaggttcagcttcttatcagaagtcccagagctggtaaatggctgagccaggatttggacttaggtctctctgacgccaaagcccaagctcttacttctgcatcaagtttcctcctagactcagatgggcaaagaatgatgggctcagaaaaagacacgtcaacctcggtccggatgttccccttttatgccaaaatcaaaggtcagagcctgctccctgggttccttgggacctcagcctcagcctggaaacaggaagggtaggaccttctgcccacctatccccaaagaaatgaggcatcccagctctccttatcttgcctagctttcagtcttcatccttccttctgccccctcccaagtccttcttttgccaggtggtcaccttcttgccctgggctgttatagccagtaccccagtcttctccaggaagcattcccgtgggaaccacagtgccaacatccggtgaggacaggccctccgttacctgctggccctgctgcctctgctatcagacccaagaacaaaggagcttggtgcctgccgcctggctggctgtgtttgtccagggtgaggcctcgcctggcacagatgctgagcaaacagaagtgcggcttcacagatccgccttacaacgagcggggctttaggggatgtgttgctgccaggacacctgctgaaatatctctgtgtccaaccccagccagcactccggggcatgggggactgcagggcaaggggacacatctctgagccttaggcttttcggctctacaatgggagagttgtataagatgatctccaagagcccttctgtggtctggagccctgagtgatgtttctgaaagccc[450 bp omitted]cccagagattctgagttccaagatttgaggtaggaaagggtggcttagaattctgagttttaaacgagtacctaggtcctctgtaggtttctgatgaaatgtatttaaaagctatgaagtcctgggttcaaatcccatctctgccactttttagctatgtgacttgagaaagtcactaagcctttctggatgtcagttttgtctgtaaaatgaggctgtataaaataactttcaataagttcgagttactgttgcagagtgttgattgcactttgtaaatgtttgtggaataaatggggcagaagtccatttgcccaaaccagaaacctactgttctccttgacgtcctcacctaccacatctctccaccaaccaatcacaaattcctgtgaactctacctcctacatacacttcacacctgccagcttctctccctcctcagggccaccacgctagcccaagccaccatcttcccttgcctgcgcactgcacagcaccctcactggtctcctgctgccaccatggcctctgcccatgcatgctccccagagcagccatgatcatccaaggtcatgcccctacttcaaaccctagctctcaggaaggccttatcatgagtccaaaaaaaattccttcttcccccaacacctacttctaagaactcctttcagtccctcttacactcaagctattctgaacttctttcggattcctccagtgaatcagtttcttttgcccctaggtcttcacacaaagagtatttgctcccctcctcactcccccggaacacacaatccgccactcactactcatccttcctatttcagcttgaatgccagttcttcagggccggacactggccgtcgccctcacgtacgctcgaggaactcttcctcctctgcaataaagctccttacactctacagcgatgacttaatcccacgtcctccactgctaagctagtaacacaagcctctgtcttgtccattgcggtagcacccgcaggtactacagtctgacacattgtgggcgctcacaaagatgtgctgaatgaatgactaaatacgcagcccagtgaaagaatgaagaaacgatgaagtcccttgtcacaggatacatcgcggtgggggtccccccaagtagcactaagctacagccacatgagggcgtcgcagggcagacgcgggccacatgggggcgcccccggtccgtcttagctggttggcacctcctcggactcagtttaggttactaatcgccaatgggcgccaggaggcggggttctccctctgatggacagcatcgctccgcccaatctaattcatcttttccttagccccgcccactccggcccctgagaccccgagggtgggcctggcggagacaccgccaactgaactccagctgagtgctctcgaggccgaaccagcgggcctggcggtctgtgagtgggtggccagccgctaggggcggggcctcagcgttgacgggcaggcaggccgtcccacccctctcgcccagagcggccgcgccagcgctggggacagcagaagtgagtacgtgagcggcgcagcaagatcccagctcggaccccggacggcgcgcgcccccgaagccccggatcccagtcgggcccgcagctgaccgccagattactgtgcatcccgaatcacgaccacctgcaccctcctgccccggcccgccccccaagtcctcaggcacccagctccccggcgccccggatcctcctggaccggtccgtccagattcccgcgggaccgacctgtccgcatccccaggaccgccgggctcggtgcaccgcctcggtcccggagccgcccgcctggattgcattccctcctctcctggatctcctgggacccgacgcgagcctgccccggagcccgccgagcgcaccctctctcgggtgcctgcagccccgccggcgcggcccggcccggcgcggcccggctcggctcctagagctgccacggccatggccagagcccgcccgccgccgccgccgtcgccgccgccggggcttctgccgctgctccctccgctgctgctgctgccgctgctgctgctgcccgccggctgccgggcgctggaaggtgagcggcgtcggggggcgcgcccgggaacaaggtgcctggggtcgcggggctgcgggctagcagcgtgggtccgacccggattgagcgcacgtcggaggaggccccgccaccggcgcccgctccggggcccagggatggggtggggaggccgcccctggagccgcctcggaggctggagctggctcggaggcaggcagcccgcgggttggggggtcgcggggagctagactcgggacgaacgtcccccagagtcctggccctgctgtgagctttcgcgggagtcccccacactcacggcagagaagtggggctcccggcaccccccgaagtcgaggacgtgtgggcgaccccccaggcaaggcgagggccgcggggctgtggcgggtgggggcgaagcgggactccccgggttggggggcgctaatgaggagcccgttggagttaactgtgagagtgtgagtgcgagcaccccgatttgtcaggggaccgctgcgggggcggacaggcgggggcctgttattgtttatggtttaccgggcgccaattacacccgaggtgctgtatgggcgggcccccgcaccctttgtggaggctccctctccgcctgctagagcagggcttgggtctccatttgaacccctgaagttgcgggatttgccccaggtagcagcagagcccggcgccttcctcagtagctggtgggaaaaggccaggcttctcaataggttctgtgaaacctgccaagactgctgtggggggcagctccaacttccaaatgattgtacttggatgaacagcccggcgttgttggcgctggcaggagagctcacacgcatgccacttgacacaagcttgccgcggacagaggccccaacaccagccacaaacaatagggaggcccacacacactcacgccccgtttccaagaatttcggagccattaaatgagagagggtcagaaccttccctaaagtggagggagggacgccacagaaattcgagggcaattggaataaaggcagtacttatttggggtatctttaacagatctagttactttcttagtttaggaacgaaaacacgaactctgtggaacttggcttgttcttatgttcacagtcggtaaacttaaaggttggaaggaaaaaagaacacagttcagagagaaaggcatcctctggtgcgttctaatgttctccagaggaaagacctcctatgatcccccaccctcctcatctctgagcctgctgtgctgacagatcgagtcccacgggtggacacatgcaaattcagactgacacaccgaggtctcgcccacactcgcacacactcacccacatgtgtgtgataggatcgcaggcgtgagaacccagtgtggggctttgttgttgattgccttgagggtgtgagccagggagcctgttctagttgccagatctgtgtctgggtctctgtgtcgtagtccaggagaggcgacactggtacacacacactcatacacttacggggctatgtgtcacctgtgtgtgtcgggccacaaggcccttgttgtgggtgtggtgggtgctggtgctgagtgtggagtgggagtgtggtttgggtcaggtgcacaggggctacctgaggaggctcacttctccctccccccttcccttcctttctgtctttcaaccctcatcacctactggaccctcaggagtccaggccctagcaggagcccaagcttccaagcctccaggccaagcagctggggggctgtccagaaggccgagtcctgatgtgctggggcggcccgggaagagggggcagcaggacctttcgttccccattcccggcctgcccacctcccctccactgtgaagtgggagctagggctactccctggctgtgaggccaggccagcatgggatgcctctgggaagcagcggtgcctacaagggtggtttcaccaattccttcacttttgcaatacctcagactctctggtctccagttcgtgcgtgggagaatgtgagggaacaaatgcaaggtgctgaccccagcgcagacattgcacctacccaccctctggctctccctcactgggagacaggataggaaccgcaccgacctcgcagagttcttctgagtactgaattcttaatgtgtgcaaagtgcttagcataggcattgttattcaaggattagctgttattattattgttaccctagggtctgctccttggggagcttcaggagtgaaacgagtgtgtgcccttatcctgctggagggaggttagagggaggaaagatgaaagggaaggttggtgcagggggctgggggtggggctgtctgccccacatctccctgcagctccagagagggaaggaatggggagagagctggcccagtgggcagctgttttctgcctgtcctccctcctgtattctggggcttggcatgtggatgggtggacttcgaggtcctgggctgtgaccaggatatgtgggttccatagcactgaagatctcttcagcccctccagcttgacaggtggggggtctagctttctccatccaacctaccatttggtttcgtcaggatttggtctgcccttggccttgtggctctttgtgtctggggcatgacatttattttggcccagggtccctgagccctggctgctacctctcatgtaccccctagttagatgctgtctagcacctggttcctcttcccttcctgcacacttgggggtcaccaagactctgcatccaaggctgtcatcagttttccatgtggatggagcctgggtccttgcttgtcctcgtggttgaaaacatgccctccccttgccctctgattgattgtccccttcccccatgcaaattgccctgggctttacgcacagccacagggaaacagggccaccttgtcacccactggtcttttgagtaatgttccccagttccccaaagccaagattattctcccctcaggaccatcaacgggtcagggggtggggtccaatggggaacagactaggaatggggcctgagatgaggaatggtgtctgaaccccagcacccctatacttgggataggatggagagatccccgctgggaagatatccttttgagaaaagagaaacagttaccagatcgcaggaggtggggccagcacgtccccctccagccaagccttggtagctgagttgtcactgcagtggaacctgtctctgaaggaacaagacagcatagagcccacctccttcacaggggcagcaggagtgacccctgagaacacgggaactgagaggggacagcgggccaggatttggagggcttgctcacttgtttgagttgcctctggcacccccaaaccccatccctgtctgtcaggagctggccttctgagcagctgctgggggccggcaggtatttggaagaaccagtttgctcagcactgccctgtctttagccacagctgctgctgctgccactgcagcttcagcggctgctgcgagctgaagccgaagctgccgaagctgccgtgggcaaggcctctgccgcacggccttccactaattaaacagcatgaagaggctgaatcaccaggcctgcatagtttgaaaattgtagccctgcctgttgtgctgagtcaaactggtttgtcgggattgggcagctggggggggtgaagggtggagggagactggatacagctgggcacctgatggggtgggagaggccccctgcccaagggctagccctggtgccaggtctcctattcccttctgcccccagcctcctggccagacccagtgtggccagcatcacaaggaagggctgaagggctcaggttaagggctagctgtccacccgtccttctggctgctggcagggccacagtggggtgggggcatggatgagcaccgaggcgtttgggctccccgccctgggcttctttccccttcttctccctctcaggtttatttaattagaaacccccatgatctgaggggaagaatgaaaaacaaaatgtgttctctgttctgagatgttccccccaccccatcccagacatgggggccaaggggctgtggcaggaaaggaggaggtggccctgggtgagttaggctccccacaacatgcatcttctccagtcccatggcaggctccccccaagacgccttgatcctcacgctgacctccctgtgtgtacaggctggcacacgtgtgtacacatcctgacccatgggaggggagccagcttggtggctgaggaagggactccgtgaagaggaggagggtgtccaactcgggtggcatagcactgctccaggctgctcctccttgcgcagaccctggccccctgccctcctgccccgctgcacactctgcgggcccagccctggtgctgacctttccttccacctctaagtccctagtctggaatttgggctgaagccttgctgcttctgtctttagttgttttgtgtttctgttttttgttttggcttgtttttttctgttgtttgtttgttttctgggtctcaatgacacttttgctcccagggtgctatggggcctggccctccaccagggcaggtggtaggccctcagctggtgcccctcccacaggccagggtgcccatgatgtcctcctcatgccctgctcaaggtcctcgacctgcaagcggaagagccttgcccagagcttctgaagccaaatctcttcagggagctaccctctaccaagggctcaggggccctggagacagtgccattgtgctggcagggaagtggcttgttacttgggcagcggctatacctggggaggccgcacccagccacacccagaatcatcttcatgcccctgctccaccccagcctcgtgacctgactgacagctcctgcccaagccaggacaacaggaagcagggctggggctgtttccctacacctctggctaaggctgccccagcacctctgcttcccttgcaagagtggcccatgtggctgccctgcctgagcgagaggcaccagagtgttgggggcaggatgaggggtaccaccctctcccagtaactcttcctctaccccactggaagacatcccataaacagaaccatgcttgcagggtgtgtgtgtgtgtgtgtgtgtgtgtgtgtgtgttgcgggtgcatggaggatgcacctctgaggctttacacaaatctaggtattgatacttacaccatgtcagggtgctcctttgcaggggctgtggcatatttcagtgtcattggacatctgtgactttgcagctgattgtagtttgtgtgactaaaagcatgtcgccaagtctatacagggaaactggtgtttgtgtttgcactttacaccgaagactgtgtgacttgcagctggtgatagcatgtgcaattgggtgtgtaaggagaacatactgcagggttgggggtgagtgccctctgtgtgcgcatatgtttcaggaaatctgcacataggtaggctggaagcgtgggtccgcctaaggcaagccagatctctgtgtaggaaagattcactgtatatgaatgtctaaggaagactaatctgtttgtaccatatgcatccgtgtgtctgagaaagacagaccatggctctgtgtgaagctgggtgtgtgtttgtgggcggctgtggctttgtgtgtttttgtccaccatatgtgttgacttgtcactctttagccccagtggcggggagtgagcccagcccccaggactggatgctgcgcgtgcatctgtgtgtttgtgcatgggtgagggccacacagctgctgccacgtggctgctctccatggccctgtggaaacctgaaagaggtattgcttagctcctgagcatcaaagctccagtccccgaaagaccccaggcctggtgactacctccctggtgactttgctgggcagttgtggtttcctgcctgacacagcccagtgtctagggtggccagcctcttctcccctctgcctcctgcagatacatggcaggacggcgagggatggggtgcagcaggcagctgggggagttgagaacttgctcactcactcctcttttgtctttacccgctgcccctcatacccccgtcccaacgtgtgtatgtacaacacacgtacacacacgtgcacacacatgcacacgccgcacacacagcacagaaaaggtgggctgggtctctttctcccaataccacggacagatgggttctatgaccccccccccacatccccctcacctcctgccgaaggcagggaccaggcaccccagggctgaggagggccttgccccgtcctctgtgcctgggcaggctgaagggagcaggctcctcctctccccctgagaaacggggaaaccgagagcacgcggccccctccccaccggagtgaccgagcccttcctcgggcacacatgactcgaaacccaagtcctctcttcattaatgggaaaaatgtggcgagattgagcgatggccaaggctgagcgatggccaagggccgatcccctccctccctccctctctcgctccccagaaattaaacagaaatgaagagcctccctgcctccctcgctccctccctccttcccgccgccgcctctccgccgtcccctccctccgctccctcctcccggagccagcgcagggcttgttttaaactgtggaggaatctggctggagggggagggggctgaatatttgggtttaaacagttccagatgggtttggcacaggctgagcagaaggaagtgagggagagggaggagggaggcggcgcgagggagcggctggagccccggcctgctccggcgggcggaccggcgggcggaccggcgggaggactggctgcgggggcagggcgcgcttgctctgccggctcccgggactgacactcgcgctgccggctggggacgaggccgcctggcaacctccctctgtccctgtctcctcgggcctccgcgtctctcggtctccctgtctttgtagtcagccgccggccatcccggctgtcggatccccgccagccggctccgcacatccctccggctccgtgccgcccaccgcccgccagctccagtcgctgccccgcccgcctccctccccgcctgtctctgtgggccccggcttctgagcatctcggcttccctcgagtaccccccaggccgaatgtctgtgtctgtctgtctgtctgtctgtctgccagaggccaggatcgctccccttacagccgggccctcaggggaccaggggctgcggcagcgggaggagcctccctccctgcagtgaatggctgctgcctgcagcccctttgcctgacatggcggggggctggggtcacagctgccttgtccacccacggggtcctccgccgtcctcggctcagacccagcctccgggaaaccactgaaggctgcaagcctgtggccgcggggtttgggcttttccccacttgggcacccagaggggatgatgtagaggcctccagaggtcctggggcaaccctgccccattccagcttcagagctggctgcactgtcttccaggccacgggaaaggagttggcacctctttccttcctttcctgacccaggtctaatctgggggtcacactgtctttcagagagtagggacatccagccagagcgcagaaccaggttcctaagggagcaagtgtatgtcagaaacattaacgggcccctcctatgaccaaacaaggtgaaacagacaagaaaccagctcagaacacaggccgggtactgtgacaaagcccctggccctagatgcacaaaggagggcatcttaccctgacttggaggttcacggaaggcttcctggaggaggcaacagctctgttgggacttaaatgataggcagttttctaggctttctttcatccctcctttacagaggggcatattgcagtcagagtgcaagggattaattatagagtcagatacacctgaacctgatccacccttgtcccctcaccccaagtcctagcaacttcaccttaggcagtgtattttctttgtctgggcatcagtgttctcttctgtaaaagggatacaccaacagtaccttcttccaaggattgcaggaagaattgaactaagagctggtttggggctttggtggtcccctctccaccctcaaagcgcatccctgccccatcacctgtaggtgctgcgtgggagctggctctggcctgtcactgccctccccttcccctgggccttgtgtggggctgggcctttgtgctgggaacggagtcaggggaggccagggccagggtctggagcacacagccctttgttccaggataaaggccctgccggcccctttgtgtggagattagcagagcctgtaggtgtgtggaccagcctctgctcctgcctcattaacccaggcctggggtcagggcactcacccctagcctgcccgacctgacatctttggggctgtgacatctctggggatggccgcagggtctcctgtaggctagggaaactgggggctttcaggacttgtggaaagtggagcctggggggaatcctttcctgagccatctcttctttctttcttttttttttttttttagacagagtttctctctctgttgcccagggtggagtgcagtagtgcaatctcggctcactgcaacctccgtctcccaggttcaagcgattctcctgcctcagcctcccgagtagctgggattacaggcgtgcgccaccagcctggctaattttgtatttttagtagagatggggtttcaacatgttggtcagactgatctcaaactcctgacctcaagtgatccacctgcctcagactcccaaagtgctgggattacaggtgtgagccacttcgctcatctgtgatctcttctgtctcctcaacctgagattagtccctgacctttttctccgttgttcctccagagaccctcatggacacaaaatgggtaacatctgagttggcgtggacatctcatccagaaagtggggtgaggctttcccatcattctcctgagtgttgtttgccattaggcctccccccacttccagcctccgtgccccctcatctcaccagggcctggaggagggctgcctctgccctctgcctgtcaccctcacttcctgtgccatccccatcatcctcacttgtgaccctctgaagcacctcatggtccttctctgtgggcatttctatctctcacccctctgcctgcctgtgccccccagctcccgctccctctccctctcttcctaacagccctctgcatgtccatccccaccatctccctcctccctgggtccctggagaaaacactggcttggaaaccttagttccagatctttaacttgctgtgtgaccttgggcaaggccgtttacccctctgggtggccacttcttgactgttaaattcccgcagtccggacctctctcacatattctaattaatctccctagatggccttcatggctgctctaagccctagaaccctggagtacgatggcactacaggccctgcagtcaccaggcctgactgtgtgaccttgggcaaaactcccttctgcgagccttggcttcctcatctctaaacgtcgggacaacagatgcggctcctcatggagctgttgtgaagattgaatgcgatgttgatagtgacagccagtagcccggaagtgcttgcactgctacaagcccattacatttattagcctgatttaattcctcacagcctcgtttagttccaagcagccccattttacagatgacaaaactgaggtataaagataacaaatatagctgatgttcctgcagtacttaccaagttcctagtcctgtcctaaatgctttattcagttaaagtcattattccttacacatctttattatccccatgttacagatggggaaactgaggcacatggcggttaagtgacttacccataatcacacagcaggcagagagctggaatttgagcccatatagcctgtatgctcagccactgcacaccatagaagcatccctgtgaagtaaatagagcagatctgggcacgagggaagcacttggcaaatgcaggcattcactctgtctttttcattggtccatgcacagtgggaagaggtgagtggctacgatgaggccatgaatcccatccgcacataccaggtgtgtaatgtgcgcgagtcaagccagaacaactggcttcgcacggggttcatctggcggcgggatgtgcagcgggtctacgtggagctcaagttcactgtgcgtgactgcaacagcatccccaacatccccggctcctgcaaggagaccttcaacctcttctactacgaggctgacagcgatgtggcctcagcctcctcccccttctggatggagaacccctacgtgaaagtggacaccattgcacccgatgagagcttctcgcggctggatgccggccgtgtcaacaccaaggtgcgcagctttgggccactttccaaggctggcttctacctggccttccaggaccagggcgcctgcatgtcgctcatctccgtgcgcgccttctacaagaagtgtgcatccaccaccgcaggcttcgcactcttccccgagaccctcactggggcggagcccacctcgctggtcattgctcctggcacctgcatccctaacgccgtggaggtgtcggtgccactcaagctctactgcaacggcgatggggagtggatggtgcctgtgggtgcctgcacctgtgccaccggccatgagccagctgccaaggagtcccagtgccgccgtgagtggggactgtcctggggaaagggttgtcgggagggcctgggccacagctacctaccgccccgccccccacccctgcttgctatctgactaggaggtctgggagcaggtccacagtggaggcaggagagggaagagtggggatcagatgcagagaatgttgtgtaaggagggagaagagagagaaaatgaggagagacacaaggatagtaagagaaaaaatgacattaaagagagaggaagagaagcatgcagaatccttggcaagcaggcacctggagaacgcagtcagaagcttaggaggctggcagagatgctcgctttgtcccggcctgagtgtatgcttcaccctgaaagtggtaggttggccccagggccaagggcacgggggctgtgggtaccttgtgcatggctttttaccctgggctctctgccccttgggaggcagtatataaatggcacagtggttaggggcccagtccctgaagttgagtcctgactctgtcacttaccacttacgtgaccttgggcaagttacttttttttttttttttttgagatggagtttcacaattgttgcctaggctggagtgcaatggcgcgatcttggcttgctgcaacctccacctcccaggttcaaacaattctcctgcctcagcctcctgagtagttgggattacaggcatgtgccaccacacccagctaattttgtatttttagtagaccgggtttcaccatgttggtcaggctggtctcgaactcctgacctcaagtgatccacccgcctcggcctcccaaagcgttgggattacaggtgtaagccaccactcctggccctgggcaagttacttaactgtttgaaccttggtttccttatgtgcaagatgaggaaaataatagaggttccttcatagggctgtagcgaggcttcttatgtgagcaatgctttgcccgtagaacagtgtctggcacatgggagcacagccaccagctaagtgttggccatgagtctccagagccctggcatccacgagagctgggctgttctgcccttattgtatacatgaggagttcaggaagcctgcctcggatggcttgccaagacttatgtactaggcttcggagttatcaaaattgtccacctagggggtctctcactgagcctcaccagtccttgtgaggtagattcctgccatctccctatttcgccaataaggaaactgagtcttggagaagctctgtgcacaggccttgtagctagggaatgtggaagctggcacggaagcctcctcctgtgctctgccatgcaggatggcatgctgagggccctgtctttcgctccctctgcccgattctcttccttggggcttgcagcctacagctctgaggggtaggtgatgactcttatggcagccctaggcgtgagaggggcttggcagcatgaagctggctgcgaggccatgttgtcatgagaaggtgaacagtgcctttcccgggccctctccacttctcgatgggaatctgtcctgagatttcctcttcctaagtggagaaagggggtggggtgatgagcctgacagcctgaagaggggctaacactctgcaggtccccggcaggaaatgcatgctggttcccatagcaaccaggctggcctggcctctgccccctcccccactggctcaaaagagctagggtggaatatcaccttcgtgagggcagatgaaaccccagaaaagggcaagccctagcgctgggcgttctcccctatgggtgtccccctccacaggcagtcatatggagaggcagtgacccactttagtgtctaggagggtcttggtttatgcccattatcctaacacagttattactagtgcctcctttgacttgcaaatgttccagtgtgaagaatacacgataaggctaccatcaatccacagagcctgtgtccaggggcccaagggtagatggcaggagggaagactggggagaagggatgctcaggccctgggcttgctctggggtgagtccccttgtggacacttgaggcctctgaactccaggtgaccccagccttcctgcctgctttctttctctcctcctctcacccgtcctcagcccccatccctgcccaagggcagacaggagctgctgcctgcgcctggtgggtggggcgagagcttcactgtgaaggtcccgtctcctggctgttctagggtgtccttcagggtcctcaggaatgatttttctggagcctcggggagaggtggggcatctccacagtgccgggtgctgctagcccaccggtggtctcttcttcaccccacctcttcctctgtctttctctgtcttccctgcctcaacaagcccaggctgtccaggtgatggggctgacgtcttcgtccatgaggccccggggtaggggtgaggggggcaggggcggggaggaatctgctgacgtggggtttccatggggcaatagggccttttgtagctgcagctggagttaggcaatcccagcattgcccccacagtctaggaggtggaggggccagacctaggctggggagaagccaggttctcatggagctgcggaggtctggtgtctgcagggaagggaggtgagccccattcatcctcttctctcccacagcctgtccccctgggagctacaaggcgaagcagggagaggggccctgcctcccatgtccccccaacagccgtaccacctccccagccgccagcatctgcacctgccacaataacttctaccgtgcagactcggactctgcggacagtgcctgtaccagtgagtgaacgcgtgacctctctttccctctgcaggccttccctctggggggccagcctgggaagcctaagcagtcactatgaatagccccattttccagggaaggagctgaggctcagggaagttagatgttgcgctcaacatggcacaactgggaggtgactgcccctgagccagaatccaggtcagccggctcgtcccttccaccaacgcttgctaagcacctacctgttcctagccatgctcaggaacttgctcctagccatgctcaggaactggctcctagccatgctcaggaactggctaggagcttagcagttggccttctagtccgttgcccctccgtctgtatagaagtgcctctctccagccccactctaaccatggagggggcctcacatcctgagggtggcctggtgctccacttcctctctgccctggccttcggtgtgccgggcattgtgctgggtatcgagggtgaggaggtgaataagatacagtcattgtcctaaaggagctcacaacctggtgggagaaataggtgtaaaaacagataatgaccgtaatgtactaagagctgggctagaaggctgtctaggaattgttttatgtacatgtagagtatagggcaaggacgaatcaaggaaggcttccaaaaggaagtgatatcacaagctgggtattgaaggataaataggagtctgcctggtgaagaaatgtaggaacgttattctgcttatcaaagcagaggcaaggcaaggaggtagaaagcagattggagtgtgctggaactccgggcagagggatggtcctagagcccccagctcactaccttctccctccatattcctcacagccgtgccatctccaccccgaggtgtgatctccaatgtgaatgaaacctcactgatcctcgagtggagtgagccccgggacctgggtggccgggatgacctcctgtacaatgtcatctgcaagaagtgccatggggctggaggggcctcagcctgctcacgctgtgatgacaacgtggagtttgtgcctcggcagctgggcctgacggagcgccgggtccacatcagccatctgctggcccacacgcgctacacctttgaggtgcaggcggtcaacggtgtctcgggcaagagccctctgccgcctcgttatgcggccgtgaatatcaccacaaaccaggctggtgaggaggggacactggagggtagggcctgggtcactttctcctggatgaggtgtcccaggacctgctaagggaccactgggggtcccatgggaagtgggtctttgggaaggatgccagggtccagggagcccctggtgagccctctgctcttcccagccccgtctgaagtgcccacactacgcctgcacagcagctcaggcagcagcctcaccctatcctgggcacccccagagcggcccaacggagtcatcctggactacgagatgaagtactttgagaaggtcagaacctcaaggggcaggaggaggccttgggctgagctgggctgagaaaattacccccggatcatgatggggcccttgggagcaaggccttgggtatggagggggcatgtggcaggcctgggtgtgaataggggctggttggcctcaggacccacctgagggtgccccctctctcctggcattgcagagcgagggcatcgcctccacagtgaccagccagatgaactccgtgcagctggacgggcttcggcctgacgcccgctatgtggtccaggtccgtgcccgcacagtagctggctatgggcagtacagccgccctgccgagtttgagaccacaagtgagagaggttagtagccccctgcgcctgtccccatcgcggccctcactctctgtccctccactcagcagccccttctctatctccaggctctggggcccagcagctccaggagcagcttcccctcatcgtgggctccgctacagctgggcttgtcttcgtggtggctgtcgtggtcatcgctatcgtctgcctcaggtactcccaggcccactgttgctccatgggccgcctcgaactgccctttagcatcctagagccctcatgccacagagatgagccgccaccacttccctcagacccagggccttagccctcctggggccagccgttgctggagaagccctctcccatccctgcctgtgtcttcatcccgccctttctccataccccattccctgaatctccgggcaggttccctagggactgagtccactgaaccccttgctcagacacccagagactgctgtgaccaccaattgtgggactaggccccaggccatcccctgtatcctctccgccccttctgtgagcccaagggtgccctgaacaaagggaggcagatgacttgtctcaggcctgccctccaccctgccaccctacaggaagcagcgacacggctctgattcggagtacacggagaagctgcagcagtacagtgagtttgtccccgccgccctccccaagctctcccagccccctgcagggctctcagacacccttctccctgcctgggacttcattccttagagataaaccctgaatgccccctcccacttccagtcaagtggcatttcctgacccctatctcactccgggtaccctgggcccctactcactcctgctagccccagaaatgactgagacgtgacctctccccctaaaggcagttagtcctgtgggaaagacaagatgcaaacacacaggaaacaatttgagaacaattaagggttgagctgggtgctcctgttgtaaagggcactaagagtttagagaagaggaaggcttcctcgaggaggtggacttgagctgagccaggcgggatgagcagggtgttgggaggtgagggagagcattcctggccagaggagcctctggaaggtagtgggcggggtggggaaggagcccaactgtgggggcagcgagaagactggtttgacagctgctgggaagccaggctgggtagctgtggccagccctcggagggtcctgaaaggcaggcagaggagtctggacttgactccaccataggtaattggaaaggctctcaagctggggagtaatacaatgaaaggattgttttaggaagacagcggtatgcaggatagctcggtgggaaaagtccagaggcagagagcccagctgggaggctattggaatagtgtgagtgttgaaggcctggacaaggtcggggcagtgggaaccaggggaggcatgaatctgagagaggtctggatgtgatgagagatgagagagaaaaactaggagtagaatcctaggtgtctagcctttatggtcaccaggagttctcatgggagctggaggattagggcagcaacacagaggaatatggggctgggctcagcagggagcctgctggagctgtgcccatcgcagggagaggctggcttgacgttaccctctcacgcccacctcttctccctccagttgctcctggaatgaaggtttatattgacccttttacctacgaggaccctaatgaggctgttcgggagtttgccaaggagatcgacgtgtcctgcgtcaagatcgaggaggtgatcggagctggtgagtctcccggggcacagtagagatgagaagctgaggcgggctgggtacaggagtgagtcatagcttgtgccctgtgccctgcaggggaatttggggaagtgtgccgtggtcgactgaaacagcctggccgccgagaggtgtttgtggccatcaagacgctgaaggtgggctacaccgagaggcagcggcgggacttcctaagcgaggcctccatcatgggtcagtttgatcaccccaatataatccggctcgagggcgtggtcaccaaaagtcggccagttatgatcctcactgagttcatggaaaactgcgccctggactccttcctccgggtaagagccagcccccaggccctctccctcccccagagagttggattgggctcaccatcccctcccacaagtcagacagcccctattcaagtccataagcatttactgaggtggcttggtgcagggaaatggcagggccttcatagccataagtatgggagttcacatcttgactgttccttactgcctgtgtgacctcaggcaagtgacttaacctctttgagtctcagctgcctggttgtagaatggcagtggtaagagctagtgggtcctcatggggattaactgggatgttgtctataagatacttgacacatagtagggcagctcacttaccctcagggcactctggacatggttgcaggagagacgaggtagagtctgagtactcggagagggaaggcaggtgggcaggccatgggctgatgggagcaatgggctcacctgagcctgcttgttgcctgcagctcaacgatgggcagttcacggtcatccagctggtgggcatgttgcggggcattgctgccggcatgaagtacctgtccgagatgaactatgtgcaccgcgacctggctgctcgcaacatccttgtcaacagcaacctggtctgcaaagtctcagactttggcctctcccgcttcctggaggatgacccctccgatcctacctacaccagttccctggtacaggaagccgctgggagggagactgggggcggggcctatcagccaggggctcgggcctggggggcagcccggagtcacagggtgaagggcctgtgcccccctcaccagggcgggaagatccccatccgctggactgccccagaggccatagcctatcggaagttcacttctgctagtgatgtctggagctacggaattgtcatgtgggaggtcatgagctatggagagcgaccctactgggacatgagcaaccaggatgtgagtgaggctacgccagagtggttgggtaggtgggtgctggctggggatcatggcagtggctcactcagggtttccctgccttcggcccaggtcatcaatgccgtggagcaggattaccggctgccaccacccatggactgtcccacagcactgcaccagctcatgctggactgctgggtgcgggaccggaacctcaggcccaaattctcccagattgtcaataccctggacaagctcatccgcaatgctgccagcctcaaggtcattgccagcgctcagtctgggttagtacctctgcctctgctcccgccaagccagtagccctatctcccaccttcaagactcaccaggtccttctcttcttcccacagcatgtcacagcccctcctggaccgcacggtcccagattacacaaccttcacgacagttggtgattggctggatgccatcaagatggggcggtacaaggagagcttcgtcagtgcggggtttgcatcttttgacctggtggcccagatgacggcagagtaagtgtgcctcagatttggaggagcagggcagggggccctaggctgggcccagagttgagggcacgaggaaagggactgatcctaatttggctccacctgcagagacctgctccgtattggggtcaccctggccggccaccagaagaagatcctgagcagtatccaggacatgcggctgcagatgaaccagacgctgcctgtgcaggtctgacaccggctcccacggggaccctgaggaccgtgcagggatgccaagcagccggctggactttcggactcttggacttttggatgcctggccttaggctgtggcccagaagctggaagtttgggaaaggcccaagctgggacttctccaggcctgtgttccctccccaggaagtgcgccccaaacctcttcatattgaagatggattaggagagggggtgatgacccctccccaagcccctcagggcccagaccttcctgctctccagcaggggatccccacaacctcacacttgtctgttcttcagtgctggaggtcctggcagggtcaggctggggtaagccggggttccacagggcccagccctggcaggggtctggccccccaggtaggcggagagcagtccctccctcaggaactggaggaggggactccaggaatggggaaatgtgacaccaccatcctgaagccagcttgcacctccagtttgcacagggatttgttctgggggctgagggccctgtccccacccccgcccttggtgctgtcataaaagggcaggcaggggcaggctgaggagttgccctttgccccccagagactgactctcagagccagagatgggatgtgtgagtgtgtgtgtgtgtgtgtgtgtgtgcgcgcgcgcgcgcgtgtgtgtgtgcacgcactggcctgcacagagagcatgggtgagcgtgtaaaagcttggccctgtgccctacaatggggccagctgggccgacagcagaataaaggcaataagatgattctcttgccccttcttattcctcctcccaaagcaagattccctgattcagagttcacagtccctggctgccaacccttcgcaactccctggaggcattgggaaaccagatctgggcccatccaggctcagtttcccctttgtgcttggccctcactgctttgaacacctaacgcacttcttggaagtgggtcagtggcaacggagagctaactaccccagagctccttccttctaaggcagagaccttcctggggtgggggcaggctcttgtgtctggatggtgttttactgagtcggttcccagcctttgtctttaagggagctgagggtagagggggttgatcagttcccagggtcacatgaccaaggacaaagggaaggagagccactggtgttcagaggctgaggcccggaagttcggctgctcctcactgaggcttcctatgcccaggcgctgggctaaatgctccatttatacacggatcttatttaatctcacaacaacccagccaggcaaggaagtatttttaactgctttttacagaagaggaaaaggagaggttaagtaacttgcccaaagtcgctgagccagtaagtgaggcccgcggctgtgattcccacccagagactgcctgcatacttgaaaggttcagaggataaataacaagaaccggggagagggttaggaaaacagcttctggaaatgtcaaaggagaaagcgtggtggggggccctcagaggcccttcggacgcaggaacaggcgggggaggggggaagtgcagtcatgttcccagtatcgggaggcatccttgggcagcaaagctttgtgctttccgagagacctgcataccctgggtagggtccctgggtaggcacagaggcatggacagacaccacgccatgtagatgagaggttcacgtgtcgcggccccacacctctccctggacgcgtccaggcagcgcagagcttcccaggggaaatctaagcgagaggctgcacctaggggtctgcggagccgcaggcctggaagcatgcgaccgtgatttcaggctctggggtgaaggcccagggaggccgcgcggaggaggccgcgggcgaaggttgcagggtctgctgcgtggcgcactcccggccgcggaagccgacggcgatcggaggagcctgggagcggccctggcagcggccctggcacagctggcggcggcgcgggctcctcaggccgcccccgtccttcaccgcgcgctcccgcgctggggctgctcggcggcgcccgctccttagtattccccccacggagcccagccgcgccgccgcagccggcccgggggaggggcgccccgcacggctaagctctctgcgtccccggggcggacgcggggaggggaggggaagggacgcagcctctccgccgaggcctccttcctcccctagtgggggggaggggctgtgcgggggcaggggcgggcgatgcgggggcccaaggtggcccttggactaggcgccggagctgtcaacggggcgaggtgtggcgggcggccgggggaggggacgcggtgccgagtggcctcctgcacagccgctcagcattccccggctgcaggcgcaaataaagcggagggggcgcgcggagctcctgctcaagggtccacttcctactctcgaagctagggaatggggagggatccgtggcccgggagtcctgcgaagccttcctcgccatcctgtgccatcgccctgacctttatagcgggagtctgggtggagggcgcggagatgctggggtgggggctccactcgcataggtgtgacatcgccctctactgggtccgcagggagggcaagatcgtggtcgtttagcgccaaggcgggaggggccctggaaaccacacgatcaggggaactcttggactgtgcgccccaggtcgaggatctcgagggatgtcttgagcccagaggtccgggggaagtaaggtactctgtcggctgtgccttgtgcagccaccacgcatacctcgctcctcctgtatccaggtatcctcgcctgcatgcgtgccctctcctgccacttgcccacggaaacagctgacaggcacacttcactgacccaagctacagcacagcacagcccttactccctcactcacggtcattcgtcctcagtcacttgaccctctaggccccaccttccaagcccacacgccctaagagtctcccatggcagaacgggtaggggaagggatgcagagagggaagaaaagccatccccttcctggaaggcgcctcccgcccccagcgcacttcctaccggaaccgcttcacctaactaacctgtgtctcactggaaagggctgggaggagtcctcagaacccccagcaggattgcaaggagggagggctatgattaaagcagaggaagagacagaagagagagggcgcctcaggagttgtctggctcttctggggacagataaggagtgagagggaatgagattttagtaggcctagtgttggttactttcacacttcctgggggcagaaaattagatctcccaagttagggctaaaaggaagtcggtgggagtgaggggttgttgaggcttaggaaggggctgctcccccttgattccctcattccacttgccccatgggggcagttatagccccaaaggaaccacttcttgccctcactatgcctgagctcagagagtaggaacagctagggagcaaaggtgctttagtctgtgctcagcccctgagcacagggagaggtgcccaggacagcaggtgagggagagggacctggatagcagtccttagacctaagcctgagtggccagaccttggattataacccagaaaatgtgggtagtgccatgggaagggctgcctatttatgtacgggcagaccggggttcaaagcccatctcttttgtttctatacctctctgcctcaatgccctcggttataaaaaggtctagttatcatttctatatcatgagattgttaaatcagtaaatacatgtaaagtatgtgccaggattgtagtaagtgctcaaaaatgttagctattttttatttgtatgaagtttgaagaaaatatagaagcaaataggaaaatgctgaacagtgcttggcacatagcagggatggaataaaccaaggcactaggagaaatccaccaactccattcaggtctctctggaagggaagagggtgaggaagctaaaggggcagagaaagaggtcccacccacggggctcctggacgttttgctgcaggcctagcccgggccctggatcagttcttggggtagggctgctggggcctggatggtttcaaggccacgggaatgtggcacattgctgagagggcaagtgtggctcaagccttctggctttttctcagcacactgatcctgggcccgcttggggaaatggaactgtttccctccaatagtcattcttcaagtgtgtactagagaactcttgtgtgccaggcactgtgctgggcactggggatactgcgatgagcaagaacatagaagatcaatgcttcaaagagcttcaagtctaatagggaacagggatgtgattcaaatatacatgcagataattgtatctaattacaggtcgaggtaaatgttacagaaaccaagttgagtgttgtggaactaaatcacagttctagggacctcagctagtcttgggcagggctgggggctctctgaccctttatttgatgcccagcagagggagctgggacctccccccccattaccctccaggtccttttaaccttttagtctctgaccctgagcatatcttcattcactccccaactcattcattcatttattcaacatactttcactggggagttctatagaccaggtccagtgtaaggagctggggataatggggataaaccagcttacagcccccactccctggaggtgtgcacagctgagagggtccctgatatataaaccaatgaatgcaatgtggtaagtgccacagggtaagttctatacctgggtaagcattccaagtgctgtaaggaagggacctaggccaaaatactgtcaaaaagggctccgagaagttgattcttttttttttttttttcactctttgagatgaagtcttgctctgtcacccaggctggagtgcaatggcgcaatcgcagctcactgcaacctctgcctcccgggttcaagcaattctcctccctcagcctcccaagtggcctggattacaggggcctgccactgcgcctggctaatttttttgtatttttagtagagacagagtttcgccatgttggccaagctggtctcgaactcctgacctcaagtgatccgcctgccttggcctcccaaagtgccgggattacaggcgtgagccactgaacccaattcttgaattcaatcttggtggctctgttgcagttagcaagaagagagaagggagtggtatatgcaaaggtcctagggcccatgagagcagggcaggctaggggccctcattccaactcagaggatgaggaaggaacacggtcatgaacatatgatattgcccaagccttcccttttccgtaagtcatccccaggcgggggccacctgcttctcacagatcagaggagtagtcttgggcttctggcctcagcagttcttggttccacagagttcctcgggcaccctctatgttgctacttcctcagccctttgttctacgtcttctctgctgcaaggcacatctgtccacaagggtttctgaatacgcgatgcactctgtgcctccaaggaaaggctcagagaggttaaatgacttgccgaagatcacagagccagtccctgacagagacaaaatccagatcccatctaccctgtccccagttctgtgttcttcccctacaacaggatacctaggaagggggtccagggaaacccagaagtgctccacttggatgacacactccggcccttcctgcccacttcggagtgacccctcctgccccttagttgcacatattttaagggctgcttcagctttcattttttcagagaggggaggagagagattggagggaagctgggcacccaggcactgaaggcacttgtcaggagcacagcccaggttctagcttgggggtggggcagacgggcaaggggctctctccctccaccgtctctccctgcccctctctgtttctcattcattattcccatctcataaagcaggaatgaaaacagactcaggatctggctggaggccttcggtgacatcagtccagaggtggctgccctgaccctgactactgggggctgaagagacctccttccctactttgtcctggcttggcagagagaaggagaaaggcaagagtcaactctccctgaatccctctcccttctggggcaccgaacttgggacaggtaagaaaggtggcacttgcctgaagggaccagaaagggtgtgtctgcaggaatgtgaggggtactggagttggctttggccagacaccactgcctcccacacaccctgccactccttccccactgccaccccagcaccactcccggccattgttctccaaacatcccctacacttcctttcgaagccccctctgttacagaggtcttcctttatactccctgctcctgccttcttcccagcctcacctcccatggcctttccaagcccaggtcagctcacactctggcttctgaaacttggtatctggctgaccagattcttcttggctccggcctcttggctctcctacccagatgctgacctctcacctgccatgacttccaccattcctagttggcctcttgacagcacattaggctaccctttgagcctggtcatcatgtagccatctcctccaagattgcaagtcagatattgcaggctctcatccattcttcctctctgcctagtttcaaaatgtggcccccaaaccccttcttctccccacctgtggaccttctgagatgctcttctctcctagcccaacctggattactcccactcccaaacatccccaccaccatctctctgaataatccttttcttgttttgctaatttccaggaacattcccccacaacagctggtacaggcttttctacactactcaaggccccagttgtaccttcttccattctcagcagagtttctcaccttcaaatgtactaaaataatgcagcctctcaacaaacactcactgagacttctttgccaggcaatggagataagtgagccccctcaaggagtccacaggccagtggaggagaaggaaatgcaacagggtgatataggaatattcttggtgtcactgatggattttgaggatagtgccatcatgaggacagtgtttagggaagaggagtgaggcaggtgtgggagggactggaggatgtagagatagtggcaggaaggcagagaaagatgccacagtctaggtgaagggtaagaaggtcctggttggagatggggtgaggaggaggtgctgccgaggtgacgggtgtgaatgatcttgcaaaggtaagtagcaacgtgcttggtgactgatgggatgtgggaggggagagataatagatgtctgagcgtgggtgattttggggactggcagtagggcatactttggtaccacttgtggatccagaaagtacaggagaaggaatagtaagtgtgaaggagaataatgagttcagtttgaggcttgccaggagagatgccccataagccattgaatatctgatctggagccactaggcacagcatggaagcccgggatgaagtacggatagtgggcaggattgcctgggagagttgtggagagaagagtagaagctgaggtgggtatgagggaatgcctcctggctgctcatgcaggcattgttcatgcctctccaagagctttcaccacactgcattgtaaatgttcctgtttgtctactcccacaccatcagcttctcaaatgaaatcttagaataagaacaactacaattaccattactgaatgcttactgtgtcaggcactgtgctaagaaccttattaggttattccatttaacataaatgaattaatagatgaatgaaataatggatgtgaggatatagtacctggatggatgtatgagtaaaatatgtatatgttgatgtacatatggacaagtaggtaagttgatgggtgaatgaatgggcagatcagaagatgaatggaaggatgaatagaggagtagatagacaaactatgtatgaatgatgaatagttggctgaatggatgatgggtaggtgagtggacagagaagtggacatgtgaatggatggagggttgaatgaatggtagggtggatgaaagaatagacaggcaggtgtgtggatgagagaatgcatggatgaatgggtggatggatggaggggtaggtagaaaaatacatgaatagatagaagaatggaagagtagaaagaatgatgaaaaaagaaagaagaaatgaaaactaaatcaatacacaagcagaaatgagaagatagataagtagatgaatgggtgaatgaatagatggatagataaatagatgggtggatggaaagatgaatggtaggatggatgaatggatagacaatgggaatatggatgaaaagatgaatgaatggatggataattgaaggactagatagcaggatcgctagatgaatgaatggttcgatcaatgagtggatgagtaaatggatggattaatggatgtgtggatggcttctccctctctcccctgttataatcgctttaacagtcctaatccagaaaccccaggaccaaagcagatgccaggtttggagggttgtgattagagtgggaaacttattggcatcacaggaagtgtcaggggaaggaggagtgttttgtggggctgccaggacagccatatctattcccaggtaaaaaagtggtttttaggaagtagcattcaggcaggcaggaagcaatgaggacttgctgagttaaaaaataggacctacctccaaaggcatctggggaagtggtggcaatccccagttcatagtctgataggcccagttgcaggccttcagttcagttctactatctaggagctgtgtgaccttggacaagttcacttaacctttctgactttcctcatttgtaaaatgaaccagcaacatctacctcacacggtcactgagagaataaaacaagatgttgcaaagaaagcacaaatgccttcaagaaataataaaatatgtagatttcatttttggtaggggaagataaactaaggaagcttcactttgtgtctgtttaggaagaagtgtgagtttggtgtgcggggatgatggcatcatggtctagggtccccatggcctctgggcattagcacagcctcatagggttctcctcgagaagccccctcctgcttcctgctcccgcaggctcgggtccttggagatttcccaaggccagagctggaggaagtagcatcagggtgcgggtgggggcaggagctagccttggagcccctccctctagcccgaccctccctctctgggccaggtgccagcagacagggcacccagctctgtatgaaacaaagaagagctgcttgttgtggaggatgagtcatggagaccccagaatggccctgggaggaagtggggagagggctcctcccccagcccatccccaggaacaggacttctcccacagctggacctcgctgtggaggatgtggattaaagggagccaggaactgggatttgtacctttttcctccccacgactttcttttacctcccttgtttcattttctctccatcacattgacatgttttcagatggaagaacagaggctgggaagcttgccttgggtcttgcaggtattgacaatattcaacacctggacttttggctctgctggaggcatttcctcctcctaaactggcttgtactgaccttgaacataggataggtggagaaagactgtgtcttacactagactttttatgtaatttcatcttcacagcaatcctgcaaggatgactttattactccattttacttttttttctgtttttgttttttggtttttggttttttttgtatttttagtagagatggggtttcaccatgttgcccaggctggtctcgaactcctgagctcaagcgatcaacctgcttcagcctcccaaagtgctgggattacaggcgtgaaccaccgcgcctggccactccgttttacagacaagaaaactgaggctcagggaagtaacttacccaaggtcacatgtctggtaagggttaaagcctggatagaacccagggtgtctgactcttgactagagtggtaccttagagagagggccttgaggacagggaccccctggggtctgagagaggaggtgagaggctctggaggcatgaggacccgggtactgttcggtttgactcagcggcaggactcctggctccgcatgcagctctgcgccaggagccccaggtctctgtgtgcaaaatgaagatgctgaagcagtgccaacagggccatacccagccccagcccccaccagagggctcaggaaatgacacacctgaatgtagaacagattgttggacccatctccagcatcacctcccaggggaagggtttgcagatggtggctcagcagcccctagcggggaggaggcccaggcctcctgggtggaggagtgccctccacagcccagaccctgccatgtagtgtggtgggcacatgggcctgtgggtcaggtcctgctgtgtgaccttagacaatttgctaaatatctctgggcctcatactcctcttttgtaaacaaaaggagaaaatgtgttctgtctaccttctgggcaaagggcctggagaaagagacctcctaccccatggggatctaactgtggatcacaacccagtctctggaaagaggtgggggaacgggagctctgcacgatcctcccattggtaaggagtgttaggcagcacgaaacagcaccctgggggctgcctggaattttttttcacagctctgcctgcgcataaggagctgcttcctcttcgtacccttgctatgggatctgaaacagagccttttctgctcctgcgggaatagagagtgtgttaaggggcaggcagggatggctcctgggatagtgatcggctctgctgtggcagctaaactctcctatggtcaaggccggacactgggctcagctctagatcatctgctcctggcacaggcagggtgactgaggtactcaaaggggcggccggcagagcctgagctcccacgttctcaaggctgaggcagacagcgcgagcggccagcccacaggggcctctctttgggggctgtaagttgtgtagaggctgaagtgcccaggaaggagtggtggggacagtggtgtcatttcaagtgtgtgtgtgggtcatcccttctccttccacacccgccttggctgaggcggcagctcaggcagaagggagtctggggggaggtgagggcagagctttgcaaaggaggaggcaggaattctggttggaaatcattcaaatgaggctatgaaaccagaaccctgtctcagaacaaattggccagatttggcctggggccgggagtacagggggagtggaggaggttgggccctggctgagcaggggaggggttggacaggactctgatgtgtggccccaggaggagcccagccttgggctgtgatgggaaaaagggggcagtcatccctgttcctcctgccactctgtggtctgcctgccatgacctaggagggagctgccaggcaccccagccaccctctggcctgtcctggagtgaagggatccagtccattgctgacaccttccagggccacccagctgtgaccctgccacagtcctgtccctgcctttttatggagcagaggaggccctgtggctccccagctcagcaagtattcattctcacttttctgtttcccttctaagtcccatgccaacagctccagggatgaactgggctgggggctagggagggaggggtgaatctctgaggctttggggtatgccttaacaaatgggttctcactccttgtcctaactaggggggtgtctgggggcctctcgcagggttgctaggggaatgcctctcctccctagtcagagctgaggataggcctgggtcacacactggggagggtggacacaggggttcactgcggggccaggcaagagcatgcatggaggaaaacgaggccttcagagacctatcaaaggagctgctgtgtgagacaggcaaccttggagggtcagccaggttcacgccgctgagagggatggaggcctgggctgatggaggagtggtggaggcagctggggatggactgactaagtggggagtggccaggcgcaggacagtaggcttctcctgtccagctggcaggctgcaggcagagccccagggagcgctttctagggagaagctctgtctgtctgcctatagtggtctgagtgtctgggccccttctcagggagaaaaacagggttccttagccacccagtccccacacctcctcttctagactgaagggccaaaatcaagcctcagagccagacagaagccgaactcagacacaagccgtgacctcccgcttcctgcccgacccttccctcttgcgaccccaatcctggggtctgtctggcatcccgttccttaaacactgccctcatcgtgcaggcttctgcccttgtttccacgacaggcgctcccactttctgtccccatagcctttcctttgactcaagtctcgccccatggagagggaaccagagactggttgggaccccccttcttattcttctctgtgcccactaagcatccagaggggaccttacttcctacccacctccagtgtggggtctcagaggcctctgaccttccccctcccagccccagtggaggcttccagaatcctctctgctccccaccacgtggattcccaggatctcctacctgcccctccgagtgtgggtctgtctcgttcactactctcaacaccccctattccaccccagcgagccctcaggattctctctgttgtctccacaccccagcgtggacttccaggggagccctggaagaaaggcgcttctcaggccatggagggggtggccagccctggcgcctgctgggaggggactcccttctggcccttccttaaggatcaggctggacctggacctccactctcaacccctcctctcaacgaagggggacctgctctttcgggggagtgagctggagggggatgggaggggcaggagaggtgggggaaccggtcttctgttgttcttggcttggagcccccagccccagggaaatcctgactctgtggaaaactgagcaggcagtcaggcggaggaggaggagtgggaagaggaagaggaggagaagggggaggaggaccaagggctcagggtgagtgggggtaggggctcctctcataaatcaatcccaccaacgtctcaggcctgacaaaaaccagagacccagggtcccttgggggccaatgtgggggtggggcacagaccatcagatggactttaggagaggaaaggctgattcgaggggcagcatcctgcccagagggttctgcctccagcccccgagaacaacaggtgtgtgtgtggtgggggaagggtctgagaattaggcctcacaactacgggagcccagccctcatggctgtgacagatcattggggaaggggggggcccacttgtctacaattcagaacacttttattgccatggattgaagcctggttcaactcctggggaaccctgtgacttcagacaagttatttcacctctccgggccttggtctctgtcccccagggtgcaggttgcgggggccgtgaggttgaagtggatgtttacagaggtcccacctcactttggcttcctctgacactacaccacagcccctctcaatgcttggcagaggaaagaatattgttctggagctggtaggacaacagtgagaagtctaggctccaccttttagtaactgtggccatgggcagatcatagaacttctcggatcctcagcttctgcatctgtgaaatgggcaaatattggctccctggcagcgctcctatgccagtgagtgaaatgccagtatgtaaagtgcctggccccgcagattctcagtggaaggccattgtttattttgtgtctgcctcttgggtgtttacggcatccagagatcccctctttcctttactgatgctaattaagtggatgcagctcccaaactggtgacataggaaaccttcgcaagccactccctcagtattttcaagagtcttgagatgcctgcttctcctgcgcccactcatccttcctgccatggctggtgtcttcctgcaccgagtgttgccccacttggccactgccccaggggacacgtgaggcctaggatgtgctttggctggccatcaccaaggtctgcaccatggaggaaggatgcagccagccgggggccgccaacaacgagcacttgaacatgaactgccactgctgttccaacccccaagtctcaccacctgctgtccttgctcccacaaaggtccatcacaggtcgtttcctgtgccctccccctctagtctccccttccaatgtctcattcctgccccctcactccttccccatccaggttcctgtggctgttgactgagcacccggcacccctttgtactgccctcctgtccctgcttcagcccaggccttacctggcttcagccagatccccattcaggtacactgagatatttcaaccagcagaaggggctgacacttgtgttatgttctgttcctccgaggggaggctgaagggcagcagtgtgttcatttcctgggtaataatgttttctcacaactagattttataactttgaccaacccttcccctgccctgaccttcccccactctcctgcccctcccatccccgaaggctcaccttcttctccaggcctcaggttctctcttcacagaaatccctaggtggtgtgtggtgaggcatcgagtcgggccactccaggtccctactcttttttttttttcctttttttgtgagacagagtctcgctctgtggcccaggctagatgcagtggtgcaatcttggcccactgcaacctctgcctcccgggttcaagcaattttcctgcctcagccttctgagtagctgggcacgtgccaccatgcctggctaatttttgtattttcagtagagacgtggtttcaccatgttggccaggctatattccaactcttgaccccaggtgatccgcctgcctcggcctcccaaagtgctgggattacagatgtgagcctcggtacccagccaggtccttactcttgagtttgaacaaacccactgggctgggccaaacctggggcacaggctggggataatttggctgggctggtctgatcccccttgaaacctctagctgggtttcacctctagctgggtttcccaggaagtcttgtctacctccaggatttccatgcactgatgccgccccagggatccatgccccaggatgcaagggacaatggaatcagagaccatgcctggtggctcttgtgctgaccagaactgccatcgttggcaggtgtgggctttcaatggtgagaggtgtgagaagcccctgggggagagtgggcagcgcacagttccccaaacagaatctttccagatttgtcttccccactgcataccagtccctcaaggatggagtccatacattatgcgggggcggccctttgggcctctgggcctcaagctttctaggtctcacctgttgccccagggctctgaggagcccagtcaggccagctggaaaggtccagagagaccatttctctgacagtggcatccccactcctctcccaggggcagaaagcccctctccaacccccatgacagatggcacccagactctgcttggccactcccggggatgggtactcatgacctcccaaggcagccccctcttgctggggtagctgggatgattgaagagttcaaagtggagactccaacaagcatttattgctggtccctctgtgggagtgaagagggggtcagggagcatagctgtggatgtctccatgagggagggggtggggcagggctgcctgtttggggtgaggcccaggatcctggggaaaaggcccaggcctaggaagccagggatgggatttgagtctctgctctgccattaactcatcgtgtggccttgagggagtccctcctctccctgggcctcagtttccacaagtgtaaactttgggggctgggctcggggacttctcagggccctgcccctggcaacggatgctcttccgtgagtctatgaatagctggcacagagggatcgggccttggtccacagggctgggctggcttgagagtgctcagagaatgagccctgtgtgggacaggacaaggttccctttcatttcaagaggtcttggcagccgcccagggcccgcaggctctccctcctgccaaggtcaacctgaccctgacctggggggcatcactgcctggggcggttggggtcaggcgctggcaacttggttgagaaggagcccagcacagacgttgactcccgtcctctgggctggggtcggggtctgagcaacatcagctctgtgtgccttgtgtttctgacagtgacccagagctctttcccccaccccactttggtggtcccttggaaagacccccactggccttggcatcaggcacgtctggtatggaatccagacctgccacttacaggccaaatgaccttgggcaagtccttgcccctcctcatctggaagtcagtgaccgtaatttctaccttgcatagttgctgggaagataaggcccacgagcaagcatcatgcgcgcagcacacactccacgaagagtggctgcgatgatcatgaccagacgcccagctaagcagggaaggtgacaaggaactagccgggactcggctcttcctgctgcctcagccctctgtctcttggtctgtttgtccatcagggcattggggggttccaattctcaggctctaaaatctgcacaatttaaagtagtcaaaacaaactccactcactctatttatgctgagagggaacaagctcctggccgggcctaatgggttccaggtgtgctctgtgccctgcagcggctgaaccggcagcagtggtggtggctgtgactgtgcctggctggctgagaagacccagctaggccagtcctctctagcccagacctccagcctatgaaaactgtagagctggagcaggccctacccagtatggtgggacagatgttagccttgtgctcagagggccttgggttcaaaatcaggaggcgttgtccgcacgcccagcagcacacacggggggctcccagactctcctgcctttatcgcaacaggttctggggctgcccagacatttttcacagatctgtaaaactccctttcacaagaggtcggctgtggaagtgacctcccagagaggctcgggaaccaggtgggagcccagagggcatgaatgaggtttcttttattaccattatatattaattatcctgttatataatcagagtgtcagctgtcatttattaatggccagccatgggccaggtactgtatttggtgctttctatccaggattcattgaatgcttacagccacacatggagatgacaggctaatgtcatctcaaagaacacaaaggaacaggaggctcagggataccaggagccttgcctgaggtcacacagtcaggaactggctggagtgggacttaggcccaaggctgtttgattcccacgctaaggtctgctcaccatactgggcaggcctgtctcaagggccagagagagtgcatgtgtgtcagtgtgagggtggatgggaggatctggttggaagcagagcagggagtaatttttccttgagtgacaatgccaaatacccataaggtgagcgcacgacaccttcccccattctagctgcaccccctcccagcacccagtcctcctagtcccaagcctgggccctgttctgctacctgggtgaacaacctctccctcggcctccttaccacctctggaccaggccagcccaaactctgccccaggaaatggaggggactgttggcattgaggccaccatcagatcaccccactttcgcccatatcagctgggccctccaggacagactgggcagtccaccgttgggggaaggctgaagatccactatggaatcacagatggcgtgtgggcacgattgcaagtggggtgccttggccccattctttgggtaattattagtaatagtaatgtttagcctctgtagtctcaataatcatcccatacacacagtgtccttactgatgtaacttctcaaagcactgggtactttccttcacactgcttaccaatttgttattagacacttacacacatattttcttggttaattctgccctctcccagggctgcaagctcgaaaaggacagttggctttcagctgtatccccagtgcctggcacagtgttgacacatagtacaggcccctgataaattgtgttgaatgcacttatggataaatgagtgtaatggagtcagcaggaagctaagaagaggtagacaggactacgaagcgggaggaatatgaggatgaagcttcaggagtctgtggatggagccgggctggtagggcatatccaatagggacagggaggagggacactgcactcttggtggcccctgggaagccaggtatggttctggcatgaaggagctaagctgtaaggccccttcacctgcctggagctgaaccgtggcctcctgcaggtcaggaatcagaggaagcctgtggatgaagccctctcttgtatctccagacttttgcaacccagaagagccaccaccccaggagacttttgcaacccagaagagcactttctcccctcccaccaatactctcaagaggggattctggaaggacctcagtatttaggccattttagcgaggaggccgtggagaagggacctgattactcaggttgcagaatggaatgctcctcagcctgcatcccctttccctcctgtctctagagttgttcagtgcatgaccctctctcaaccaatctctactccttagcccagtgttcttgggatggtggaaagggaaggcgttttggagtcagaaagatctgggttcaaaaccagctcttccactttctacctgagagaccctgggcacacttagcttctctaagcctcagtttccacatctctagaatggagaagatagtgcccactttgcagtgtggcagctatcccagtgcccggcaccacacaggcactcactgatcacctgacctctcattcctgctctcaccaactggctgtgtgactttgggcaggactcattacctctccctgtctcagcttcctcatctcaaagacagggttggatcccacagtcttgaaggccccttctagctctgacttgctcggttctattctgagcagggagccccacctctggggagggggaatacgaacattctttcagcacagattcaacccaggcacatgcttgcccagccccatccctcacatttagcctgtagctattgccacatgggccgcacccttggcactgccctgctccccccacccccgcctcactcgccagggccacaggtgggtgggttgttcttgtggaactgaaggagcctgagaggacagacgaagagggtgggagagaagaggaaagagtggaggggctgcgggggtagccaggtgggaagggcggggctttgagcctggtagaatgctagctctgtcactttctagcggtgtatgtccttgggcaagcggctttaacctcttagaaacctgtttcctcgtttatgagctaataataataacaattttttaaaaacccattagatcgcagtgaggattaaatgaaagaatatctgtcaagtgcctggcactgtagcgttctgttctggggtggggggaggcaggcacctacacccttccctcgacccgggtagggggaagttccacgaaggcccgtgggggcgccttggccaccttcccgcaggcgaacccgagccagagaggcccacagtcctcgccgcagccggagccacctcccgagggctgtcggtctggggtccttggcccgggagccccagcccgcagagcaaggggaaggctgcggcccgagccggcccccgacccacccgccccgcctcggcctcgtacaagcacctttgatctgcaaccttcagggggattaagagcctgagagcccccctccccggggtaccccgctccccaacgccctccctccgggctgacctcccagtctgccgcccgggccgggggccggctccgccgccggtggtccccgccgctcctggcggccgcacctccgggcaggccacttggattacaggggcagcagccgcggctggcggcttcggggagccccggggctggggcccgcgggcggggcgggaggggaggctgggggcggcgggcccctcctggccattttggccggggaatctgtgtaaagtgtttaaaaagaaaaactctccggaggaggacgtaaccttttcttaacatctggggctcaattagctaatgacagcaaagccttctccggtgtcgctgacccctgggcggcagcccagctcccccacccccggtatttatacagctgcggcccctcgctgggacggggggcagggggcttgactgggttatctctgcggagatccgccgcccaccccaaaaaggagaaagaaaaggcttagcacacggtcccacccaccgcccctcgatcctccttgttgcccctcggtcctcctcgtcgcccctcactctttccctctctccagctcttggcgctgcctctgctttcctgcccctgggcttctctcctctccctctcccccattttctactcttcctcctttctgctcctctccacttctcttttttacctctccctctcccctttctcccgtttcttcttcatctctgttttgtctcttgttcctgcccagctttctcactcctccctctctctccccctgctctcctccccttcttgcccaccacccccttgcctgcctgtctctcttttcgcccctctttctctgtcttttctctctccctggcggcctcccctctctttctgactctctgaatagctcccttgttccctctctgtgttcctgtctatccctctcattctagtgcttcctccccacctttgtctctccctgtctcaacctctgaatgcctgtctgtcctcccagaggtgtgtcctaccctggctgccaggcaaatacccccaggggagcagacctattgctgggccacctccggaccaagcatcctttcccgctgagttgggcaggcctgtggctgggcactgcagggctgactccggatcctgggtgtgggaggtgtgggagagctgtgtttaaggctctccatggctagagccagaggagatccccaggggcttccctagaaccctccactccagctggtggaacctcgccttccctggaggctccttccctgccactccacccatccccaactcccccaacaccccgtgcctggtattttgaagcccggcacaagtgcagagacacactttcctctttatcctccctgagcgcagttagaacaggctggagtcccttaaaaaaattcaccaatattaagaaaaaagtgataagctcagaaactataaatagcacaaaatagtcatgtccaagggcagcgcagagcagcaaagagcacacagtttggaatgaaaggagctggattcaactactaactccatggtttaaacagttctgccatctccagggagtcatttgagcctcagttctgtcatctataaaatgggcataataatcgttattaaacaatattgaaacattgtgttctttcattaaggcatttactttttgttttcctggggaaaatcttggactctgatttttccaggatacagctgtgttccaaaattctacctccttctcctccaaatacacttgaagctctcgcaccattgctgacccctcttatctaagggtgaaggcttttcgcagaaaaacgcaaacataggcaacatttgcaaacaatgggttgagggggaaggcgatcctagagctcctgaaacctttggttgatgctgggtgggaccctgggctcactgcggcgggtgctttgtgaatcctcacaacaaccaaacgaaaagggtcctgacgtcctgttttacacttggggaaacggggaagcaattgtccaaggaccacaaagcggactaggaacccagggtctcgcctctagagctttggggaagtgggggtttctcccagcgggtaaggggtagaagcaaggtaggtggcttggaaacgttcagtagtcggacctgggccacggagggcacagcggccactctttctgagaggcagaggtcggtgggctccaccctcccactccgagccggcctgaccctcggtgcaggcggaaggggggccgcggggagcggaggacggtgccgaggcctcgctgctgctgcagcgcccccgccccgcgtcgcctcccagccctggctcccagtgctccgggcttgctgacggtacagggtggacagccccgagacattttcatcagatctcgtctcccgcagcccagcgctgctgccgggggtcggacagggccgatcccagcacccctcccccgagccctggctgggcgagaaaccgagatggtggctgcagaaaccggagcccccgcgccggggcgaccgcgaggggccgaggcctttgagagcgctgccgccccttgccaaggtcaatcaaaccctcccacgctccggaggcgcgcgctgcgtgctctaggcagcggggattggggccggaggggcgcgtcccggcggggccgggcgagggtgggtggggggtctggcctggggggcgcctcccgccccctcttggggaaggtgctcggagactcccgggccctgggcggagagtgtggggaggctgggctaaaggcagagacccaggccgagggctctgacccacccaagaggaaatagctactaattagggacgggacgtttttatgctaatatgcacctggctgggcttttctggaggctgagaaagtgtggagtggaagggaagaagttccggagagcgggaaacttccggaagcacttgattcctggataaaagacaactcttgctctcctgctcacccgctgtgtggccttggggaagttacttagggacgtgtaggagcttcagtttcctcctctgaaaaagagagaacacggtcaagtttcttcccaagctcagtcactctgtcagcaaaaagatggaaagccagccctcgggtggctcttggaggatggaaaggggacagaattgtgggaggtgtgcgtcgcgggacagagtcctaggagagccgggtgcacactgtcaagggcctgcgactgtcttcactgttgcccagaggtggagagtgggcagtagagggaggtcgaacagaggtcctccgattgttggacggagtgtcaggaggtgctccgctgtaaaagaaaatgggaggtggatggggagtagtgtagaggagtgggtattctatggtgggaccgacttgagcttaatcatagagttggggtggaggggagggtgggttgaagatgccaaggagagaaaagggagatgactgattgagtcaagtcctgaagaaggcctagtgggtgggagccaggcagggtgcaggttggaagaagtaggagacaggttggaagtggggaggaggaaggggagaggaggaagtggtggaagaggagacgaagaaagaagggtgaaattcagggtattttgaagggagggaacaccctccattggccttactcaactcagctcagtattggaggaggcctcggtgttcttcacagactaaagaaccaagagcagatttgggctgggcacagtagctcatgcctgtaatcccagcactttgggaggccgaggcgggcagatcacctgaagtcaggagttagagaccagcctggccaacgtggagaaaccccatctctattaaaaatacaaaaattagccaggcatggtggcgcacacctatagtgcgagctacttgggaggctgaggcaggagaattgcttgaacccaggaggcggaggttacagtgagccgagatcatgccactgcactccagcctgggcgacagagtgagactacatctcaaaaaaaaaaaaaaagagtgcatctggaagaatccaccatggagactcaagcaggagtagggtaggttggacagaaagggctgatgagcagggctgccactgagggtgggttacaggaatttgaaagcaaagtaatagaaacctttgagctcatgggaaagggaaggcgcttactgagattgacttgggattcatggtctcactgaattctcaccacccagtgtggtctgtgttatttccattttacagatagagaaactgagggtcggagcagtaaagaaccttgcccaagatcattcagctagtgataatgagatgaaagaatggtttgaacccaggtctgtctgctcccaaaatgaggctgcttcctgtggggtcctctgggcaagagtcctgaccctggggccttggcagtccttccctccctgggtgtggccatcctgggagcactgacccgtttggctggaaggaaggggctgggcattctcaactgagtacaggctgccctgagccagcttgaacttagcaggaagcccccaacccagctgagaggagagggggaaatggtaggctgtgccaccaccaagccaaatgagatcaaaccatatattttattctgcaacatgctatttttctcttaatatttccacgcttatatatataggcctattgtttttaagttgtgtactactcctttgcataaatatttcatttcttatttatctattcctctaccactgaacatttgtgttgtctccagtcttggaattacaggtaatgcccactgaacatccttgtgagaatatctttgtaatgacacaagtgcttctagaggatagattcttaaaaatgacatcaatgggttaatggtatgcttgttttaaattcttatagatagtactagacttctctccaaagatgctctatcagtttccactgcctccattaaactatgagtgtgcccacccactgacaccctcgctactactgggtattctctctgtctctttctctctccatatagataagtttggggtggggggcaatctactgaatgaaaaagagtttttcacttttgttttcatttgtattaccctgagtctctacagctctgccaaaggtccactagctgaagaaagcattgtgaagaagcgaagaagagcccaagacaagtagcagcgatttagggcagctctgaggaggaacttactctgtagataacggaggcacccgaattcctttctcggtgcacattcttatactccaaggaggatcgcacgaccccagtagctcggggtgacggctggctacctagagtctcatggcagtcagccagacactgagtgatgcccactccccatgggctgcagggacaagctaacaggctgcatgggacagaagatggcagttttcagggagggcagaggaatgggttcagctttctgaaagaaccagggaagaagagggtcaccatggtggggcaggctggccctgggtactaaatgaaaacaggaaggtcagtagtttgaggaggtggcagatgggagggaacgggatgccaaactaagcttagcaaaggtgggactgggcagttgtggccgcacttcccccgtcccataggcatatccaccccagcctattgatgataataacatgactcatatttttgagcctttactgtattagactattagacactgcttttttttgttttttgttttttgttttgttttgtttttttcagacagagtctcgctctgtcacccaggctggagtgcagtggcgcaatctccccacactgcaacctctgcctcctgggttcaagcaattgtcttgcctcagcctcctgagtagctgggactacaggcgcacgccaccacccccagctaattttttgtattttagtaaagacggggtttcaccgtgttgcccaggctggtggcaaactcctgagctcaggcaatttgcctgcctcggcctcccaaaatgctgggattgcaggagtgagccattgcatccggcctagatactgctttaagtgtttcaatattttgagtgactttatccttttaacaattatgtgagataactgtaattatgatccccatttcatagatgaggacatggaggcataggcttaagttgctacccaaggtcacacagctagaaagtggccaagcggggattcagacccaggccagggtcttgagaatccacacttctaaccacctcacatgtggcttttcacagccttccttagccagtagaattaccactgccattaattaagagtggaccaagaacattcaattctttgtttctaatgcttacaaggcttgaaatagaaggtgctaccctaaatttataggtgagaaaagtgaggttcagacaggctgagcaccttggctaagatcacccacataaaaagaagttgagccagactttgcactcagatctctatgaatcaaaagcccctgccccttgcatatcactacaggatcttttgcaacatgagaaaggaaatcacacaatcacagaacagtcatccccccaaaaatacctctttcctgtagagatgagtgtgtgtcagggcagcctggagggagcatctgtgcactgtgtggtgggggaaagtgggggcaagggggaacagtgggctgtatgcagtgctgtggagagaccatctcccctctatcagcagggctgactgggaagcagagtggcagtttgggagggaagtctggggaagccatcccttttgttactggaacctagaacctctctccacccccatccgctccatatccacctccagcttaagaaaagcatgagttggtatcctggaaagagctgtttttgaagacccccaagtcaccctacaggctgacccaagaaggactgccatttcaccttatatgcgttacctgttaaattaagcatcgtctctttctttccttctatctttctttctttctttttttctctctctccctcttttttttttttttgagatggagtctcactttgtcaccccggctggagtgcagtggcacaatctcggctcattgcaacctctgcctcccgggttcaagcgatcctcctgcctcagcctcctgagtagctgggactacaggcacatgccaccacgcctggctaatttttttgtatttttagtagagatggggtttcactatgttggccaggatgatctcaatctcctgccctcgtgatccacctgcctcagcctcccaaagtgctgggattaccggtgtgagccaccgcacctggctgtctttctttttttaatttttgagacagggtctcaccctgtcactgagggtggaatgcagtggtgctatcatagctcattgtagccttgaactcctgggcttaagcaatcctcctacctcagcctctggagtagctgggattacaggcatgcactaccatacctggctaatttgtaaattttttgtagaaaggtctcgccatgttgcccatactggacgcattgctctttctaagggtatatgtaaaagtgcaaattgcccttggacctagcaacatggtgaaaaggatgtatcagtcattcacaccttcctgtgaattagtttctcagccaggacagtgtttctcaaactagggtatctactttcagagttcctaagtgctctgaagagttttaaattttggatgtaaatttcaatgatgttaaaatattttagcagttataaagacagaactctttgcagttaaacattttcatagactagaacttcagttccttacgttggcgttgctccagtatgggtctgtgaacttctgggaattcacagatgggatctgtgagaattgcttttcctttcaagaggtttgctcattacacgggtttgggagacacttcgcaagaactagatgggtgtgagccttttcagccccagtgccatggttgccaaggtgctggggacccagagatctgggttctagccttggtcacttgaccactggtgcctcagtttctccacttgaaaattcactcactcttttccactttgcagcgtcctctctgtcaggcctgtgctggctgctgctaggggtaggagatgaacaaggccaagctggtgaaggtgccaaacgtggcacccttctgtctgacaattcaaggcagaggggagataaaggctatgggggtccagcagaggaagaggtcacttctgcctgctgggtgcagtggggctttgcagcagaactggctttgagctaggccttgagatggggccacagcaggcaaggaggccagccctccaggcagagagggtgggtgaagcggaccggctgcgacaggcttgtggggagagtcagggtgtgatgtgtatttagggaactggacctgtagccaaaggacctgagagatcatctcagccaactctttaggatttaggggaatgtcaggaggctgaattggctcaagggcctcgtcaagatcacacagccagctgggggccctgctgagaacaaggaggtaggcaagatgtttttccatctggagctgagctcccagcctcaggaatgtttcggggggtccagcccatgttggcaaccccctcttccaccacccactccatgaagcctaacacaggctctgcaacccaccgtctctcctgcccccaaggctactgaggcccacagacctggggggcgttttcatctgattttcactcaaggaaacagccacatcctgacggaagccaagttggagggaggtctttagctcacccttcccagccccctagttcttgggggttggggcggggctctgatagccttcagttaacaggggaggaagcttccaggcttaggcagacagcctgcctccaccaagccccaggagccttctcttcttggctgtgggggactctcaggttgggcccacccctttgggtctagagaaaagtctcccctcacacaggcctctcagggcccatatctagtcatcctgtgtgggcagagaggggctcactgccccaggactaactggatagtgaccaccagaacgaggctgggcccaaaatcttgtacccgcttctctcagctaagacatggaaagaacaggctagtgtgagcggccatcacagatgccaggcaggagggctgtgaagcccagatttaccatcgctagcctgggtttgcttgctgctgccatgaccaccaccgaccaccaccattgtcacatttccgtttctaccaccatcactgtttccatctctaccatcgctatcttcatctcaaccaccctctctgtctccactattatcaccacctccacacccgccaccatcagcatctctatcaccatcatctccacctcaaccatcacctccagctccaccgtcatcactatgcaccgcccctgccgcctccaccataaccactgcttccatctttactaccatcaccaactacctccgccagtatcactaccggcatcttcatccaacaactgccctctctgccatcatcaccacctccaccagtatcactaccttcatgacaattatcaccaccatttctaccaccactgcccctcttacctcccctgacacgtctaaccaccgccagcacagtaccccacccaccccaacctctgtccattcgaatccatccatgctacctataacataaagaactgccatttgggctaacccttcaacctcttttcatttgcccaaccccagaaaggccaactatagaccccatttctccagtttctcttttgagacttctcttggaagatgaaatgaaatgccttgctcttgaagttgaggaagattatgtgtctcttgccgttcttgatttaccaggcccaacattctgtcctagaaggaaattggattactctgacagaatgtattctttggaaagcagtgctggttattacctaattccttatgacctagtgtttgcagattgattttttgacgacgtgtcccagtagttttctattatagcagtttggtggataggcccagcacttgcagaggcatctgctttcccccaggtttggaaagaggcagggaccggctgcctgggtctcttgtctccaggcccctcaccagttctccataaatcccctcagagtgagagctagtgattggattccaatgtgggccaatttcttaagtacctaagcatgtaagtcatcagggcctgtggatgggaatacacaagttctttccttatccccctggcttcctgcctgctcgtgattccacatggtgcctctttcagttttcagatcacagctgacctttttaggctaagaaaaaattaaaaggctctgctttttcagtgtcgttgcttataggctttctctccccagcgaaaaacgtgccagcaatccccttatcccctttctttggcccattatagttagcaaatgtttttctcattcttttgccgccttgtgcaagttatatcccatttcttttctgaacaagttttctgattttatctccacagccttttttttttttttttttttttttgtatttctttgtgtgtacccctccttcggaacctgccctaatttccactttctttggcttgtccgttatcattttagttctccgggaagctttctgcataactaacatggaatcgctgggttccttttagctgctttatgcatcgggatagtttcattctcttttcctaattttgttgccttatgtggaaatgtccagttctccttagagagtgcccatggttcttaaactttgtctttgtgtttttcatcttgagtctcaaagcctggtgcagaacgctttcaggaagggccaatatctggatcttgtttgagtttctgcttttcttcctttctctcagatggtgctagcttttctcagtgctcccttccattccccagtcttttttttttgagacagagtcttgttctgtcacccaggctggagtgcagtggcgcaatctcggctcactgcaagctccgcctcccaggttcatgccattttcctgcctcagcctcccaagtagctgggactacaggcgcccgccaccatacccagctaatttttttttgtatttttagtagagacagggtttcaccatgttagccaggatggtctcgatctcctgacctcgtgatctgcccgcctcggcctcccaaagtgctgggattacaggtgtgaggcactgcgcccagctccccaatgtcttcagtttgtgagtagcaaaccgagtcaggacctgctccccaaggcctcacaaaccgggcaaccagaatggggaggggaccagcagctgcatttggcctctgatacccagagtgtggatggggtcacttaccaggagtgtttggttaccataaggggctccttccattcacagacccatttcctcgttctcagactccctcattccctcattccctccagaacctctgtgttagtctggggtcctgcccgctgtgggctcacggggcacatgagccttcttgaatattaggtcaataatggcctggtgcagtgcaccagctagtaatatacacagaaatcaggttaatgacgtagaaggtggtgagtgcaaggcctgtagacagtggtgtgggagcgatgcgctctgccagtctactgcaggaggctgctccacaaaagccatattccagcagggtctttacatttaggaatgtgtttgccaggaagggggatgtagaggagcattccaggcagaacaggatgtgcaaatgcagagagggccatctgggactggccacgtcaggcaaacggagtctccaaaccccatgaaagcctgttgtctttccaaccctccactggtctggatggatcacgtcaagatggctctgggaagggccctttcagtgcctccccaggggcgcccagtgctcccagagccacctgctgtcagctccaaacttgcctgttgagtgaaggctttctccatccagcctggccagtgctgactggaggctccaaacctagtcccttcccttcccccatggctacgacaatagggacgctctgaatcttccctgcactccgccctgttttcttccccccagcatccagctaagcatcctctacattatagattcaattttttacgtctagaaaaactagaaaatacagagtagtaaaaatgttaaaatagcttcaaaaagtatgcatatgccgggcacagtggctcacgcctgtaatcccagcactttgggaggccaaggtgggcagatcacctgaggttgggagttggagaccagcctgaccaacacggagaaaccccgtctctactaaaagtacaaaattagccaggcatggtgtcgcatgcctgtaatcccagctactcgggaggctaaggcaggagaatcgcttgaacccgggaagcggaggttgcagtgagctgagattgtgccaccgcactccagcctgggcaacaagagtgaaacttcatctccaaaaaaaaaaaaaatgcgtaatcccatcattcagagttaaccttgtcaacatttcgatgtatatcctcccagatgtatcatttccttttacaaaataggcagctgtcacgggcatcttttagaagtatgtatatatctggcccatgattccaaacagcttcgtagtactccactgtgcagctgaaccatcacttatttaaacctggaagcttgatgaagggcaccgactgaatgaacaaaaatgaggaagggcctttgtagattcctcttctgcatcttccatgttcctttggagccagtgttttgaatgtatagaaagtgcgctggtcaagatgtgagtttgaatgcaggctctttcgtccgtgtgtgcgggtctcagatctatccacacatcttgctgagcccatcctgtttggcatttttgcgcattgaacacaactgaccactccccattatttacctcttcttccttgggcctcagacgatgtcctccagcccagcacttctcccatatttcgcctttccttcttagtttctggaactggaaacttttctcctgaccagcactcatgtcagtaccctccaggcctctgttcccggcttcctctctgcttcttcccaccttgtcatattcagtttgtttcctttggatgacccatctagttccatagatttgagggccaaactctccctggcccatctctcctgaaatctgcatccacatagtcaagggcctaaagaacatctccatcagaaactcaatgatgtggctgggcgcggtggctcacgcctgtaatcccaggaggcaggaggatcacctgaggtcagcagttcgagaccagcctggccaacatggtgaaaccccatttctactaaaaatacaaaaattagccgagcatggtagaggacgcctgtaatcccagctactcaggaggctgaggcaggagaatcgcttgaacccaggaggcagaagtttcagtaagccgagattgtaccactgcactccagcctgggtaacagagcaagcctccatctcgaaaaaacaaaaagaaactcaatgttgccacatctgagctcactttttcttcccccaaacttcttcctcttggggtctctgtctcagtgactgcctgtcacctaagccagcagccagaagctgtcttgagtcttttgccctcccgcccctacctccatatccagccccttaagcagccttattcctgatggtaccagcaccttcctccagccctgtcctactctgctccaacatctgctatagccaggccatggtgtcctccttctgggtgacacctgcagccttctcaattgttccacacctttagattctcctaccatccatctaccaggatacctttttaaaaattgaggcattacttgaatacaataagatgtgcatattttaagtgtacagtttgatgattttttgttttttgtttttcagatggtgtctcactctgtcacccaggctggagtgcagtggcacaatcttagatcactgcaacctccccatcctgggttcaagtgattctcctgcctcagcctcctgagtagctgggattgcagacacccgccaccacccccagctaatttttgtatttttagtagagacggggtttcaccacgttggccaggctggtcttgaactcctgacctcaggtgatctgccctcttcagcctcccaaagtgctgggattacaggcgtgagccaccgcgctcagcctgatgaattttaataaatatattgcatccgtgtagccaccaccccaataaagatagagaaaatttccattatctctgtgaatgttccttagaatccttttcaatcaatcccctttcccatgggcaatctctcttctgatctcttccctagattagttttgcctcttctatagaaattcttacaaatggaatcatatagtttgcattgttttggtcagcaaaatgcttttgagattccttcacattgtcatcacaatcacttaaaagtgagtatttatttaaattagtctcctattaaaacttttcattggctccccgttatccaaattccaggcccctgaatgatctggactcatctcacacactgcctacccttgaactttcacctttaggaatactgagccatttgttcacctgcacaaacgtagcttttcatgggttgagtcctgcagctggaatcccttaactcctacacagtttgcctggtgcactcctactcatccggcagcattccgctcacatgtagattgtgtgaggctttctctgacctgttcccacccccaggacaaagagtctgtcagctgcactataatggactgtgtccactattctcgacacccagaacccctgccctgcatcaactgaatggattcctttctcggtgtgagtgctgtgtcttgcatgtcatttatcattgtgcccactgcactgtatgtgtttatggacttgtgtaaccccttagctatgctcacttagctatgctcagagggatagaaagattcattttgtttccagaaattcttcccgtggaagacagtcatgctgcctacccaagagcctacccaagaagtactccactgtgcaactgaaccatcagtcttgtgcaacaagaagcaagacaggcggggcatggtggctcacacatgtaatcccagtactttgggaggccgaggtgggtggatcacctgaggtcaggagttcgagaccaccctggccaacatggcaaaaccccatctcctctactaaaaatacaaaaattagctgggcgtgctggcaggctcctgtaatcccagctactcaggaggctgaggcaggagaatcttttgaacctgggaggcggaggttgcagtgagctgagatcacgccattgcactccagcctgggcaacagagcgagactctgcctgaaaaaagaaagaagaagaaggagaaggagaagggggaggaggaggaggaggaggaggagaaggagaagaagaagaagaagaggaagaagaagaagaagaagaagaagaagaagaagaagaagaagaaaagaagaagaagaagaagaagaagaagaagaagaagaagaagaagaagaagaagaagaggaagaaaaggaagcagcagcagcagcagcagcaagatggaaggcggaggttgcggtgagctgagatcacgccattgcactccagcctgggcaacagagcgagactctgcctgagaaaagaaagaagaagagggagaaggagaagtagaaggaggaggaggaggagaaggaggaggaggagaaggagaaggagaaggagaggaagaggaagaggaagaagaagaagaagaagaaggaggaggaggaggaggaggaggaggaaaaggagaagcagcagcagcagcagcaagacagtcttgctgcctacccaagaagactgctgggtcttcttgctctctgaagcagagaaatcagcagtcttctttgctaacagaccctgatcttgttcaggcaaccacgtgcctagagatagctttgccagtgatcagttgaggagtggtataattccggccaaggagatgttaagaggacatcttctgggaaagctttttcttcctgaaaaaaaagaaaccagaagcaaatgctccattttatgccttcctctttcctcttatttgggacactattgtgtgatggtatgatgtttggagttgtagcagccacctggtgaccatgaggcagagacgaagaagagtgcagaaacattgatcccgaaccctggcatcagtgagggtctaaacacccctccttccaacttcccattatgtgaggtaattaaatgactttactgcttaagacacaattagttggattttctgacatttgcaattgaaggactcttaattgatatattttgtgagtaaactttttattttgggataattgtagaaactgtaaatcttcatgagattataaagcacttgatgtccagatgatggtgcagacccatctggagctgtcctctagcgtggccgtagcatgtccacttagagtgtgcctcagggagcttctgccttctctccttgttcctcagtcttcggacctctcaaccctcccttaggaaaaagaaaagggcttcctcctctgggcctctgagtcaggctgtcaatcagtccattccatccagctttaccccactggagtagggggagaaggcttcaggtcccagattatcttcttaacaacccatgaaaaaggcattgttgctccattttgtagaaaaacttagtcatgttagtaaaaaacctgatcaagatcgcacagtcagtaacagaggagccccacaacctggtcttcccaaactcaccatctttatacctcaaaatgtgacctcccttgggcttaaatcatgtcagtatcaagcaggtggtgtgcacgttgctttggatggcagccatgaaaatgccccatcagatctcctactgctgggagtgtcatcgaccaaggccacggctcctaaggccatgcttcccatgggcttcctgccacccaaggctgagcacagcaggggcgctaagacaggaccaatcttgggagatgcagggctgctctgaggacatcgttagctcaaggactcccagttggtttgaccggaactttcctagagctgtgctgagtctgagactttgctcatccaaccctccttccttctccctcttcctggcaagggtcagacccacagcctggtctgaaagttcccgcctctgctggctcatttcccttttcccctcgcagatattttccccagtaaatctcttgcatatctaatcttgtcttgggatctggcttcttacaggacctgaactaatgtgctttgatttttaaccctccaaattcaacctggcaacctgtctgtaaagcacctggcacatactaggttctcttctcttttcctctcagagtgtgggtgttaacagtggccatgctgtgaggctgtttctgtctccagtgggagcaaggtggactgccctgtgaccaggagaatatgcacataccagaaaacctatgcctcctgaggttcagagaggctgagggactcacccgaggccacacagctcatgcctgagtgcccacacagatacacacacatgcatgggatggggagacaaagttagggtggagagacagggtcaggatgtagtgtggggcagacaaagggcacgaggaaagcagccccttcctgcccctccctgctgacttcccaggctggtctgtatgttttggtgtcatggcaactggctgtgggggctgtacgtggaaagtgaagcttaaccttaagacactgtggggagctaaatgagcctaaaagatatcaggtccatgattttccagcctcccagccttgctccagcctggagatactgccagcccatgccagccctcggtcatcaggaaatgcctttctctacttactcttactgcctatcctgcccattgggctcacctgcaatcattatactaactctgactctggaatcctctcttctcttcttgtttgtctaaatcctctctctctgtcagggccgagttccagtcccacattctctggaagccttccccggtttccctagcccatgtagctcttttcttcctctgatcgcagctagcaatccctgcactatctggagcactcacattatggcatttcaactttgtctccacgcaattcaacaagctcctcatatgggctggacatcctgctgagtgctgtatgttcctgtgggtatcttgggggctaaatctactctaggcttgttagacttcggacaggcagcagctgaccatctagcacttatggaccatttatgacaaggagaggctcccatcagctcccaaactaggcaagacagagggtgcaggtggtaacttgttagagccttggactcggagtccagacaggccactgtctgagtcttgtttttctaagctataaaatgaggatgacagtacctacctcacagacttgttctgaggacaaatgatatgatgagataatatatgtaaagtagcaaacacagtaattgatgtgcttgttgtttgctttttccatgccagtggcccctgcctccaccccatagcccctgagtctacctaaatacaaacactgtgttccctttggggctgttcaaagaactccctgtcttggattgtagaattaaataggaagaggcttgccctctagaagctcaccatcaggtgcttctcacgcttgctctcactgaatcctccgccaactctgggacaggaaatagtattcctgtgtcatagatgactgagccggggctcagggaggttgagtcagactcaggcctgagacagatgataagccctaagcaaacaggcagccattgggtgagaacactttatactgtgcaggtgtcagctctgtccaaataattctttaaattcaaaaagtaatgccaggcaaaatcacaacagggtttttggggcagggcgggggagagatttaacaaggccattctaaaacgaatctggaagagtaactgtgtcgcaataaacaaaaaatatttgaaaaaggagtacaatgaggggagacttcccctatcagatatcaaaacactaccaagctgtactctttaaaatcgtgtgctggcctgagacaagacagatggatcaatgtcactgaacagagagctgaaaaaggggttctgcattaagaggaattcagtgtgtaataaagtagcatttaaaagcagcagaacaaactttcagttataagatgaataaattatggggatctaatgtatagcatggtgactatagttaattatactgtatggtatactagaaatttgctaggaaaatcggtttttcttttgttttttattttttattttttgagatggagtttttctctgtcagccaggcttgagtgcggtggtgcgatcttggctcactgtggcctctgccttccgagttcaagcgagtcttctgccttagcctcctgagtagctgggactataggtgcgtgccaccatgcttggctaatttttgtatttttagttgagatggggtttcaccatgttggccaggctggtcttgaactcctgacctcacgtgatccgcccgcctcagcctcccaaagttctaggattacaggcgtgagccaccatgcctggcccagaaaatagatcttaagtgttttcaccacacacacacacacacacacacacacacacacaaaggtaactgtgtgatgaacgtgttaattagcttgattgtggtaatcatttcacaatgtaatgtatatcaaataatcacgttgtaggccttgaatatatacaatttttatttgtcaattagacctcaataaagctagaaaaaagcaatcgggaaaagagggattcttcagcaagtattgtagagacaattggctatccttgtggaaaaaaaccataaagttagattcgtgcttcacaccattcactgaaataaattccagatggattagagagctcaatgtgaaaaaaacaaagctataaaactattaaaagaaaatataggagaatttgtttataaccttggggtaggaaaggcttcctttagcaagacacaaaacacagaaaccataaaggaaaagattgctaaatttgattatgtccaaattcaaaactggtgtataacaaaagacgctgtaaatactgttaaaagacaagtgacagactggaaggtatctagaacatatgcaacagaaaaagattaatattcaggatctgtaatgaattcctacaataacaagcaaaagataaacaaccccaaagaaaaaatgggtgctgggaatggaatagacaattcacctaagaggaactgcagatagtcaataaacatatgaaaacgtgcccagcctcactagtaatcaaagaaatgcaagtaaaaataacgccaagttaatggttttcacctgtcagatttgcaaaatttaaaagagatttgcgccgggcgcggtggctcactcctgtaatcccagcactttgggaggcggaggcgggcggatcatgaggtcaggagatcgagaccatcttggctaacacacggtgaaatcccgtctctactgaaaatacaaaaaaattagcctggtgtgatggtgggcacctgtagtcccagcaactcgggaggctgaggcaggagaatggtgtcaacccgagaggcggagcttgcagtgagccaagatcctgccactgcactccagcctggaggacagagcaagactccatctgaaaaataaataaataaataaataaaataaaaaataaaagagattggcaatggccacggttgggaagaatctaagggcaatgaataccttcgtcaccattggtaagaatggaaattgtcctggcatttgcagagtgtgatctggcggtacctactaaagtggaaaacacccaaactcttcgcaagagcaattccaaatctctgccgagagaaacgctccaagtgtacaaggggccgccttcacttcgggtcgtggcagtagtgatggaaatgtgaacaatcagaaacaactgaaatgttcctcggtagagaaagggccaaatacatctctgttgttgttgttgttgtcttttgagacaaaatctcactccgtggcccaggatggtgtgcaatggcgcaatcttggctcactgcaatctccgcctcctgggttcaagcaattctcctgcctcagcctcccaagtaggtgggactataggcacgtgccaccacacctggctaatttttgtatttttggtagagatggggtttcaccaccttggccaggctggtctcgaactcctgacctcaggtgatccacccgccttggcctcccagagtgctggtgtaagccaccacacccagccctaaatacatctttgaatgtgtacactagtaatgattttctggggaccaagcaatgagagagacctttatatcctgaaatgaaaaggtctcattacaagagaaaaacaggtcacaaaacaatatggatctgtttgtataaacatggatgcgcacttcacaaccgtgcatgagaaaagatactctagaaggtacctaccaaactgacactccctagggaggcgactgggactgtgtgagagccaaggggggctttatctgaactatttaacttttttacagtgcgtatgtatatgtgttgtacttatgtaataataataatgcatttaaaataacttgaaagaccagctgtcactcaatgcctggcagctttatgcctctacttctcaagccctactcactgccggtgccctggacctgtaacttagatcctgtgccttgttcctgattgtccccatccctgacccctcgccacctccatcatactaggctcttagtctgggttcttggcctgtgccgtgtggccttcttgattcctggtgcctatcatgggttgggaataagggagaattggacatggtcatatggccccaggagagtacatggtccagcaaaagaagaacttcagaggccgggcgcagtggctcacgcctgtaatcccagcactttggaggccaaggcaagtggatcaccttaggtcaggagttcgagaccaacctggccaacgtggtgaagccctgtctctaccaaaaatacaaaaattagctgggtgtgctggcgtgtgcctgtagtggcagctactcggaaggctgaggcataagaatcgcttgaacgcgggaggcagaggttgcagtgagccaagatggcaccactgcactccagcctgagcaacagagcaagactccatctcataaataaataaataagtaaataaataaataaacaaacttcagaaaagatgtggttggaaaatgcaaggaaagcttcctagagcaggtgacgtttgagctgggacttgaaagcaggataattttaatcctaaaccccacctcaattatgttgaaaactacataacaccatcacagaaattttgaataatggagagaaaacaattcacccataatttcactgccctaacccaacaacttttgtaaattcccttcaattctttgtccacaagacacttatcatttaagtatacaatccaaataatacatttgattatatatatgtgtatatatatatgtgtatatatacatgtgtatatatatatgtgtgtgtatatatgtgtgtgtgtgtatatatatatatatatacatatacacacacacacacttttcttttttttttcaagagacagggttttgctatgttgccaaggctggatttgaacttctgggctcaagtgatcctcctgccccaggttcctcagctgggattacgggtgtgctctgctgtgcctggctggttgttgttgtttagtataacatcatatcacagcctctttttacattactaagtgatatgtatcgtcatcatctgttaatgactatggaatttgccatccagtgagtgtgcttctgatttaattacctattcccctattgttggctgtttaggttgtttcttattactaatgctgcaatgaacatccttgagcatgtagggtctttccccccccgcttttaggttatttccttggaacaaataaactctcagaagtggaaatactgggtcaaaatttatgaacacttttatggcccttgaaacatgttgccaaattgcttctaaaagtagtttcagaatacactgagggctttgttaggcaaatatgagaggtatagaaattgaatgggggtcccaattccaagaaacagcatgtataaaggtgcattgaccaggacagacttctgcaatttatcctttgaataccatgacacggccaagatgtagaattttatggcagattctgctggttggcaaactaagaagccgttcacagtctccttctttcatgttattctcccaccatagaaggtaaaagccagataatctcttgcccagcttcttttgcagctaaaagtgaccatgtgactccattttgggctcgtggaagaattctttccttcctttcaggtttttaaccagtttattaaatctttgaactaggaagttgaaggtttttaatatcccaattaaaggggaaaatgtcattgatgccatctctctttcctcctcctgccctgaatgcagatgtgatgcctggagctgcggcagccacatgacacctatagggttggacaagcgttagcacaaacaggcaacacaggagggtgagagaaaagagacagaaagaccctggtttcttgatatcaccatttgagtggctgaatcaataccatcgacctctaactttttattatgtgggagaagtatttgattatttgataatcattatttgataattgggggggtaattatcctccctatttgattaaacccttgttagtcagattttctgttacttgcagtcaaatgcttcctaacagaggcaaggctccaccaccttgccctgtctctctcagatagcacctgggattcagattcccgtcctgatagagtttaagttttctctcggaactggtgacttggatttccacagctcaagacatttaccacctgcccacctgtagtgtgggtggaatcctctttctgatgctggatgctcccaacagccctcagagtctgagagctgcttctatagtccctgagccttgtttgttttttcaagagcagcttgaaaaaggaccttgtgttcaagatacactgttgctggctccctttgaggtctcaagagaattttgagccaagagtcctggattcatttctggctctttcccttaccagttgtatgttgtattgtctttttttctttttcttttctttttttttttttgtttagatggagtctcactctgtcacccaggctggagtgtagtggcgcagtgtctgctcactgcaacctctgcctcctgggttcaagcaattctcctgcctcagcctccgaagtagctgggattacaggtgtgtgccaccacacccagctaatttttgtatttttagtagagacagggtttcaccatattggccaggctggtctcgaacttctgacctcaggtgatccatctaccttggtctcccaaagtgctgggattataggtgtgagccaccgcacccagcccagttgtatggtcttagtcacttaatctctctgagtatcagtcttctcctgtaaatagggatgccagagttgctggaagatttagaactgccaatctggtaacatggtaagggcctaataaatgtcttccatttgaacactcaaagaggtgtggcaaagagcccatcacaggctgggcgcggtggctcatgcctgtaatcccagcactttgggaggccgaggcgggcggatcacaaggtccaggagttcgagaccagcctggtcaatatggtgaaacctcgtctctactaaaaatacaaaaaaaatagctgggcgtggtggcacatgcctctaatcccagccactcgggaggctgaggcaggagaattgcttgaacctggaggacggaggttgcagtgagccgagattttaccactgcactccagcgtgggcgacagagtgagactctgtctcaaaagtacataaataaataaataaataaatagagcccatcatgtagcaaaactggggatagactctagcgtgtggagcctctgtcaaggtgccttccaatagcatgtggcctcctctgtggacacctgatgctgggagtgacgcaggttctgccctgctcagaatagaaattgcagacgggggttgtccctgggcaggcaactctaggctactctggggctgggtttagcacgttctgaacaggctcccaggggaaagaaggaacgtcttcttccaggctctggggactgcagggcctgctgagaccttggtgctgctcctaagcccctggaggtagagccagacctcccctgcatccctccaagtagccagagtcaaggtcaacctgctcacttccctcccacaaagtctgcagtgtgggggtggggggtgggggtgggaagcagccccggtctctcctgcacattcccagctgacaacttgacaactacagtacccgagccaaaattaggacatggctctgtcaaaggattctttccatggctgaatatatttatttgaaagttcttatcaaggaataaaaatgaaatctgccagaggtttaatgaatcaccttaatttgaaggaacacaaatatgggcaaacagggtcatctcagacaggctgaatgatgtcaggagagacctccttctccacggctgagaggtagaagtcttcggcccaggggcagaaggagagaggtggaagggggtgggccctggtcagaagttacttgccttgaacaaattctccaaaactagcagcttttcaacaatttttgaagggattgtacaggcctattgattagtgaaaccagaatgaaaagatgtaaatggatacagtgtgaaagtgagtctggggggccgggcgtggtggctcaggcctgtaatcccagcactttgggaggccaaggcgagtgtactacctgaggtcgggagttggagaccagcctggccaacatggtgaaaccctgtttctactaaaaatacaaaaattagctgggcatggtggcgtgtgcctgtaatcccagctacttgggaggctcaggcgggagaatcgcttgaacctaggaggtggaggttgcagtgaaccgacattgccccattgcactccagcctgggcaacaagagtgaaactgactcaaaaagaaggaaagaaagaaagaaagaaagaaagaaagaaagaaagaaagaaagaaagaaagaaagaaagaaagaaagaaagggaaagaaagaagggaaggaaggaaagaagggaaggaaggatggaaggaaagaaagaagaaagaaggaaaagaaagaaagaaagaaaggaaagaaagaagaaagaaggaaaggaaagaaagaaagaagaaagaaggaaagaaagaaagaaagaaagaaagaaagaaagaaagaaagaaagaaagaaagaaagaaagaagtcagtccaggggccacagagagctgatggtgggagggacacagtgttgttttactcactcacccctgcccccagtttactggcagagcaggtcctgcacctaccctgaccctttacctgtgtaattatccagctctgcactggggggaggccaggttcctaccctgcacagacaatttccatttcccttccatagccacctgcagcctaaggcagggaaggaagggagagagcggtgtgaggcctgggaaggaccctcttctcagcagcatagcaagcttattccgagggtgtttccaccagcccagaataaggttggaacccccgtaagcctgctcatcattgcactgctttaggggacatgtacccccagtcccctcactcacctgtgtttggatgccttctggttgtgacttggcccctgcaggcctccggagaagagcccatcgaaggacagcttgtcacctgacacgaggggaagacagggggccctggttgcacatcctttttctgcatcttcctctctgatctcagtcaaggtatgtagtctcactgagcatcagtgtcctcttctgtaacagggacctagtgatttctaccctttaggccagatcatacatgcagagccccgatttctttgtctggcacacagtaggccgttgataagtagtgaccattagtatgtaaaaaccattaaggcacataaaagtataagagctaacaacaataataataattatggcaattatcctgccctcctccttacacccaggcagaaggaagccaggagggaggacgctgccgtccttccagcctgatgactgacttctcatagagagattcttgttgttcttgggcagatgggctctgactaatttccacattcactttcttcttgcatagcgccattcacacctaggagatggcttgaccttcttctcagctgggtagggtgccgcttctgccccccataataatcaggccccggaggctaccacctggggctgctgggggtgacccatcccagctgccctagttccaacggccccgtgagttctcagctgccctaatcccaacagttctgtgagatcttagcagccctagtcccagcagccccttgagtgatcccttcttgtccctctcctgccctgctcagctaaagaaggactgagctgctgtgaccccaagaaaggtgccggttggcatcgcactcagcactgacagcaaggctgagcacgctcagagggaaggcggagaaggcccccgcctcctgctcacggcctactgtctccacaggcccaggctgcacgggcaggaccgcggctacatgtctgcagcctggcttagcctctcagccgagcccctctctcctcccccaccttctcccgcctgtcgggggtagggagtgagaaggggatcttaatttctcctgcttctaatcagcaccgctgggagcatcagcctgcagggggaggaggaggtgaaaggccatgggcctaatctacaagccacccagtcaccagcgcccagcttccctcctcacaagccatggagcaaacaaattatttttgttgttcctgggaaatctgcaagtacttacccgtgtgattagcatctgtgcctcatgccggcagttcaggtgaagaggccatggctagtagcccggtgccgggccgcctgtaatcaaaaccaaagcggcggccagggtgctctctggcaacgacgatgtcaaactcaatctggccctcacctgggacagcttctctgggagccctatgcacgttgaggcctcggtagctctgaaataaatgcaggaaggggctgggaggctggggtagcccagccttcccacaagtagctctggcactccaaagccggggcagatggagggcctgaggcctgacgcactgatgcaaaagccttgggcccagggatctgcattttaagctgcattccaagtggctctgatgcgcctccaacgcttgggaaacacaggatgctgtccaggctcccctgagtcagtctagtagtcacagcgatgagcccggtttccaaatgcctacgaggtgcaggcgctttatctgctaatacattctctcattgtccctttgagaaaggtgtgaatataccttcatatagatgaggaaactcaagctcaagagaataaaccacttgcccaaagacacaatgcagggcggagagtcaaactgaggtgtgcctgcccgcaaaccctgttctagacccttctgcagagttaggtcccgcttggagctgctgtctcatgcgatgcggaggtgaagtggagtcccccgacattgctcatggactggcagccccctcggcgagagagcagagggagggaatgacacagaaagctccgatgtgtcttgttcccacctaaggggcaagctgttctcagcctcctgctcaaagcagggaataacacgcatctgcctttattccacgggcgcagaatatggcatccctacgaggagcaggaagaacaggccagaaactggcaaacagcacacaaggtgctaggactgggacagagcgcaggagctcagcatggagcccacgggggaggcactcctcgtgacagcaggcggctggcatgtgcatacagaatggccgctggaggctctccttaatatgctgggcagaggttgtacttaagtgaacccccagtgagcccccttggagactaagggccaaagctgaactcaggagcagccagcatggagccggagtggggaagccgcggccagaagcagtggagtttagacggacaatgtaagaagctgactctagcctggatagcgcagagactgggttttcatcagttcctcagtgaagaggaaattggaaattaataccaaaaatcccactgagtagcgtccatagtttccatatgtaatcatgcttggcttagccaggtagtagaatgtttatgattttctttccaaggtggagtttagtcattctcaacgaaccatttagttggcttcataaggtcctgaattaaagaacccctctaggtgatgttatagatgggcagatacctgggcgaggtggaccctcactggctgttgaagtcaaggcggagggcccagattgggcaaatccggggaagaagccatcctcccagacagctgcttggacgaggccagggcgccacacgctacgtgaagcgctggctggaggagaaatggtctgtcgtaggtctaggtctgttttaaggatctcccctggcgtttgtgattcacgtacaaaaattcaaatggtatgcccctccccgaacacatgctgtcagtaaacggaggcatcgctgcactgccagctaatgactgcaggctgaggcgggcggctgggtgcgttcactgcaagctcggaacgctggcactggctcttcctgctccatcctggaaaggaggagaatgaggcagcctcctgcccgtggccctgatctttagctcgctctacactggaaaccaggagatggatttagagacccggctgcacagtccctcaccagctgctgggtgccacaggcaagtgagggcggctgggcaggctgagggcctggggatcccatcgtgtgcctacacacacatgcacacacactcttaagcatgcatacacacacacactctttttttttttttttgagatggagttttgctcttgttgcccaggctggagtgtgatggtgcgaactcagctcaccgcaacctctgcctcccgggttcaagtgattctcctgcctcagcctcccgagtagctgggattacaggcatgtgccaccacgcccagctaattttgtatttttagtagagatggggtttctccatgttggccaggcaggtgtcaaacttctgacctcaagtgatccaccggccttggtctccctaagtgctgggattacaggcgtgagccaccgctcccagcccccacacacactcttaagcacacatacacacagacacacacagccatatgcacacattcatacacacactcatacacacacatacacatacatgtacacactcatgtatacacattcatatatacacatgcatgttcacccacagatgtgcccatttatctacacacactcacacacagacacacattcattcacaaatgctcataagcacacacactcagaaataaactgtacacacatgtacaaagagagacataccctaacacactctcacacagacacacagttaacacgaatacaagacacacccttatatgcagcacacacttgttcactgagtccacaccctcagacacacccacgtgcacacacaccttccctccccacttgcccttcagacagaagaaggcagcattccggcgctctctgccgccacctgactgccctgcacagaggcctcccagccccagcagagcaagatctgctgccaggccgcccctgctgcccccatctcggtcactcataaatgccctgaggatgcccacatgctcagacccagccttgcccacctgctcctgcctgcggccttttcttccacatatcaacagcctctctcacaagggccttcacacagcctctgacacacacacactcaaacacatggaacatgctctccctcctttgccatctcactgtcacatgggtcggtcactctgtctccagcctctcccagtcacatccatgcgatttgcctgccagcttgtcccctacaactgcacccccagctttggtctttgtctcatgcacagatacacccagccctgtatctgtctgtctgtctccctcacgcaggaacaacttgagccatggcaagtgggagagggcgtcaggcctgatggaagctgttattcttagccctgtcactgaacacttgcacccctccccagctcagcccctgccctgcctgtcaccctcccctcgggcagagccgaacctgaggccagtctaatcccccatctgtggagagggaggggaggcagcaggggattgctgcccagcattgaaaaggagcagaaaatgggatttatttttgctgcccctcatcccccccttccccgactctgcccccagctgctcagagagcagttgtgtgaggaacgagtgggggtggaaggagggaatttgcatttgaaaatgcttgttggttggcctgaaacactgggtgccattgctgatccggttctctgtgtgcacacgtgtgtgcatatgtgtgtgtgtgtgtgtgtgtgtagggtgtgggaaggtggggctgtgggtgagaagacactggggaagtggactcagggctttctggagtgactgtgtacccctttcttgctttggagctggaaccagccataatagatcagacccaagctcagcttctttttttttttgagacagagtcttgctctgtcgcccaggctggagtgcagcggcgccatctcggctcactgcaagctccgcctcctgggttcaagcaattctctggtctcagcctcctgagtagctgggattacaggctcccgccaccacccctggctaatttttgtatttttagtagagacgggttttcaccatgttggccagactggtctcaaactcctgacctcaggtgatccgcccgcctcggcctcccaaagtgctgggattacaggtgtgagccacctcgcccggccccaagctcagcctctgtttggcctcaggaaccaccaactcctagacctctctctgccacccgggccacttgtaggcctccatatcttatgtccagctgccctgagtggaaaggagggagttccaccccaggaagtcccgtggacatctcaaccccaaggtgcttggtctttttctccaaacctctccttctccctggtgtcccgaagtcggaagcttcagacaacccccacttcttccttgccccaccctttctggtctgcctcagaaggtgctctgaaggtgtcctcttgtccccactcccatgaacccagccccagcaggcccctcttcggctcttgccaggactattgcaggagctgctagctgctcttcccaccctcagtctcccttcctgcccatcccttctccagacagctgccagtaacttattaaaaagccaaaataaataaaagcgtatagtgtcactctccttctcaaaacgctcccctggcagctgcagatagagtctagagccctggggtgccgcaccagggcccccgttctgtcccatgtccctcccaccactctctctgagcccttcccttcctctctgctggctctttagcctgaaatagcttttccctctccttcaccttgagtggatttggaatccaatttagatatcatcttcacttctgaaaacttctgcctccccacacatacctccatgagaatcgtttttaatctttttactctcaagggtgtgtacaaactttaattccagccctgaaaccactacccttcagctcagggtcccttaatgagtccatcctcgacgcctgtgccaggcagggtcctgtcatgcgtatgtcctctctggccatctccatttgacacagtcctgtccagcttgaatctaacctccctgatgttgactcgtgtctcccttcctttgggattttcagtctgtggccacactgggccctgactcttttgccctgtgctgtccacattgttttctacgtgcgggtgtggggccaccccagctggcctgggagctcctgagggtgtcagggtggagttcctgcagccatgcccctgtggagctctgagtggtactgggctcacagccaggactcagcgactttggggactggggctgcagggcattgaatttaagtcgggaagagggaggaggaggggacgggaagaaaggagcccttagcaggcgctgagtgaaggcaggttgtaggcccctgggactccactctcagggcaggactgggggccacaaggcctgctctcgcctggcagctgtgaggaaacctgctcccagaggtgatgccagaggtgcgggccaccggggcaagtggtctggcggctggccaggatctgactctgacactggcctgctgagtgcccagaagaaagaggctcagagggagagccagagcatgagagacatggcagggacgctgagtgagagggacagagagagacacggcaacagggacagagacagagaagaggagaggggggcacagagacacatacgctgaaagagagacagacagattcagagacagactgagagacagagtgacttagagacacgcacaaagaaacagactgatggaaagaaagacagggtccgagagagacacacagaccagaagacaaaaaggaaggcagacagagaggacagaaaggagtgaggcagcgtggggagagagaggcagggacagaaacacagacacagacagacatgagggcacagggcagcccgagagaagcccataaacacaggcacgcacatgcgtggaggaggcacgaagccacctaaaggtggagggagggtgtcggggaggagaaggcacaggcctgacgctcagggcctggggttgggtggcgggaggctgggcctgtcggctcctctccttgacgtgagtcaggggtggtgggcaggctgatggggcaggcctgaagtagggctgcgtggaagggctctgcggggtcaggggaaagcctgggtccagctgtgaaccctccaggatccagggctgccccaacaggagccccaggagagggagctggaaccagagaacagcacgtggcaagaggccccagttaagctttgcagcaggatggcccagtggctactgggttcagaacagcttcttgggagctgggtgtcgtggcacatgcctgtagtcccagctgctcaggaggctgatcgcttgagcccgggaattcacgactagcttggataacatagtgagaccctgttccttaaaacaaaaaacaaacaaacaaaaaaacacaaaaaaaaacagcttcctggacatggaacctctcacctcagcaaggagaggagctgtggagggagcacagggctgagaccctcagagttcctccatgggaacagcgcacctgcatctgtgtctaagcctcagagagactccccaggcccttggcagtccattccattgttccaccgtccaatacagagagcccactggaagtcctccctgctgtctcattctgatacctcttattgcaagtgcagcccactcaactctttaggaggttaaaaaaaaaaaagcaacaaaaacccctccaccgaaatctgaaatgccacacagtgctcagacaaagacccctttctgcacagctttactccctcctacacctctctccccctccccaccccgcttccttactgcaggctaaattggcagtggggaggttttgagtcaacaaatgcagtgggttggggaagggagccctgaaggggattcctgtctgggaaacatttgctgacagcagttactatgacaaggaaggcctgcaggagaacccagcagcccctgcctcctgcctactgcccctcccaattctagctctccttgcccatcccccctcccaaccagttcattcactgactcatccattccatcatttactcaactcaacaatctttagacatttaccatgcctccagcacccgcttggcatttcatgtttattcttccactctgtcctcaccacaacccacaaagttatctgttgttttcccttttgacaaagtagaaagctgaaacccagtatactgaattgacttgcccagagtggtgcagatgacaggaggcagagctgggatttgcacccaggactctctgctttccagatcagtgtgggggtttctgaactgcgtcaggaaagcaggtgccaggtgatgagtactgtacaggctgagacttcgccatctttggctctgcatcactaaaactgtgcccagcacccacacacagtaggcactcagtacacacttgtgccatacattcagcacacatgaactcagtatacacatgtgctttttgatgggagggcaagagtcagcaaaagtgggactcctgagaagagagggccttcctgtttggaagcagctgtacctcggttctgcaatccaggcactcaagggcattgataaagtgcctactgtgtgccgggcactgtgttaggacctctgaatacaaagatttaaaacacagatttgtagtttgccctaaaggaggtctttgtttagtggaggaggcagacatataaacagatggagttagcagtgctacagaaataagtaccaagtgccgtggggttgcaggtggagcaaggacctaaatctgaaaagcaaaacaagaaagcctttataagacaatgtaaaaaaaatctccgtgacctcagggtagggaaagatttcttaaacaacacacaaaaataacactaaccataaagaaaaagattgacaaatgtgggtgcattaaaatgaagaagctgtgttcttcagaagacaacatgaagagagtaaaagggaagccacagagcaggaaaaggttttgcaacacatgcaactgacaaagggctcagctccagaatgtgtaaagaactcccacaaatgagtatgaagattggcaactcaatggaaaaactggatcaaatgcataaatatggaaaaatccaaatggctataaatatatgaggtgtgtgaccttatcaggaatcaaagaaatgcaaattaaaatcccaagaagattctactacataccctccagattagcaaaaatgtaaaagtctgataaaacgaagggctggtgaagatctggaccaggagttctcaaatatctcttcagaagcagccggtcagcatctaagcagtcaattcagacatgtgtactccagaggtgaatcgtgtacaagaatgttcgtggcaggcattattcatgaaggccccagactggaaccagtgaatatccaacagctgtagattggataaactgagtacagagaaacagaatgaagagcacagttaattctgcctgaggggctggggtgtctgggaaggtggatcttggaggaagaatagtttcccagtcaaggaagcgggagagaggttatcccatccagagggttcagcagatggatgatcatggggttaagagcagttctagcttgtccaggaggcagctggattaggggctggcagggagagaggcagggaaggtgagcagagagaggttggatgtgttggaatgtgaaggcctctgtgggccatcgaaggaaatttggcttaaatacaaaagtgagagatagtcagaagcaaggagcaactagaggttattgcaaaagatgatgcagcaggaaagaaacatagcagtgtggcggaagagagagggtgcatttgggaaccatgtctgagacagaatacataggatgttgtgtggggtgttgggaggggtcaggacggagctgaggcaactcccaggtctctggctggccggctgggtggaaggtgatgctctaactcaacatccagagactgcggaggtggaggtttgaggcaagagctaagaggactagttggggacatgctgctttggtggtgcctagggatacacaggtgaacatccaagttcaccaggatgtggagcttggacatgagccacagatatcagaattactagagcaagaagccatgggtttagatgagaatatcaggggtgcaggagcagggcaagacaagaattggagctctaggaaccacaacatagaggcagtggacagaggagaagcaggggagagagagggaagggatgatggaaaataagagaaggtccagaagagagggtggtgctgcagcagctaagggaggagcaagttgcaccagggctgggtggtctgtgagtgaaaactaggtcttgggaagaggtggggttgggtctgtggttagcaaagaagaggaggagagggtagttgagggagttctgagaatctctattttctctgtcaattacacatgacggaggggacaggccggaagcctgaaagggtggtaagtttcagaacaggagctgatcaccagcagcccaggagctgaagggccaggctgaagtcagggaccataaatctggagtggcactagtttgcacggttgagtggttttcctatgccttctagtagcctgggaattgcaatggacaaagcagatgactggagtcctccagggctgggaaaggcagggtgagggggtgtgggaatcaagggtgtcgggaaaatgaatgatgtggccaatcacaggcaggtcaagagaggagaaagtagagccaggaaggagcagatgcgctggcggaaggccttgtccaaagccggcactgcagcaccggtgctcgaacgagtgagacagaacgggagaattggagaatctctgcgagtggagaccaggttttatggaaaggaaggaaaaagttgtggcccaagatgggggtgctggagtttaagatttcacaggagacgtttcaggtgatatgtgggtggcagaaatggagagaaggtcgttggggaaggggagataggagagccaagggtgagggtgttgggaagtccatgtggacattcaggtcccccagactgacagcaggaggtgggagacagaagaagaccctgagccaggcgcccaagtcctcaaaagacgttgagtgacctctgggtggatgggtgatcccagccaggttgggtgaggggtgtgtggctggatggtgggaacctggaggtctggttttgagtgggagaggaagagtcatggactgggtggcagagagaggtggaagaatgctgactgtccggcctggccaggtgccacctccagcaagctcgtctgatcactctcttcttgaccttcattgttctttgagtctgaaagactccatttaacccttgagtatccacagccccaatatttgcttctctcctccagagatcactgggcagaattcccatgggtggattgtggcttctgtgtattgtggccccagtgtattctgagaaatgggccatggacacaggacaaagaggccttgaccgcagcttgggttagtgaaagtgtgggctgctctgggccaagccacaccatctactttgggcccagcaggctgggctcctccacccctaccccatctccctgggacatgtggagcttttctacccttcattttgcacatggaaaattaagccaataaaagcctcaagaatattaaggcatgggctgaggcctgatggcatctggaaccccgtctgcaatacctgattcccttcacctgctatcaaaatcttgctcagccttcaaggcccaatcaagggagcctcaccttctttctgatcttcccttctccacgtcaattactttgctggctagattcttggtccttccatttggcatttgttttcacccatcttaaagttggttgctaagagtctgtgttttctataagacttcttttttttttttttttttttttttttttgagactgagtcttgctctgtcacccaggctggagtgcagtggcatgatctcggctcactgcaacctccgccacccaggttcaagcgattctcctgcctcagcctctcgactagctgggactacaggcgtgggccaccacatccagctaatttttgtatttttagtagagacagggcttcaccatattagccaggatggtctcaatctcttgacctcatgatccgcccgcctcggcctcccaaagtgctgggattacaggtgtgagccaccgtgcccagccaagacttcatttttttaatgaaggggagttgggggttggagatactaaccatcatcctctatgtgatggtatctacaagacttcattcttgaagtcagtgcctctgaaggggccatgggtacaaataagacatggtcctttgggaaggagctcacattctgaacatagtgttggtggattcgaattgattcttggatctccagggctaggatctgcaaattgaagaccagtggatccaggggcaggttgaggggagtgggaataccatgaagcctcttggagaaactttcaaaattacagaggcaacacccagggattctgatatgatagatgaggggggcgaggaagggtcaggacctctgaatttgtagaaacttctggtggttctgaatcttctggtcaagaaccatgatttggggaaatacagtgttctgctgcctcagcgattctgctgcctcagcctcccgagtagctgggaatacaggtgcgggccaccacgcccagctaatttttgtatgtttagtagagacagggtttcaccatgttggccaggatggtctcgatctcttgacctcgtgatctacccgccttggctgtggggctaacaaagtagtaaaagaaaagctgaactcactgccatatgctgggtatgcaaatgacagtcacttatgagccctcctcacaacccaaaaccaatcactgcaaagcacaataacaattgggcatggcattaaaaggtgaaggtcagtttttgtaggtgacgttagattttactgtaagcatctcaggactggctatcgttcaaggcatgagtgctaatcacagtaataagaaacctcagtgtgctttgaggctctccccctatctctttctctttctcaatctgtctttaaatcttccagtttctagagctagatatctagaaagaagaaacctaatgcatgctgagcacctatcatgtccagaacttggagtatttatcttatttgatctctacaacttccccatgatgaagagctgtgtgcagaaaacaaatggttcagagcagtggcctccactgactccacttcaggtcctggccctgcagctcactactgcagatttgggacagtctaaccttcacagcatcaaggtgcttatctgtgagatggagctaagatgatgtaccctatcacgcacagggtagatgtgtgatacattgcagctctttattgccatcatcctgttttgtagatgaacacactgaagcccagttgtaagcagctgtaggtatttgcactcaggtggtctggacactccatgctgtttcccccagtgctccacctccaggcagcctggccttggctggggagcatgtgccacgggaccctggcagaggctgtaactatttccagggatgtagatctccaatggggttgggggatgggggtgtgggggagcacctgtggccattaggaactacatttatgagcctgttacaccaactggccccctcccccaggtctgcagcacattgaagttcttcctgtttgctcccaagcagatggtgccggaatctctctacaccaactcccattcataaatcacagccattccccgggtgctggagcaaccattctaattacagtgggggaagtgtgcgcgcaagtgtgtgcgtgtggagtgaagggatgtagacagaggctgctggccgggagataccacctcttctgcatcgtgggtactgccgcctccctcagcagccctcccaggccctatgcttcacagagggaagcctgggagtcctaggcctggggagggaggcctggtgggagtgtttcctgctcctgtgacacttccacccccctcaagtggccttaggatgaggcagccattcttgaccccacactttcaggccccaggctctctgtagaatggtagggggaggggaggccactattaacagagtccctggtgtgtcccaagccctctgatggggacttgagataggattgggaacctggtcacaatctggtcaactcttatctgctggaggtgagagagagtggaggggcggagaagagaatgacaggcttgaagaaagccaggctggggacccttgctgagtacctccactccccaactccagagctctctgggtcccttatctaaggcccctgggctgtgtgtgtgagcattatttccacgcatattcatctacctcagtgtgcaagtgaatacggatttgtttgtgaatctggggatgttgtgcttgtgagtacaagcagtttgtaagctgtgaatcacggtgtgcactgttcacatgtgtgtgcgagcctgtgggctcctgtgtgggggggagtaggggtttggttgtgtgagtttgggtgtatatagagtgtctttggggtgtgtgtgttggagcctgggagagcaggcatgagacgcatctgctgttggctagatctgcatgcagtgtctgaacgaggtgacactgcatgactaaggattcttgtgtgtgaggcctgttcccaccacccctcggttctgaatgccccactatagaggtgcatcaagtagtctgcttctttccttagtccttggggcttcacttacaaatgaggaacgggaaagtggggcagggggtggcaaggctaccttcccacctggagcaagctggaaggaggccttcagtcccccagcacccccacctgaggacagtggctgccctgtgggctcatgactgaccctcagtctgtttttttgcccaagctcctctccctccaagtctgcggcctctcgttttttttgttgttgttgtttgtttgtttgttttgagatggagtcttgctttctcacccaagctggagtggagtgcaatgggacgatctcggttcactgcaacctctgccccccgggttcaagcaattctcctgcctcagcctcccgagtggctgggattacaggtgagcaccagcaccaccacgcctggctaatttttgtattattagtagagacggggtttcaccatgttggccaggctggtcttgaacttgtgacctcaggtgatccacccaccctgaccttccaaagtgctgggattacaggtgtgagccaccatgccaagcctgcagcccctctttttgtcaatctcctgtaagtgtgattcttcccagtcccctccttctccagaatctgcccttcagggagtcctccttcttcccctgctccagaggatccaagacatcctcttacctgcttgagtccatgtccatgtcctcttacctgcttgagtcctccctccccattaggtggcaaactgagagggggagagtttggccaccatgacagatgctgccgagaggggacacttttgcttcccttgcctctccctccccacggatctctgtaaccctcagaacttccctaagcagctctaagctatccccaggggaaagagcagggacttgagaataagagctccccatttgccacttgctggctgtttctccagctacaagtctttgtacttgtctgagactcagtttcatcaactgtaaaatgggggttaaaatacctgtcctgcctatctcacaggattattgcagaaatcaagggaaatgatgcataggaaagtagttggacctggtaaaagtctatcaacatgtgccaggtattgtcattaaatatttctgggggccaggtgcagtggctcatgcctgtagtcccagcactttgggaggccgaggtaggcggatcacttgaggtcagcaattcaagaccaccctggcaaacacggtaaaaccccatctctaccaagaatacaaaaaatagccaggtgtggtggcgtgtgcctgtaatcccacctacttgggaggcaggagaatcacttgaacctgggagtcggaggttgcagtgagtcaagatcgtgccactgcactccagcctgggggatagagcgagactatgtctcaaaaataaaaataaatttctgggttttcttttaactgaccaacactatatccattttaaagatagactgagcaccctggagaaacttgaccctgtgttgctcccatctcagcccccaactacccatctctccctcctgtccattagcaaaggagagcccagggcttccaccaggccttccacctgccccaacctgcctgctctgaacatttttaagcattcttcaggcacccgctgcaagggcacctcttctggggaaatacccctgatccccaacacagctggagtctcctgctccaggcttctgggctcacacttcctggcagctcttatcaggctgcttggtaattgtttgtttttccaacactgtttcacaattactgtgcaatttacaaacttgacaactcagtgtgatccagctactgcagaggtgccacccaggtgctgattcctgcagggccagcccttccaaggaagaaagcaccacccccagcccttacctgtgcccacccccaccccagggcctacaccagaacctggctggaggaggcccttggtaaatgtttatcgactgaaggaacacgtgaatgagggatggagtggaggctctgggaacaaggcagaggggaagagatgcttcttgttaacatctcttcataaaagccagtgagttcctacatccagctggtgtctgaattggggccaatcataaaaccaggaggcccctgaggctgagggcagctggctggccagtgggctttataaggcggttttatggactcagctgagatgtggtgatgagaagccaaactttaaacatcctcttaaagttcgttttcactcccctggggcttctagctgaacgagattgaggagaaggccttttgaggcaccagtggagggatgatgagatagcatcatccacatggaccaaaaggaagtaagcgggacttgcagcagaaggggtgcaagttaggcatgaggaaggactttcttctgggcttggggtgcagcaggcggtgatgtggggaggggaagagatggactgacttcttccccctattattcggccacccaagggggtcatgttcacttcctgcagcctcccctggtctatgttttttttttgagatggagtcttgctctgtcacccaggctggagtgcaatggcgtgatctcggctcactgcaacctctgcctcccaggttcaagtgattctcctgcctcagcctctgaagtagctgggactacaggtgaacgccactatgcctggctaatttttatgtttttagtagagacggggtttcaccatattggtcaggctggtcttgaactcctgaccttgtgatctgcccacctcgacctcccaaagtgctgggattataggtgtgagtcactgcccccggcctggtctgtgttttgagaggagcaccacctctgctccgcatctcagcctgctctctcctgacttctttcctgttcttggccaggtagaatctctagaaggaaggagaagggaaggaggtgctgaaggcagtatcatgatctgctcaggagctggaaggctaaagctgacccagggccagccaggcctgtgagtccagggtcccatggtttaagatgtgaagatttttctccagcttccctacttgtgccgtgtgtggaaaggagaaaagcaactagcctaaggaactgaagaaagtgccaagaagagagttggagctgaaaaaggcccaagaaacaagaagagagaaaaatcaaagaaagaaaaagtggaaaagaaatgcaagagggaattaacatacgtgggtgcagacgttaacatccatggggcccctgaggtggatctcagcaatcctcgccacccttccagggagtgttactattttaaggatggggcgttgggtacggcggctcatgcctgtaatcccagcactttgggaggcagaggcgggcggatcacttgaggccaggagttcgagaccagcctggccaacatggtggagccccatctccattaaaaataccaaattagctgggcgtggtggcatgtgcctgtagtcccagctagttgggaggctgaggcaggagagtggcttgaacccaggaggtggaggttgcagcgagctgagattgtgacatcgcactccagcctgggcgacagagcaagactatctcaaaaaaaaaaacaaaaaaaaaagaatgggaatcctcgctcagaaggctcatgtggcttgcctgagggttccccatctggtgaaaggggcagctgagtcttagacccagcacgatcggattccagcccagagcaggttctaggccttggagaacacagagttttcatgcacccaggcacagaagcctggcttggctctatccgctgcgagctctaatagcctgggatgctcccaacccttgggatcttgcagctggcccgtagcctccagatccccctgggctggcctgtgcctgctctctgaggctgggcttgtggctggcctgcctgctgggaggattgatggctctgctctggggaattgagaagttagaacccaattaagagcttttcaactcaggccagagaccttggctacagagagggtgccctttgcctcggaagcctctagttcaagcaggattcagcccctaggttcatagaccctgtctgctgagagtggtcaaagccactctgcactctccttgtggcctgctcccacagggctcttggctggagagaccaaggatgggaacctcgtctgtctgtacataactgtatatgctgggggctgcccctcctcctccctggacttggcctcaggggtcagcatgaccaagctcccctcaccaccttttttttttttttgatatggagtttcgctcttgttgcccaggttagagtacaatggcgcgatcttggctcactgcaacctccgcctcccagattcaagctattctcctccctcagcctcccaagtagtagctgagactacaggtgtgcaccaccacacccagctaatttcgaatttttaccagagatggggtttcaccatgttggtcaggctggtcttgaactcttgacctcaagtgatccgcctgcctcggcctcccaaagtgctgagattagaggcgtgagccgccacgcccagccaaagcatcatcaacagcctccccatcagggaattgaaccccgtctcccgcatgacaggtgggaatactcaccactatattaacaagaacttcctatccaggcccttcttgattcggggcaggggaaggggaatgaggacagggaaagaacattgagcacctagcatgtgccagggctttctatgcgttagcacatttaatcctcaagcaaccccacagggcgggttatgatcttccctttataagtgacaggcaggaagctcagagaggttaaagacctcactgaagcccacacagccgctcagtgctggagcagctagggaaactcaggtctgccgaactgccagccctgttctctcgctctgggaaatgggacttgcccacccctccagaacttccaagcctggggcgttcccaggcacactccatgtgtgcacgtggtctctaggggcccaggcctcccaatgctaacaaacacccttcagacgtttccggatacttcccaccccagctccagggaccttgggaaaactgggttgcctttgaaggggccccccagacccatcagcatctctactatttcacactttcccttcaggatcatcggacgaggaacagctgggcctgcagatttattagcgttttgcaagtgattccacccgctcttctagtcccatgtgagccctgcccccgctcctattagaagcctctggaaagcaaaggagttcttttttcagtgccccaagcccacttagccggtgtgatttttgcctctcccactcctcacagcaactgggagctagttatatctccccagaaaccagggaccaaaagaaaaaaaaaggaagaaagaaatgaaaggaagaaaagaaggcaaggcaaggcgcagtggctcatgcctgtaattccagcactttggagggccaaggcaggcagatcacctgaggtcaagagttcaggatgagcctggctaacatggtgaaaccccatctctactaataatacaaaaattagccgaacgtggtggtgggtggctgtaatcctagctacttggggggctgaggcaggagaatcgcttgagcccgagaggtggaggttgcggtgagccgagatcgtgccactgtactccggcctaggcaacagagagagactccatctcaaaaaaaaaaaaagaaaaagaaaaagaaaaaagaaacaggttagtgttatcttccatttcagtaaacaaactataggaaacctctggctggagggacagaagacccagattttcttcctggtcccaccagctgtggggctagaggcaagtcatgacatctctcgaggcctcagtttccatctgtgaaatgggggatggtatccaccctgagtgcctcacagcggggatgtgagtatcaaagccagcactttgtactttccaaaggcctgtccctgtccccttttcctcacagtcctgcacacagaaacgttaggtgagtgtgctaacgtaagatgggtcatctagatgggtcatctagatctaacctagatgatcgacctcatacacactgcagatagggagttttcccactaacaagccttcagaaacattgagttttatcctctttgtttttcaggggtcacgcactcacctagacctgtgtgacgtgcatgtgcgggagcttgtgatggtcacacagtcatgacatgaagagagccatggggaggaggcacaggaagtggtgggtgctggggcgcaatatgaacattcagcaccaaacaagggacaaaaggttcctggccacccttgcggtcagagttccactgtgtgacctgttgtcacaggtgccacctgcaagggccaggtaaagccctcatggagttgggcagaggcacagaccgatggtaataatttaataataaatcactattaattattttaattattaaacaaaatatattactatttggttaactattaaactactaatgatgatacttatgaattaatggcttgggatgatcgtgacggtcaccgcaataatgctatactgaaggaattttttgtgtgccaatagactaattagaaaacatttgaggtatataattgtgattgcaggactgatgtgtagtggaaaacaaaaaataagcatgcaggtgtcaaaatgccaactgttagccttgacctccatgcttggctgaagggctctctgtcataaagtggctttgtgcagcaatgacccagcctccagagccctcacagctgagggccatagacagtgtggacctgcaggagggagccttgagagggacgctgagagaggttggatgtagcacctccggggagcaaggccagagggacaaaccagcagagggtgacgcgatgagggacgggggtcagaagcacgcagagttggcagcagaaaagccctcatgagccgctgccaattgcaaagccaggcattgcagtataaccaccatgtattgaagagatagaaatagggtctctaggtccctggcaacatgggcagatgaagaaaacaaactgacaacatggagaggcgattgagtccaggtcagaacgcaggctcacccacccctgcctggaggagcagggatgggccatgagaaccagaaagacaaccatgctgcacatctgtaattaagcaaaatgcttactttagtcgtttgataaagttgtagttgattttttctgtgatttggctatttaccaggaatttagtaatttctttgttgtaaagatgaccctgaagaacctcaagcaggatggatctgcctaaacttccaagtgtccaggcagaaccattcatggtggagtccagaaaggactcctgtccagctgatcctgaccacccttgctgcattcagaattccccatagtgatgagcagcccactttataaagactaggaataagccctgctgtctcccgtattgggcagagaagcagggccaccttacagaattggatcagctgctccagccaagaaagagctcaccacatctgtccctgagccaagagatcagtctgaagcagtggcctccacactcccacactggaggaggcttcctgacggaggctggtggccttcaggagttgtttgaatccgctttaaattctgcaaagatccagtttgtccaggcccttaaccacaatggcagtcaccttgaatgtaagggaagctgcagttagactggattggaagtaaaagagcattttcaaatactcaggcatttccttatgggaaaggggttgcggggaggggttcacactgttcttggcttgaatacccagaaacctcatggaaggcctaacaccgtctttttgcaaaattgtgctgaccatatagtgttgggaagaagtttaatacattaaagagctagctagtctgtgttataaaataggaaaattccagcaaccccaaactctcacaatgtccatgttccagctcccacaaagcctgagcgtggcaccctcctagtaggcagcctgctgtggggatgggcacacagtaggtctcacaagcagctgtacctttgcctctccctcctgctgtgggccaaaaccacttaagattattataacaggtcgagtctcgcttgtagatttgtttaaccttacaccatgttggatatgaattcctcactaaaaataacggtcacccattttcccctgccttgaaacaacaggcacttcattcaccgcagctggcagtgcccagcagactggctaactggctctcatgagctgaaacgtgctgcggcttgttcctgctccatctctcctccttctcagcttttctacaagccacatgcaaaaatctggcccattactccattatcatatttcgtatgaaattaggtattgcaagtctcatgtcattcaattagcttggcacaggctgagggcatgactcagagacactcccagtttcacctcttcccagtcatgggctcctcctttatcctgaccccggggagaccctgttgtgccaagacaaccttcttcctcctgaggcttaggtcaaaggacactcttgggaccctttgttccagaacgaaggaccttttctgatcagtctcagttccactcccttgaaccccgactctctatgtctcccacaagcacccagatgaatgccctccacttgcctcccttatggtgaggcccacagccctgcaaaccagccctgtgcctaccctggccctggccactttctccttcttctccctgtcaccagactaatggtttctctaaaaagcctcagccctccaggctgcagtgtcagcagctctgggtggcccaggacatacttcctccaggtacacacaagcatgctgaaaatcctggttccacccacacatcctgggctggtagcctcccccgttttgcagccttcacattctcaacgcccacatgtacatttcatcacagtcaactccaggctctctgcaatcccgccatcaatccgcggtgatgtttttggctatacctcctgcccctggaaatgatttcccgtcactcctgaggcagatacccatgtgcctccttctcttccctgtacactttgccttctgtgcatgactgcccttagaagggccagaaaatgcatttagggttcatttgctctttcagtaaagttgtctgagtacctactatgcataagaccagattccttaccttcaggaactagataacctaggaggagaggtgaggaaaaaaaaaacacaactcataaaaagatcagcaaaagtgcctcttatgagagaaggagaggaagacaggatactgatgagtcttaatctgcatagtcactctgggtcatcatgtctgaccaccaaggaccagtgggaaacagtgtaaaggactttgggtaggatgatcggggcccaggagacttaatgaagactctcaaaggcgagataaagatgaatcagctgtggctctgatctgtggccccagaactcaccttcagctagaattaagtgaaagaacattgaaagatccaggtttcctttcctactgatgagcgaaatcagattcctgagaaaggcctcctctaattttgaggttccctttggcagtgagccctcttaattgctctagaattcacatgataatttaaagcaaaaaatataacattgtcttatgggttttataatgtatgtagatgtaatacatatgataactatagcataaaggatgggggtagcgggcaatggtttctacattttacttgaaatagtaactaagtggactgtgaaaatttaacgatatgttgtaatccctggggcaaccatttcaaaattaatataaagaggtataattacaaatccaatagatagatttaaatggcattcaggctgggcgcagtggctcatgcctgtaatcctagcactttagggggccgaggtgagtggatcacctgaggtcagcagttcaagaccagcctgctaaacatggtgaaaccccatctgtactaaaaatacaaaaattagctgggcctggtggtgtgcgcctgtaattccagctcctcaggaggctgaggcaggagaattgcttgaacatgggagagccgagagattgcgccatttcactccagcctgggcaacaagactgagactccatctcaaaaaaaaaaaaatgaaaaaaataaaataaaataaaaaataaatggcattctaaaaaaaatccaaaaaaaaaaaaaaggcaggaaggaggaacagagaaataaaaaacagaggggggaaataaaatgaaattcaaccatattaataattacattaaatgttaacaggataaacattccaattgaaaggcagagattgttggaaaagattttttttttttaaaaaaagacctatttgcagtctacaagagatgaattttaaatataaagacacaagtaagatgagaataaatggatgaaaaattatatacattcaaaagctggtggggctgcattaatatcagataaaatagactttgagacaaagggtattaccagagaaaaagaaggacattttgttatggtgaaagggtcaattcatcaggaagggaaaacgatcataaccatgtatgcaactattaacactgcttcaaagacatgaaacaaaaattgacagaattaaaggaagaaacagaaaataccatgatcaaagttggagattccatcagtaagggtgaagtctgatttcaccttcaggacatatgggtttgggaggccattccctaggccaaggctgggctgtgggctgtgggctgtgggctgtgttaagacacttcagggaagaggccaggagggagtcaggcaggcagttaatgacaaagactggaaagattctttgaggctgagacactgatggtctcaggtgatttttatggagagcctcaggccccacttggggtgaggaagcaatggttgaaggcattgaaccagttctgaagggcatggtgatagtgtccatatggcaatgattacttttgtcagctgttccagaagaggatgccaggtaatggaatggaaagcagcagcagaggccaaaaaaagctttacccacttcattattagtcactcagggttcctttataaaagacctgatgacttgggctcaggtgtcaaagaccacaacaagagctaaccttacccttaatggtcacctagacttgttggggtctggagaaacaagaggtagcccagtggttctcaagcttgagcatgcatcaggatcacctggagggcttgttcaaaccagattgttggaccccatgccaagagtttctgatgcagccgatctgaggtgggatctgatgctgatgttgctggtccagggacacactttgaaaaccactaagataaacaaaatgccacaggagcccagaagagggagatgtcttttttggcacgcagaagcagggtagaatgacatagttgcaggtgaggctgaggggcatgtcaggtagaggaggcagcccaggaggaaattagggggctcatttatggagctgaactgcaacgtccgtctaaggaacagggcagaacaggctggcaaggtggaccagaaccccagtcaaacatgggctagcttagaaatgaagagcagacgctcagaatcagagacatgggttcaaatcctggtctgcctctaattagctgtgtgacctaagagagatgatctaaactctcagagcctcggttccataatctgtaaactggggctaatattagtacccactctaaggatctttagtgagggaatgcagcctggcacagagtaagagccagtaggagccagcaccagggttgccatggagcactaggcagaaggcacatggctgacaaagcttctggctcctgtgggttgaagtggagcacatcaggcctgggctgggacttgggcaaccagctagacagacagtattttgtgaaactcctcctgaggacacttgggctcttggttcagagttacaggcctccttctcaaggccattgctttcctaagtcaggttgctccccggccctcctcccatccttcctgagcccctgccaaacccaagagatggctgtggaagctccactaggaccagggaaggagcctggcctggcctctggatttatttgcctgcctttcagaatgatcagccagcatccaacgcagcaaatggcagcagcttttggattttttttttttaagcaagaaagtgaagggggatttagtctatctgtgtcaaggaaagagaattccggctgggcgcggaggctcacgcctgtaatcccagcactttgggaggttgaggagggcggatcactaggtcaggagtttgagaccagcctggccaacatggtgaaaccccatctctactaaaagtacaaaaattagctgggcatggtggcactcgcctgtaatcccagcttctggggaggctgaggcaggagaattgcttgaatccaggaggcagaggctgcagtgagccgagatagtgctactgcactccagcctgggtgacaaaacaagattccatctcaaaaaaaaaaaaaaaaaaaaaaaaagggaattcattctttccccctgtgttctgagataaaatggttcatttccatgaaaattgaaactcagagatgaatctttgctgcagtgccttttggactgtgggctaaatggggagggagcaatgtgcacgggctagagaactaactgtgtcttccccgccctttcctggtgccacagaggaccccagggcatgggcactggcttctgtgtggccctgcatggttctttgtctccgctttctgtctgtgtggtttgaatggagctcaggataaagccaagcctgatcatcttgggggaagtattgctcgtggttggaaatcatgagtaaattttgaaaaatagtcaaagaaattcttgcttagggaagcaaatttcccagcagaggcggaaaaaaagccaactggtaaagtccaatagggataatcagaaatagtctctggattattcacctttggcatcatcagcccccttcccagtcttccctgcagcatgggtaacctggagatacccatgttcaggtgattgtctaggaagaatcaacttagacatgaagccaaattcctgagcagtttccactgtgctccagattccctcatgctgccttctctaactgcttcttcatccaaatgcagttcacattatgtatttgctccctgggggctcttggccctggcagatgtttgcggcagaaccctgggactgattcaagggttagaccttctaggccctgcgtggggaggtacagcttaaaggtgtaggtggatttatctaatcggccaagtgttgcctgagtgtctgaatgaacaaaaggacagtgaattcccctctcttagccttgcaaatcagtccccccgcttgcccagcccatgtggtgatgttatttatctcccttgacactgagaagagtaaatgaggcagcaacccaggtaggaggaggagatctggttcaggacctggctgagtcattcctctctccctcccacttatccctgcccctccatcatagctttaattcagcctttatcctccttgactcaggtagacattggtcttcctgcctccactcttgtatctccaagcttccctatagggcagcctttttttttttttttcagacggatctcactgtgttccccaggctggaattcagtggggtgatcacggcttactgtagcctcaaccacctgggctcaagcgatcctcccacgtcatcctcccgagcagctgggaccacaggcatgcgccactatgtctgactaatttctagattttttgtagagatgagatctctctgttgtctagactggtcttgaatgcctagtctcaagccatcctccttcctcagcctcccaaagtgttgggattacatgtgtggatcatggcacctggcctagggtaagctttttaaaaagtaaatctgtgcatgtgattgcttgggatttatacccaagaacaaccagatgcgcagctcagcagaagactggaagggggattgcaggtggaggctcagtctgggttaggccccttccttagtgcgaaggggccaggtaagtcttctgtctccaagtgtgggttggtccctgctgatccaggttggggtttgggggaggactcatcgccctttgagaatgttatcacaagggacaacctgaagtcataagctgcccacttttttttttttttttttttttaagacagagtcttgctctgtcacccaggctggagtgcaatggcatgatcttggctcactgcagcctccacctcccgggttcaagctattctcctgcctcagccccctgagtagctgggactataggcgcgcatcaccatgcctggctaatttttgtatttttagtagagacagggtttcaccatgttggccaggctggtcttgaactcctgacctcaggtaatccaactgccatggcctcccaaagtgcaggaattacaggcgtgagccactgcgcccggccatctgcccatgtctttaactcccctagaggagaacactcctctctaaagcccctacaatactgtctgggctctgcaaggtgtgggcctccctggatgtttgtggaatgactctaaggcatctgggaatgccccagggtcaaggcagatttggagtcgggggtgagaatgtatctcatttctctcccaggctctccccaattccatgggacccaggagtagcagagctgcctctgagagttgacaggcttatttttagtttggattctagttcgcaagccggattgtttttccgttttgcctaatttgggccaggtcctagtggtgtctcctaggaccctggcttgggctgtgaaaggtctgcaggactcaagccttggggcagggaagtcccaccagcttcctgtcccagggcattggacaccctggggcctggaccagctgccccagttggaagaggaaggaacctgggcctccccgtgctgagcctttggtgatttggggtgggaggggcgtagacttaacatcctgtttaaatttggcattagccgaattttttaacaggggttatgacccccctcctccctctcccaggccttccttacatactcctctaatcaatttttaacttctggctctaactctgccctttaccttggagcattgggcctgaccgagggaggagcagtctgatttcttgaatcctgcctctgaacagaactggccaaagggaggctgccgcgaagcccaagcgaccactgggagaccagaagatgggaagaagagaggagaaaaagaatagggaggaggatgataggagaggaaagaaaagagaggtgtgtgtgtgtgtgtgtgtgtgtgtgtgtgtgtgtgtgtgttggggggaggttgggattgtgttttagacacgtgactgtgctggggctcagcaggaggtgcaggaggcccagtcgaaagacaagcgagcaggacaaaggcctgattacacccaggcacgatggccattgagcccagtccccagtcggccatctgagtagaggctctgccgagcaaacatccagcccctctgtgactcccaggcggagaagcccacattcctgcccggcaaaggccgctttaatcaagcctccagatccttcctgcagccgcctgggggggactgtaacgctaaacacattagtgtgtgagattgaaaggtaacacattctcatggaagcccccagaataatgggcctcgggtctgggtttcatttggaggaactgtgcggtgggaatttctctaatcaaataaaaggaaaatgaaaaactctatcgttctcaaactttaatgctcttaattgcattaattcgaaaaacatacaaggtctttctgagtatggtgttggagcctataggaaaagaagctcagggcctggctgggggaaaggcaggggtctgatggcagagaagggtgcccgggagggacaggcagtgtgtccagggcttgaaggatggcctggcagagacccaagtgacaggcggtttggcctctgtccccccatggccactcccagcctcggtatttccggggcctccgtggtggctgaagaggccacttggcttggacctgctgctgtcactcactcctcatctgcccagacccaagggggaagggcagatcttgtctgctctgtcagtgcccacagcccagggccagctgctcctctgacagcacaccccgcccggatgcctccagaagcccaaacccaacctgccccttcattgcagtcccagtgtgctggacctgccagccttccccagcctcttgctgcctagacccagctccacataggatgcggtagaaagaaacagcctgcacaggggcgtggagcctgtccggaggtggctagagattcctgaagcctaaggagttgtaggcttcctccgctgccctcctgctgcagggcctggagtcagcaggggccaagcctgtttctcacctgcacttcccagggcctgcccacagtgtcagggtggaggaacaataactgagcctgcagagaatgtggggcctgggggttcctaaccattctgggacacggccttcctagaaaatctggtgaggactagaggctgcgtatcagaaaagtgcagacacaggccaggcgcagtggctcatgcctgtaatcccagcactttgggaggccgaggcgggtggatcacctgaggtcgggagttcaggatcagcctgaccaacatggagaaaccccgtctctactaaaaatacgaaattaggcaggcatggtggcacatgcctgtaatcccagctactcgggaggctgaggtaggagaattgcttgaacccaggaggcagaggttgcggtgagccaagatcacaccactgcattccaacctgggcaacaagagcaaaactccgtctcaaaaaaaaaaaaaaatcgaaaagtgcagacacatgtgcgcgtgcacgcgcgcgcacacacacacacacggtttgcacatgagtgtagaggtcttacaaacacctgttctgcgtgttccaggagctaggtgaagtcctgctcctgagtcttggcagggacattgccttgctaggagtccttccaggggagcaggattctggccgcagaggctgggtgcgagatagcagtgaggagagctctctggagctgaggagggtctgaaagactgaggaagttcaggcctgtgacacacaggaagatggccacagaccaggaagcccgtaggtaggggtttaactgcagcttctccacactccacctgtgtgactttgaggcaagtgaagttattgtgtaggaataatagataccccaccaggactgtgggaggattgaaaagctatgctgcatgccaggcaggcaggaggggctcaggaagtgttggttccccttgggaccgcagtccttagatgacaaagaggggcacgagggttggcagtgcgcacataggagcttcagggctttgtttttagtggctaccacaaagggccttctttctccatcccatagtttcctccttgaatcactgttgccttgtggctccctcaacctggaactcccatctttttttttttttttctgagacaccaggctggagtgcagtggcacaatctcagctcactgcaacctccacctcccaggttcaagtgattctcctgcttcagcctcccaagtagctgagattacaggcacccgccaccacgcctgcctggctaatttttcatatttttggtagagatagggttttaccatgttggccaggctgcttttttttttttttttttctcagctcactgcaacctctgcctcccaggttcaagccattctcctgcctcagccttcctagtagctgggattacaggcatgtgccaccacacctggctaattttgtattttttttagtagagatggggtttctccatgttggtcaggctggtctcgaactcccgacctcaggtgatccgcccaccttggtctcccaaagtgcttgcattacaggcatgagccaccgtgcccggcctggccaggctggtcttgaactcctgacctcaagtgatccgcctgcctctgcctcccaaaatgttgaaattacaggcatgagccaccgtgcccagcctaggaactcccacctttaccttgaacttgtagcgagctcatctcagttctcaagtgtcatctgctctatgaaggcctgtagagtccctgggagaactaactcccctgggagggaggctggggatgtgttattgttcctattttccagaaaatcgagactctgagaggttggttgacttgcctgaggtcactcagcagcagaatcaggactaacattccaggtaacggcctccactgtccagcatctgccatgtgctgggccctgcactgggtcctttgcatatgtgagcttgttgcatttctaccagaacctaagtggcttggctccaggtccacattctttcccaacatcacactgcctctcaaagacaaggatggaaaaccacgtttccagggctcttttaaaatcttcttcctttgtgaagaatgttgtcagccatcagccaacaccacttactcagagctctgggcgtggactaatgaaggacactgtcctcgtcctcgcctgggcagaatgcaggctctgagggcggccagacctgcagccagccctccagggggaaaagggagtgagagaggacaaactgcatctcacaggagtcttgccctcctgctggttctgccactaaccagccctggggccttgaggaagggatgcccctctggcctcagtttctctatttgcaccacaaggagctggaggcataaggttttctaagagcactccggccctgggattctaggattctgcgacttctgagagtgccttgggctagctatgcctgggtgcagggaggtggtgatcagcggggattctcatggaaaaggtgcctcggtctgccttaatcttgtggtttcattgtctgccagagctcagaactcaggaggggggagctccgctgggataaggggagccctggttgaagatgatttacaaagggaagctgtgcgcaggttagcggggcccgacggtgtgctggggggaacaggcagatgtgctccttcggctggcagatgttatttcttaagaacttctgaaggcagagtcctgcggggagggaatcttatggtcttgtctctcctatgacctaatttaatcatcccacctgatctattaggggagcatattgccccctacttcccaccccgtgtctccccgtattcccccatcccagctcagcagtccatcaggtagtggaagtaaggtcacctggctgggacatagtggggcagagatgcaaacacaggcccgctggtgtcagtggccaggtgccatccactgtgccatgccacccacacctcatctccattagggaggagtgcaaatcacagaaccggcagttgaattctagtaccaaggaaactcagagaaggaaacctcacatgaaagggttgcaaactgaataccggtgtgcctcagtttaagcaaatccaatatacccaaatctaaaaatagctccttctattggagctctttcccatatgaattcattcccatacgaaaatgaatcactggttcttttcttcaagaagccaactctattagtgcattaaaatacaattcaagttgccaaatgtgatttcatatacaaccctcctcccgacccccacccccaatatacttctcactcctgatcccaaaggaacactccgcctttcataaagagaggttcgccggcagtgagcggggctggaaaccaacatggcaaacacatgtccaggattttctgagactggctcactttctaatattaggtttccattgtcccataagaacacttggaacttggggccttggggactgatgttttggttggtacaataaggtcacccggaagaggaggatgctgtcctgtcaaacccattttctaccctggcaggcctggtcagagggcaagctggtcagagagggtggtgacggtggggagcccagaggcaagcctatgaggcggggggagccacgtggggtgagggatttgaggtatggggtgagtcagctgagagagtcagcatcttgggttcctgggatcgattagcgagcaagccacgcaaagcaggcgggctgaaaagatgcaggctccctccatgggctctctctgcatgggaagcaggcgggcggggccctggaaggtggccagggaagagcagctccatgattaaagggttggagaccaggacttttgaagcgagaccaggatggctggttatttgcgcattcatctctgggccctgcctctaccccaccccactccaccacccagcaactcagacctgcagcccagccctggaccccatactgagccctgggaggtgggagaagaagacaaggatttccaaaacgttgactgaacacctggggagtggtggcaggggctttaacacaccaacatcatgaatccccccaacaagcccatggggcaggagacactagctccgtttttacaagtgttcaacaagagttgaaaacaagagttgaaattatttgcttaaagtcacatagccaaatggaataagatcccagatcttctgattctacctcattagagcaaaagcagaagtgacagaagaaggctggagtccaagggcgagggtgcgggcagggaaacctgaacgagcccctccagggactgcgttatttccccagggttgtttacgtgtgaaagggtcgttctcaaaacaggaacagtagtgaggttgctgttctttactgagtacctattacctttgtggcattcttttttttttttttttttttttttgagacggagtctcactctgtcacccaggctggagtgcagtggcgcgatctcggctcactgcaagctctgcctgctgggttcacacttctcctgcctcagcctcccgagtagctgggactacaggcacccgccaccatgcctgattaatttttttgtatttttagtagagacagggtttcaccctgttaagccaggatggtctcgatctcttgacctcgtgatccgctggcctcagcctcccaaagtgcagggattacaggggtgagccaccatgcctggcctacgtttgtggcattctaatccttacaacgatttcccagggtaagtattataatccccattttactgatgaggaaacagagactcagagactcgcccacagtcagggaactaataaagggcagaagggtttgttctgccttccatccccgcaccgccctctgcacacccgcatatggttgctggagctgcctacatgttggtgtgttaaagctcctgccgccacaccccaggtgttcagtcaacgttttggaaatccttgtcttgttctcccactgcccagggcccagcatagctcttatctatgggaagggagtttagggagggacccgggagtcattctgagaatgtccttagagcataggagggttgccccaggaggctgctgactgactagctgtattccagctccccaggccaattcacggccaggctttggctcgtgctgtttccttcttgcatttgttttcatgtcaaatcctacccatccttgaggactggacgccgatgactcttcttcataactccccgctgatctcctaaccagagctgtgcaccccctccctcaactctctgtctgcctttcatgtagcaggtaggacctggggcctcccctatttatctggctcaaatggttggaagagagagggtgggttatgtttaaggaagtgcttcctggatgaaatttcagagtggggattcttgagtcccaatctgggaagcttgagtgagtcatagagaaatgctgctcttggtgagttgagtgtggggacagcctgcccccactcccagcatcaggcacaggtacagacccggcggggcctctgctttccctcaccttcctcacagtcccgcagtgttcctgtgcatgtggaggcctggagattcgtgctggccacaccaaaacccttcctcttaatgctgcgtatctgtggctcctacatggtgttataggaagaattcagctgggcgcggtggctatgctgtaattccagcactttgggaggctgaggtgggtggattacctgaggtcaggagttcaagaccagcctggccaacatggtgaaacccccatctctactaaaaaaacaaaaaattagctaggcatggtcatgagtgcctgtaatcccagctacttgggaggctgaggcaggagaattgcttgaacctgggaggtggaggttgcagtgagctgagatcgtgccattgcactccagactgggcaagagagtgagagcgagactccgtctcagaaaaagaaaaaaaaagaaagaaagaacaaactcaggaccaggagtctcaccgggctgtggtggtttctcagcctgcgtgtggccttgtgaacttgggtaagtcacctcttgcttctgggactcaaaactggccagtgagctttcccctgggtttaggaaatgtaaggatcaataatagagggtccctgcctttaggaagctgacagtctagagagggacacagccaaagaaacagattgctgtaagtcaatgcagttatttctgcaatagaaagatgaacagcaccacactgagaggaaatgaggagaatcagaggatacagtgaccaaccctgccgggggcagtcggatgaaaccttacagaagaagtgacgtgaagcatcacgggagtttgtcatacacagaagaggatgggagcactcgactgttgtttactttgagatttgctggctggggtgcatcacctgagctctattcctgccttctgataaggacgtgcccgaggttattacttggcgttcagggagggtcctggtacccctgtggaaactcaactcaggcaccgtctacatcctggcaaggctcagttagagggcagctcacaaaagaaatggctggtgggataggaacggaaaccagagaaggaggctggaggagggagtttcaggaagtaaatattcaatagcattaagtgctacagggatcaggaaagatgaggatggtgaaaaataagacaacgtttggcattgagaaaaaagactggagggaaatatagcagaatgctcatgatggttgcctctgggtggtgtgaggatgcatgcctgatccttttcctgctcctatgggctgctctgcacttgccaaatttcctacaatgagcatttatttgataaccaagaaatagaacaattgaaacttgtttaaaaaagaagtcattggtgaccttggcaggagtggattcagtagagctgtaccgacaagccagattgcagggcattaagaaagtagcagggggtgaggaagcagaagaagtgcgtggaacactcggagagagagctggcaggacatggaagggcagaggcggttccggaggcagccaggccaggtagggatgtttattcttaatttaatgtgggagggacttttgaaagtgataaaatttcctgcatcaaaaatcaggatcttataaaggacttttgtgccttttctgaatataagacaaagaagggctgggtgcagtggctcatgcctgtaatcccagcactttgggaggccgaggtgggtggatcatttgaggtcaggagttcgagaccagcctggccaacacggtgaaaccccgtctctactaaaaataaaaaataaaaaataaaaaaattgccgggcgcggtggcacacacctgtaatcccagtttctggggaggctgaggcagaagaatcacttgaacccggaaggccaacgttgcagtgagctgaaattgcaccactgcgctccaccctgggtgacagagcaagactccacctcaaaaaaataaataaataaataaataaaaggcaaagaaggagaaaatttattggaatttctaggacttttctgtggattgtagagacaacagaaaaaaagaattatgaaagtgggattgtcctggcaaatctaggctttgaggttgtttatcgtgtgggtttccagtcagaggggaaggaacaagtaaagaaaaagatagagaggatgttaagaaacagggaagacccatgttcacagcggcgttattcacaatagacaaacggtggacgcaacccaagcacccatcgatagatgaatggatcaccaaaatgtagcacatatacacaatggaatattattcagccgtaagaaggaagggaattctgacacatgccccaacgtggatgaacctcgaggacattacgccaagggaaataagccagccacaaaaagacaaatactgtatgattccatttatatgaggtatctaaaacagtcagactcatggaaacagcagaatggtggttgccagcgactgagggaaggaagaataggaagttattgttgaacaggtacagagtttcagtctggaaaatgaaagttctggagacattgtgatgacggttgcacaacaatctataacttagtggctaagatagtcagttgtatattatgtatactttaatcataatttaaacaaattaaaaataaataggtaagtagaaagaattaccccacttcccagagaagtaggggagaagtggggaaggaagtcttcctggatggcaggaccgtccctgagtgtcccaacagggatggttttggaaatgtgtaaagaacactttttggctaagagcagtggttcatgcctgtaatcccagcactttgggggactgaggtgggtggatcacctgaggtcaggagttcgagaccaacatggcaaaaccctgtctctactaaaaatacaacaaataatggggcgtgatggcggacgcctgtaatcccagctactctggaggctgaggcatgagaatcgcttgaacccaggaggcggaggtttcagtgagcagagatagtgccactgcactccagtctgggcgacaagagcgaaactccatctcaaaaaaacagaaccctatctacccagagcacagagtgaagatgggaaagggagatacagaaatagaagtggaggagggaacgggagtgagcccaagcgcccaggtctatccccacctgctatggctaaggtttagagaataggttggacttattcaccattcgtttgttcaacgaggtacagtacttcagcaccagcatacacatagcgcctttgcgtgaatcagagaacaaacactacctctttcccaggcagatacagtctcctgggtgcagggcttagctagcaaacaatatctctgtgggaggggggagttcaacccctacctggccacttggctgacagcctctatattataagcaacttacacagatgcatcatcagccctgtgtaccaggcactgtgctagattctgcagagttttcttagctatagaagaccagtccgtgctctgaactatctaatgttgcaagtgttgaaggagccaggggaagagagaggaggtcttcgacagcatgaccctgaacctcatgcactttgcttctgtggggttctaaggccaggaagcagggatgcaaaagatggcaggagggactggacttgggccttcattgcaaacccaatggcaggtcaaggccacgggggtgtggggaggggctgaaggggctgacttggtgtccaggcttgggaggagcccggtttggctggggaggaaggcacctggacactacacacctgtgtgaggtgtgcaggaagtctgcctgctgcctggagaagtcaacttgctgctggtcgccttagggaggtgaagcctctccgtactaagcctggtatacagggagagccggtcaacttcgactcctctgaattatccctggggcagaatgcctgtaaccaattttaaccagaggccggcaggcctggctgcatctgatttgtgctgccttccccactgtcagcacaagcaagataatgatctttgggctatctatgacacggggtaacagacttttgagtcggagaaagcagtgttcaaattccagctccacaatttataagctaagtgatcctggataagtctcaagtttccctacctgtaaaatggattcaattataccatccccctaggagttgataaagatggaatgtgttgatgtttataaaacacccagcacaatgcctgtacaaactaaccaatgttcaggggatgtcatttcacacacacacacacacacacacacacacacacacacacacacacacacacattctctctctctctcacatgcacaaatacatgcgtgtgcacaaccacttggtttgggatgtccacatcagtgaggtctgacacctggcccatatcattggggctggtacaggtgacgggaaagactcttatctgcagcagagaaattcctactgtccacttgctcggaggtccctcatctctcctctcttcctctcccaaccagcaggcttagagacagacctcctctgctgcccacggcacagcctcacagagcatgccacacgccggacacggcacctctcaggcacttatgctgaagtatgaggtggtatgctgactggcactgcaatgcagtgaggtacaccgtggggagctgagcggccctgggatgaattggggtacactgtggggagctgagcgaccctgggatgaagtggggtacggtgtagggagctgaggtacttcatgatgaagtgggggtacagtgtggggagctgagctaccccatgatgaagtgggggtatggtgtggggagctgagctaccccatgatgaagtggggtatggtgtgggaagctgaggtaccctgggatgaaggaggtacactgtggggagctgaggtaccccatgatgaagtgggggtatggtgtggggagctgagctaccccatgatgaagtggggtatggtgtgggcagctgaggtaccctgggatgaagggggtacacagtggggagctgaggtactccgtgatgaagtggggaatggtgtggggagcggaggtgcccatgatgaatggagtatggtgtggggagctgaggtaccccataatgaagtggggtatggtgtggggagctgaggtaccctgggatgaagggggtacactgtggggagctgagctaccccatgatgaagtggggtacagtgtggggagctgagatgccccatgatgaaatggggaacagtgtggggagctgaggtgcccatgatgaatggagtatggtgtggggagctgaggtgctccatgatgaagtggggtatggtgtggggagctgaggtaccccatgatgaagtggggcatggtgtggggagctgaggtgccccatgatgaagtggggtacagtgtggggagctgaggcacccatgatggcgtatggtgtggggagctgaggtgccccatgatgaagtggggtacagtgtggggagctgaggtacccatgatggagtatggtgtggggagctgaggtgccccatgatgaagttgggtacagtgtggggagatgaggtaccccatgatgaagtggggcatggttggggagctgaggaggcccatgatgaagtagggtaaggtgtggggagctgaggtacccatgatggagtatggtgtggggagctgaggtgccccatgatgaagtggggtacagtgtggagagctgaggtacccatgatggcatatggtgtggggagctgaggcgctccatgatgaagtggggtatggtgtggggagctgaggtgccccatgatgaaatggtgtacggtgtggggagctgaggtacccatgatggtgtatggtgtggggagctgaggtgccccatgatgaagtggggtatggtgtggggagctgaggtacccatgatggagtatggtgtggggaactgaggtgccccatgatgaaatggggtatggtgtgggaagctgagctacccatgatggagtatggtgtggggagctgaggtgctccatgatgaagtggggtacagtgtggggagctgaggtacccatgatggagtatggtatggggagctgaggtgccccatgatgaagttgggtacagtgtggggagatgaggtaccccatgatgaagtggggcatggttggggagctgaggaggcccatgatgaagtagggtacggtgtgggaagctgagctacccatgatggagtatggtgtggggagctgaggtgctccatgatgaagtggggtacagtgtggggagctgaggtaccccatgatgaagtggggcacaccgtggcaggtgagtaccccaggatgtagtggagtacagtggtaaatggaggctcactggtgagggcagatgctctgttgagaagcagtgctaccttctgcttcataaccctgccttctcttcctgcctctactactccactttcaaattagacatcgctgctcaggattccttccctagaaatcgacctaaaatacctctcctacagacatgaccctgaggacaaccagtggcttctcacctggggtcctggctcccagcactgtgtgctgctgggtgagagttccctttgtgcagagcccacttaccacgtgttggatggatgcgtccattaaggatgggatggatggagtacaggagtccatttcgcacacatttcctgaggtcttcgaggtgtcatgcacctgctggcctctggggatcagacgggaatataaactggtccctgttctcaaggagctcacacaggcccccggcttcacctgggctaagaggtatgacccacacacttattcagtgtaggggacaggccaccagctctgccttggtaagccggggaaggctcgacagagttggtaatctccgaagtgggctttggaggaggcatatgagtggaggaccacggaacaggcattttaggctggctgtcagtggcttcaggaggttctgacttggtgggagatacgtcctatagaggttctccaaagacccacagtgccatgctgattttctgaaatccagtgggacttaggtagggtgacaagggcagtgatggagctacagttgtgtccatttagagggaagtaagagtgaggatggtcagagaacctggctacacccagctcttgcagtcataatcgattcctttccagtcaaagagggtgggagagtggtttttctccctcagacagaaggatgaggctaggagggaggagctgggtgggccgggcgtggaccagcttggccctggtggacctgcagttgggcgggaggatgctggttatttgactacaatgtatatttaaaggtctcagttacaatgggccccgggcgctctgtaacaagctgcagctgtcccattgctcattagctttcctaacatcttctcggggctggtcctgggagagcagcccccaagctcctccctgtgggccggggccctgaaaagctgacttcttgcccccagcctcagagctgccatgatgaatggcgctgctgccccgtgcagacaaacgtcttccaggaacaagccccgtttgtttaaatcaaatgatcaccatcttctctggcaaaagccgctccctggactcaaggcccaggcctgcctcaactgccacccacctgtccctcttcctctggacattaggaaaggacacatcaaggggtcaggagcagctctagccactgtcctcagaatggggacagagcaggatctccagggccagcagggcctggtcgtctttggaagtggggtgagaaaggactaagctttcacaagacatggagaagcagccagcagcatgggaaacagggcctcagctgtgctgcatctgtgctctgagctttgcactttctacatgtgtctctactcaagttacgcctctcctggcttcagacccctcaagcatagaagagtttgttaggtccacagctctcaaccccggctgcacactggggtcaccagaggaacttttaggaactactgattcagttgggttccaggcactgccatttcttcccctcaggccctcaagcaattctagcatgcagcaatcggtttgagtagccccaaggtctctgacctcatggcttatcaggtcttctttgaaaagtcctggctgcttaggaaacacctccaggaagccatcagtttgcagactgtgggtcccaagaagttcctgtaccaggagttcttcctaaagaaacccacctggactggagcaggaagggaccccagagcccaccttttccaacttggttttagagatggcaaaactggggagtgctcctcctctccttgggaggacccccagctcagacgggaagtgctttgtgaacgtaaagcaccaacgctgggaaattactacagatggagttgttgaggatggagattggggcactggaattgtaactcctatctgtctccccaactagattgtaagcaccttaattgcagagaccaggtctcctttgtcgtgtgtgtgtgtgtgtgtgtgtgtgtgtgtgtgtgtgtgtcctcctgacttagcaataaatgactatgtggatggatggatggatggatgggtgggtgggtggatggatgggtgggtggatggatggatggatggatgggtggatggatggatgggtggatggatggatgggtggatggatggatgggtggatggatggatgggtggatggggccttccacaggtgaatttcccttccttacttatcactagattttgccatgggtcacctaggctgtcatcaccacggtcactgctgtgaataatggagtgtcaggagctgagggaggcagtagggtattgagagaacctgttagccttgggactcaggggagggccattaataaggagtaagcatctgaagctggtcctgacaggcttgctgtgaatggtgaggccagattacatgcccattgtaccctgctgtgaatccacatctccctaagccccatcacacagtgtagccgggaatttctcaccctcaaaggtctttcaaccaaaaaaaaaaaaggccatttctgcccaaggaagaatgtggacctgcaggttccaggtgggaaggagaggggctcagggtctgggtgaggacagaagttggtgctctgaccttagtatgaataactccagcaaagtcttaattcctcaaaatactgcccaacatgcaaccggccaccttttattgaacttccacgtgggcagacactatgcttgctgaggatacagaggtaaaagagaaagaccctgccctcagaggacttatggtcaaggagtagaagctgtcggggaaagggcagagggctggtgagccacggaggagaaagtgctggacagggcatggaccccaggggtggcttcatagagaggcaagatttaagctcggtgggagttcttcagtgtggctcccgggaatctgaatttctatctctctcttttttttttttttttttagatagagttttgctctgtcgcccaggctggagtgcagtggtgcaatctcagctcactgcaacttccgcctcctgggttcaagcaattcttctgcctcagtctcctgagtagctgggattacaggcgcgcgacagcatgcccagctaatttttgtattttcagtagaggcggggtttcttttatttatttatttattttttgagacagagtctcactctgtcacccaggctggagtgcagtggtacaatctcagctcactgcaacctctgacccctgggttcaagcgattctcctgtctcagcctcccaagtagctgggattacaggcatgcaccatcatgcccagctaatttttgtattttcagtagagacggggtttccccatgttggccaggctggtcttgaactcctgacctcaggtaatccactcacctcagcctcccaaaatactgggattacaggcgtgagccaccgtgcctggccaaatctgaatttcttctcaaatgcatgggggaatctgttgtgccgacatggttaggaatgatttgtctagtgagtggtggagaaggcatcctaggcagaagaaactgtatgtgcaaagaaagggaggtgatctaagggcacagaggtaacggcaaacagtcaaatatatgtgtagaaaccaggttatttgggggaaaggggatgcaactagagtgggaggaagaaaatcaaaatgccattttgtttgaatcgttgaaaataattcccccaggaagcagtaatccatttcagccttcctcattcagtgctgatttgcccaagtggcagggagatctggtgccgattaccaggtttcggtgcattaggtaatgcaacaataaaatctgggtcactgcagcacaaagtcccctttattttgacaagtgtagtttttactctgaagtgttatcataaataattaaattaaaccagtaaatgggttgtagtatgctttgctgcagtaacaaagtctctgtaaccccagacactgagccactcctttgggggattcttggctcggaaacatttgggaatttttcagaagtcaagaatatttggagtagtcaaaggagagaggtagggctgaaggcttgttccagcccatcctgctgccccgtttcccactgggcttccccatcctgctgcacgccattctatcatttgacctgtggcagcttgaatctgtaaagggatcactcctcagccctaggctggcctcgaatgaagaagggtagagagtcccagtgcacatattgggcagcctctttttttttttttttttttgagacagagtttcgctcttgttgcccgggctgaagtgcagtggtgcaatctcagctcactgcaacctccacctcccgggttcaagcgattctcctgcctcagcctcctgagtagctgggattacaggcatgtgccaccatgcccagctaattttgcatttttagtagacacgggttttctccatgttggtcaggctggtattgggcagcctctttttttttttttccataatgcccgctcaggcatcagggcatcaataagtaaatacttcaaatcttagggtagaaggtcttgcagggactctcaagaccaccagacaacccaccaccatccatgacttttaccatttcatagacatgaaaaccagggaagtaaagtgacatgacccattgcttgttggccgatggacaggataagtaacatgcagaacgtgagtgccaaagacgcggagacccaaaggagaatgtgctggagacacaggggctgcatgcaggcagagaaaggggaagttgcaggaggaaggaaagaggaaacggtaagaggcaggggtgaggtctgctagagggctgggagctttgaaccaagtcttcaggcggagaccctgaggagtcatcaccggagccctcaagtactcagacatctgcccgctgcatcaggacagttctcaaaccaagcaagagagaaataaaatctctgtagtgaagaaggaaaaatggtgctggagagaatacccagaggcggaacctgctggctttaaagcaggagatttcggtccctccccagggtgagtggggctgctttttgcctccttctctaccatctgccccctccgctctcccatcgtcctgcctgctggacatccaggcatcagcttctgtcacccttgtcagggcctgcagataaggtggcagttggtggccagattagagggggagtagcattccactgccccctcttttggtggcatccaggcctgtaggactccatgcagggacaactccattcgtagagccagaactcccagtgagagttctagaatgggggctccttccgagtcccagagcctccagctgagccagctccagggagagcgtgacaaacaggtatcctggacagagaggactctggagaccagaagagcctgtcagaatgaggggccgaacagcacacacggccttccctcctgcccctccacagaccggctgtttttcatagcacctttagtggaaaggaaagcatgtttctctcactccatggaactctgagctatgtaaacaatagagatagagctggaacaaaaatcacctacagggccgatagctgcaccagaaatccctccagggaggaggccaaggctccttggtgttcaacagcacaaaagctcagatattagtgaagtgtcggtgcccggggcttttgccccagggctgtggggtcttgtttagaggtcagtgaaggggaaggcccacacctggtgggctgcacggcaccccctccttctccctgacatctattgcatcattctcaaggtgtgtggaccagggacaggggaagtgagctcagctgacccagaaaccccggcaaggcctgtgcccagtttgctgttcctcaccggagacctttggggttctaggccactcttacgtggtgatggcagggcaggtgtgcacaggtctgcctatgaggtggggatctgcaactgtccccagaaacccactgctaaactgggtccttagggacttcaccgccctgctggcctcctcctccctctgaggcatcattgactccaggaagccctctgtgaaccccaaggctgcaccctggggtgccaagcttctctgtgtgcctgcactgcaccctgtcatactcagagcttatcatctcaagcgtatctccttaagacagggctgtgtttgacttatctctgtgcacacttccatatacagtaggtgctcaataaacgcttgttggacagaacggggcatctctaggccaggcctggcatccctggtcaggacggcttcagtgggaggcccagttctctggcctcagctgcccttggctcagggggtccagttcgggagagaccagggtggtcagagcgtgcactgccctttaatccaggcctgggttctttcccgcgtcacggccagatcccatctcctcttcaacacatagcgctgtggctaccacattgcctctctggcagacactgtggggatgtgtgtagtcaggttgcagggagggggactttaaacaaacagtccatggccccagtcagtgccaaggctcaccgcatccccagccccacaccccctctccagggcgagccagcttgctggaccgtgtgaccgggagcccgcagaattcatttcacaaaaaatgttttggtgctctgcttctcaccccatccccagctgggccagagagcacctgagtgcccctcctgctctccctccctcttgggcctttcgccccctaatccacaaagtggggagcggtcatgtgggccctcagctctcgacaggaagctgtcaggcacagctggctcgccgggccagctcccttaccgccagggaggcgggctgccgtccccgagcccggctcgctgaaacccaacccctctttccagctgcagctcgaaagagcccctggccagccttccccagggaccctgcagcctgcagatctcacggtcagggaattttccctgcgcagtgttccaagtcagccaagcctccagaacaaagggcagagagacagagaccggcctcttcctatccccccataagtggcaagaaagacccagcccacagaggctgctcccctgatgtgggggaagggtatacccagaggacaaagaccatccttcctgggaggcctgtgcctcgggaagcactccccggaggagccaggaccagatagatttgcagcagcccccatttcttccaccccagggaggaaagtgacctgtactggccctgacatcccaagggccacgggtgtcaggaggcctgtgtcagagtcaggtgctgcacagaaggggattgttgctgattagtgcggaggcacacattccagaacgcagtgattcctttccctggggaaaatgcaatttacaaaagaaaaatgggccgggcgcagtggctcacacctgtaatcccagcactctggaaggcggatcacaaggtcaggagatcgagaccatcctggctaacacagtgaaaccccatctctactaaaaaatacaaaaaattagccgggcgtggtggcgggcccctgtagtcccagctactcgggaggctgaggcaggagaatgacgtgaatccgggagacagagcttgcagtgagccgagatgatcgcgccactgcactccagcctgggcgacagagcgagactccgtctcaaaaaaaaaaaaaaaaaaaaaaaaaaatgggacttttttgttgtggtccctaagaacagactgttcctcaaactcagataataaactgctgtcaagcagcagccctggtaacatgtaatagagtggagagaaacccgcaaccagcattggttcaagctctgatatcatcactaactagctatgtggctggtctagctctagggacaccccaaagccattgtggccaggacagaatatattataactaacttctctgagcctcattttttctcatctgtaagatgggactagtattgtttaccaggcctacttccttcatttagcaaacattaagtaccaactgtgtgccaggcactaagtctgttgctggaagctgagaaataacaggattccccaccccaggtcacattaactaatgggtataaaggtgcttggaaaactgaaatgctgaaataaatagataaggaccagctgtaatgatctcattaactttctgggaatgaggctgctaaagtgatttttaaagttcttaaaaacagttaagtaagccagacctgtctctgtaatctggcctgcactatttatttgcttagcaaaccatttcttcatagatagtgcaaaaggaaagacttcagaccagcccgaggcagaatttatcccaaattcagagtgagtggggtctgaattaattaggtctttctgtagcttaatgtataaacctgggctcaggaaatttggcctttaaagcaggtgccctttcaaatgagtgggtttcatgtgactgttttaacttcagcttcattaccctttatgggctgcaggagtggtggggggagcaggcaggagggatctggtgtgagtctgcttccgtgaatggggagccaaaggaaccgtaaaacagcccctgggtcctcaacagccttctcccaaccagggcctgccaaggtgacctgcctacctccccatggaggtaaattcatacttacagtccccgtctggggtctcctccagtctcaggtgagggcaagggccaaggctcccagtcctacttgtggggctggtcatctgctggggtttcctccttcgatctctcattgtccttgaacttcttgttctagctccttggcagcctccaaactccacagcgtgagagcgctgtgccaggatactctctcactcaagaacccgcggttattccctactgcctgaaagtcctcagcccccaccacctgctcttattatctgctcaagatgctccaggtcacccgtccctttagacagtccaatatggcagccaccaaccacccatgactatggagcacttgtggccaatcccaattgagatgtgctgtaagatatacacccagataatgaagattcagcatgaaaaaagtaatgtaggctgggcgcggtggctcacacctgtaatcacagcactttgggaggccaaggtgggtggatcacctgaggtcaggagtttgaggccagcctggccaacatggtgaaaccccatctctactaaaaatacaaaaattagctgggcatgatggcaggcgcctgtgatcccagctactcgggagactgaggcaggagaatcacttgaacacctgggaggcagaggttgcagtgagccaagatcatgccactgcactccagcctgagtaagactctatctcaaaaaaaaaaaaaaaaaaagaaatgtaaactatctcattagtaatgcttataatttttatattgattacatgttaaaataatatggatatatttgattaaatagaatatattattaaaatgaatttcccctgtttctttttacattttaaatgtggctactagaatgtgtgaaattacccatgtggctcccatgttggcttgcagtaatgtctaccagccagcctgctctggagcaccatgcagtgaaagtacctgggctgggttgtgggcagatttccctttcggtgctatttggtatgtaacctttccaaacctctatttccttttgttccaaatgggattaaaagtacctgcttcagatgattactaggagaaagagataagccaacagctgtgaaatctactagcagagagcagttaactcaatacgtgttggtttccttccttgtcctttccaaatcacatttcaaaacactttttagagcactggttctccttggatgcacccagaaatcacctgggaagttttctattaaaaaacaacaaaaaaacacaacaaacaaacaacaacaacaacaacaaaatatatatatatatgcccaggcctggactccattctttttctgtttgtttgtttgttttttgagagggagtctgtctctgttgcccaggctggagtgtagtggtgcgatctcagctcactgcaacctccacctccagggttcaagcaattctcctgtctcagcctcccaaatagctgggactacaggtgcacaccaccatgcccagctaatttttgtatttttagaaagatggggtttcaccatattggtcaggctggtcttgaactcctgacttaaggtgatccactcgtctcggcctcccaaagtgctgggattacaggcgtgagtggactcttttttttttttttttgagacaaagttttgctcatgttgcgcaggctgtagtgcaatggcgtgatcttggctcactgcaacctccacctcctgggttcaagcaattctcctgcctcagtcttctgagtagtcaggattacaggcatgcaccactatgcctggctaattgtgtatttttagtagagacatggtttctccatgttggtcaggcttgtctcgaactcccgacctcaggtgatgcgcccgccttggcctcccgaagggattacaggcgtgagccactgcgcccagccggactccattcttaatcggagtcagggtgagtttaattggtcaggttgggacctgggcatcagcatagtttaaagggctccaggtaatctaatgcatagcaagggttgagaattcctgcgccagaagaaccagttgctccttcacccctcaatgctctgaccctgtgctttatatgctgtccctttagcattttacatgtgttttgtgctactttaatgataaccaactttcctgaatgcctacctggacacctttcctgaacatctggcactttacgtatagtatctttaatccttatcacaactcggcgaggtaaattagattaaccccattctgcagatgaagaagctgaggcttagaaaggttaaagtaacttacttgttaaatcagtggaggggagccaggaggaagcactcaaccccccggcaagcctgactccagccattgctccctagactatgctgcctttgctttcagtgattcagtcacaagaatctacacgtccaggggtagggtgctttcttcctgtttgcaacagttctcaaatgaggcattcagcagccccttgataaatactgactaaacctcagagtacctgagttgttttttgtttgtttgtttgtttgttttgagatggagtttcgctctgttgcccaggttgggcgtacagcatacaggctggagtgcagtagcatgatctcggctcactgcaacctccacctcctggcttcaagctattctcctgcctcagcctcccgagtagctgagattacaggtgggcaccatcacacccaactaatttttgttttgtttttttttttttgagacagagtttcgctcttgttgcctaggctggagtgcaatggcacgatctcagctcaccacaacctccgcctcctgggtttgagccattctcctgcttcagcctcctgagtagctgggattacaggcatgcaccaccatgcccagctaattttgtatttttaggagagacgggggtttctccatgttgctcaggctggtctcgaactcctgacctcaggtgatccacccgccctggcctcccaaagtgctgggattacaggtgtgccgccacctccatcccagagtacctgtttgagagtatccaaaagcaggctgagaggctggagagctagcctcggggcccataaggattcgggtctgtgctgcgctctgctgtgcgccgagcagtttcagagccaggggagtttcagggctgccctccgcaggcaggcctctaacaaggacaggacagctctgaaaaggacagtgggcgaatgagagaggctccttggattctaatgtatcattctcccacactcagtctctcttagcaactctctgacccaggaacactattgagagcacaggtccttcatggtcaagaaggcaagagacctgactctggtggctcctgggtgggtggcaggtgccctaaccctaccctactagtgcctccaccacctgcaggtcccctccccaatctgccaccaccaagggctgcctggattttttggaccagctctgagtccatgtaattgctttgttttcaaaataggtggtgtgttaaaggcttgactaaacgggattcagtttttctacttttgtaagacttcaaatacaaatgttcttaagtcagaggtgcctccacccacatgatggactcacctgcagccattcagaaggaggacgggcaaaccgcacagtggcacggaaagacaaggatgatggccgcgaagtgggggcagcatccgatccacattctaaaagtagcataatcaccattactaaacactaaaaaaaggaaaataaagaggtaggagagcggggg

SEQ ID NO: 591 - DNA, 73804 bp, Homo sapiens
atgtgtctccgggttcaaacccaggcacaggccaagcgttcttgtttgttgagggcggagccaatggcgggggagtgttgttagcgcgcgccttccggatcgcagctctcgcggcagtcgcctgagacttaaggttattgcttggccgcggcctggtattccggcgattcgtttcttgctcggcttcctggagctgtggtccgtgtgggcttccacctcagacagttgcgctggctcagcggggccggaacatggctgcgtccggtctggtaagtgcaggccccccgctccaggcgagtggttgagcggctggctggggcacgggcgcccgaggctggggagaaggaaatgctaggctgaggctgtgatctctgagggatttcagtgggaaagccgcaggaatttttgaaatcaagtgtgatcgtgtgtcgataaccagagttaatttactgtacttttattatttcttaagttttcatgtcgtcatttcgtctgtgcctacgtcttactcttgagaggtgcttgtgatttctgctgggtttttttttgtttttgtttttgagacggggtcttgctctgtcccccaggctggagtgcagtggcgcgatcttggcttctgctttttagtctagctccagttcctaggcctccaaataacttttctccccatggtagaagtattgaaacgccttaaaagtgtgtctttgcgtcacacttggtagttgggagaaacagattatgtaacaagtacgtctcgaaataatttgacgttttcagttcttctgtcaaaatggtggccttttatgcagttcttgaggctgatttatggagcatatgttattgacaaactcttctgaaagacagctatcagttaaaaggtacaagctgtgaatgactaatgggggcgacaactcattttgtttacatatttctggacttctttggtgttcactattctatatttcatactttggttatggttactatataaaaatccgtatcatttcttttctaatttatctccccttctaagaaaatcttcagcttcgatgatctcccattatgtgacgttatacatataaacataaagagttgtatgaaagaataatataatctatactttttactatgagcacatatattgtttacattatatataatcagaagaaagcaataaagccattctcactgtggggagagaagcggaataaagcttaccagatgcctgcagttcagtttttaaatgcctgtcataacctatgttatgtcataacataacctcaaaattgttttgagcccttaggagatgtttggtgtatagcatgcccatactggatgaagttactttgaaaataaattttactcgactctatcttaaagaaaccaaattgatgatttacttttctttcaggatcatctcaaaaatggctacagaagaagattttgtcgaccttccaggtgatttacgtacttaagcttttaagattatttttattctcatcgttaatagatttttaaatgaagaaaggaaaaactatcacctctgactaatataatgatttctgtgcccactgattaagggtagtcatcttatactaacgggaatgttaatgcaagcagtgcaatgactttgtggctgtgaaaaaagaaattcacctgataaaatagtggaaccaggaagagggagtctcagttctgactaagtgactgccatgggaaaagcattttgtagaatgaatcaaatggtaaaattagaaagatgtagcttattcagtggggcaaaaagaaaaatagtacatgctgtcgtgcatttgttgagtgcttgtttgggttgttttggttcttcttttagttgtaaaacctgtaaaaagtaaattttctagttaaatatttactagtaataggatgaaaagcatgtttttaaaagtgaagatgttattatgaataacgtcatgtttattgagctgtgattttagtaggtccaatggggcacagaagtatgttcttttgtttacaagaagcttagatttctgttgggaaaatgtatatgtacatttgtgaaacaatttaatggacaaaaattattacttgcaatactgaagtaatgacttgtgtatcatagagagtaggcctatatataattaggcattaacttgcagtatagacagccatgtgagaaattagggatttgtgtgttgttgatattaagaaaagctttaaagttgtagtgtaactttggtggaccttgaacaggtatttaaagactaagataaagtatattccagacatagaaagtaacttaacgaaggaaccaaagtaggaatacatatatttgtcagtagcagagagacctgatttaagaaggttgaatatgttgggtagaagtggaaaacaagaccatatgagttggattgagccataaaatggatatgttaggctttaggcatctattataggcttgaataagctctcctaaatcttctgtggaataagggctatctgatataaacacacacacacatttaaaaaagcaaagatgtttgatgtttacaaagtagcttaaggagggtgttgtagtaatctacacatggtggaggtgcttttatgctaaggtaataatgacaaaggggaagaaaagacgaatttgataaattttgaaaaagctgttgcctaatgtgacctgcgttctaatagtgactctgcattatcaccttggcaaatctgatctttttggatctcatccttgaaacaggtaatagcaggagtgtatttatagctgtgcaatatgtgcacctgtaggtggtattttggggtgatgtcaaggccagaatttataatagtcacctatatatattctggtagaaaaccggccactaatactacttaggtttacaaactgaggtaggccatttgaccattttgggtttcagtttgcctatctgcaaaatgagggcataggattcagctaggggtttttaactagatttgcacatcagaattacctccatcaccctaggaaatctaattaaattggtttgtgggaagtgaccaattaagtgtatttctgcaaagctccaaaagtaactttacacatctatttggatgatgattattggactggatgatttctgagatctttcagttataaaactttatgatggatgacctgataatgcactgtggctcacagtttttaattactgcatatatagtacttttccagctctcaataataggaatgttgtagatcagggatcagtaaactctggctgataggccagccaaatgttttgtcacaggttttatttcaattttattggaacacagccatgcctctttgtttacatactgtctgtggttgcttttgggctagaatgggagagtcgactggttgtgacagagactatggtttacaagcctaaaatatttaccatctggccctttaagcaaaagtttgtccactctgttagagatgcatgtcaattttatactgattgaaatccagatgttcttcaacaggtaaatggttaaacactgtggtacacacatagcatggaacattacttgactctaaaaagcaatgaaatattggtacattcaacttggatttatttccatagaattgtgttgagtgaaaaaagccaaggcaagaggatacatgttgtatgattctatttacatataattgtttccacatgacagagttttagaaatggaggacagattagtggttgccagaggttaggaatgagaggaggcaggaaggagatgagagaaaggtggttatgattacaaaaggacaatagaggatctttgtgatgatggaactattcagtatcttgactctggttgttttatctgcacctacagatgtgatacattttgtatatatacacacaaacatgagtatgttcagaaatgagtacatgtagaactggagaaatcacaatagcattggtagattgtatcaatatcagtatcctgattgtgataatatgctatagttttgcaaaatattagcactgaggagaactaggtaaagtgaacaaggggtctgtattatgttgtatagctggctgtgaatctacaagctcaatataatttttaattaaaatttatactgattcataaactgttaagattaatcaatgatactgaattagaaatgcatttgagaatttatagggaggaatatgttacttggagatgtgactgtaaagtctgttaaagaagcatttcaggactgattggattcattcaaaaaaatttgtgtttttgagatacagcagtaatctaaaacagctttagacatggctgttcaactaagaaatattaattgttaaggtagattatgatatactaattcttattaggaaggaaagagttcacttgagggaatgtatagaccctcaagtacttgttttgtcttcaaatagtaaagatattttacatattaagtaaatttatattttataatgagatgtggaattttcaaagagatggtaatataaagaaatatcttctgaaaatgacaggctgtatttttcctttattagggcacgtgacattaacacagagcaaggccagaatgttctggaaatcttacaagactgttttgaagaaaaaagtaaggcttcatttcaagatggaatttaagggttagatggatgaaaatatgaatttgtcatggtaattaatatcaaatgcagcaaatatgttctagggtttaaatatatggaaaatattttccctggtattttgagttcatatgcaatcctttgtgtaccttctggtatacttaggataatactgacaaaaaataataatttgacaataatttgtcatcccgtttagttcacattaaattactgtaatctggaagtccatacataattatcatacacaagaaaaagtattttattatttatttatttattgagacatagtcctgcggtgtcacccaagctgtagtacagtggtgctatctcaactcactgcaacctttgcctcccaggttcaagtgattcttgtgcctcagccttccaagtagctgggattacaggtgtgtgccaccacgcctggctaatttttgtattttttagtagagaccaggtttcaccatgttggctagtctggtctcgaactcctgccctccagtgatctgccctcttcagcctcccaaagtgttgggattacaggcataagccactgcatctagccagaaaaaatatataatgaaaatagatgtgtagaattcttggaatcgctggagaatttgagataatctttggtgatttacatatctgtttaaggaagtcataaattacagcaaaaacttttccaagtgctgattagcatcagcaggtattggaataagagaataagccagccaaagaaataggggcagatgatagaaaagaatgttttctatacaagctctgaaagaagagctggcatatattgatacttcaggtgttttgtttgcttttctcatttcctgatgcttctcaggaacatttgaatattaaattgaggtctctacttgatttaagctaattgtggtcagtgagtcaacagatggttcttcacatgtcatatacagctacttttaattgtgactaatagatattacactatatcttgtttttgaaaatttcatacttttgttttaggtcttgccaatgattttagtacaaattctacaaaatcagtgcctaattcaacacgcaaaataaaagacacttgtattcagtcaccaagcaaagaggtaagtgataaagaagagctggtataggtttaatattttaatgaatgaaggtatacacaatatactcatgtatattttagttgtttgtaagtcttattcttgaaagggaattctatattcccattgactttctataaaatttggaggtattttgtgaaaagttttatttgatattttctgttggaattgggattatgggaattagaattatcaaattataataaacatttttcacttctcctaaaataatactcaaattaggtttttaggaaaatgggcagtgatcaaagttgctaatcaggttggcagggttggttatattctaataaatgaaggcacttcattgttatacggggaaatcaatcttctgttgattatatattttaattgctgttagtttgatcagaaataaagtattggttgacttaactatactaagtagcagactttcaaataaagtatttgaagctaatctaaggcaaattattcaaaagcacaatactaattagaaaaatcatatagtgctagaagtaacacttactagaaaactgtaaaaggcaatcaacatattaaacatatgtagccttttggttccaagcaatgcagacaaaaccatttctttcagaattgagaggccttctgaaacttgataaattacaatggtttttgaaagttaaagcaactttaggttttctgggataaacttgacttggtcataaagtattaactttttttgattaggtttgcctaatattgaagatgtttgcatctatgtttatgaataatattgtctttttttgaaaaatgttcttacagggctttggtatcaaggttatgctagaggttcctcttctaggtagaatgcagtaagtcacagaaggctaacactcctgctaaagcagctattttaaaaaatggaaacaaattttagatatatgagaagctgtggaaacaataaagactagcaaaatatagtctgtggctaattttcttcccttctgaggcaaaattcttctctactgtgtcccgttacttatggaggttttccactctggctggtagattattctaggtcctttgtaactgggaggatattccccctcaaggcttcgggtggttctttctctggttttcttacaacgcattctctgatcaatatttgattgaatgcttgagagagatctgcacattctgcagttttctctatgtaaccgtctcctgtccagtactttatcctgcaaattctaaccactttggtcttcctgaatcctcagctttggctcctcaactgaggatttcccctgtgtgtcacatctggaaatgggtgatcagagggttcacctcatttgtttcccatctcaagaatcattctctttggtttttcaatgtcgtatttcttgagaatcttgtatgttttttctttttttaaaattgattcaggcaggagggtaaatctggtcccttttaagacattgtgctctaaagccaaggtccactgcaatgacttctaaatgactttaggccaaagaagaaagcatgttgggaatataaaatattctgaatgaagataataatatgacttatcagaacttgtgagatttagctaaaatagtgttagagggaattcataactttaaatgtataataaataagaaatgttcaaaataaaggttctactctgtgtttgtactggtcttgtaaaatgagttgttcagtattttctctgtctcttttctcctgaagtgtttttatgaaccactattgtttctttctcaaatatttgatggaattcataggagttttctctttgcgagaattttaaaatactaatttatttatttatttatttattttctgagacagggtttcactctttagcccaggatggagtgccatgacatgatcacagctctctgaagccttgaacttttcctgggctcaaacccttccgtctcagcctgctgactacctaggactataggtgcatatcaccatgctggcctgcttatttatttatttattatttctctatctatctatctgtcttgagacaaagtcttgctctgtcacccatgctggagtgtagtggtgctatcttggctcactgcaacctctgcctccggggtacaaatgattctcctgcctcagtcccccaagtagctggggttacaggcgcccatctccacacctggctaatatttgtatttttagtagagatggggtttaaccatgttggccaggctggtcttaaactcctgacctcaagtgatactcctgcattggcctcccacagtgctgggattacaggtgtgagccaccgcacccggccattttaaaatttttctttacagaggcagggtctcactgtgttgcctaggcttgtctcaaacttctgggctcaagcaatcctcctgcctcagcttcccaaagcattgggattacaggcatgagcactgtgcctggcctcacttttgttttcttatgaaacataatacattaaaatacacaaattgcgtgtatatttcattgaatttttacaactactacctagatgatgatatagaacattaaagatttagattttacttaatagtttcagtagacaatttagattttctattttttttaaatgttctacttttctttttttagggatttgttcattttatttaaattttccagtttatttggataatgttgttttgtcatgtctttttccagtcttgttaatgtctgtaggatctacagttatatccccttttttattcctgacattggttatttatgccttatcttttttttttttttttttaattagaggtagggatcttggtatgttgcccaagctggattagaactcctgggcttaagtgatcctccctaagctaaggaatagctgggattactgctcgtaagtcacatgccactgtgcctgctatgccttgtctttttcatcgattaattttgtcagggtttatcaattttggtctttcagaaaaccaagtttggctttgtcggtcctctcatttgcttgtttttagtttcattatttttttcttaattttatttttcatatattctttatttttatttttatattattaattttttctaatccttgagatggatgcttcaaaacaacagagactttgtaggtgttagggtttttttttcaggtagggcctttccatgcagcaagcttggcctaggccttccacataaggaatgaaatttgtttacttgatttgaaaataaaatcagacttaagacttatctatcttataggcttttctgtttgcgaacttgagattcctaggtctagttattacttcatatttgtttgtctttaagtaaaataagatatgactccgtaggttttaactgaaacacaaccgagcttcatgaaataaattagtttttctcttctgttttctgggataacttgattaagcaaaaatgatctgtttcttcaaatttggatcatttgtaaaacatatggttggagctgttttggtggggatgtgtgtgattaccactttattcaatgatctattgcattttttatatttcttttgccagttttgacattttataattttcttgaaacatttcctctgttctcaatttgtgtatagtcaacttcatgatcttcctcatagttattactctctttttattgctggttttcacctttttaaattatctgtgttgttacaggtatttttctgtcattaacattttcaaagaatcagcagtctattctggttcactattttattctcttccctatctttttacatacttttcttcttaatttgttggaagattgatttttaaagctcaaaggcattatgtacatggaagttaaagtagttccataaattccacaaaaaaatagtagaccccacttttcctcctccaagtccaactttttagtcttagctattactctaggtattttgactccatatttctaaataatgtttatattgctgtttcttgattttttttcccagtctttgctattatttattggctttctactatggaagtttagactttatttgtcatatagtttctacttccgaccacaacacataaacttccattctttagtacatcataatttttagtaggattagtagttagtgtttatggtattattatgactgtttcagtagtcacagctatgtagagtactaatggttaaattttctttatgtacagttcttaattttctcttgatttaattttggtttttccatttttgactttctgtgcacctgtgactaattcatcaccagttttctatgacaaacgtctaagtataaatgtcttagtatgcatagacacattaatttatcattttcagctttgctgtccctgctcttttttttttcttcaatctacccttagacctatcacataggttttgtcatgtactctctctgtatcacagagagtccctttgcttttctcctgaattgcaactcttatttcttggatctgaaatcttccttttttcttggcctctccttttttggtgggactcatcctttagtagctttctgagaatttgagaccttaattgtttaaaaataccatggttttaccttcatgatgggtaatttgggtgagtacagaattctagattagaaattattttcctttaattaaaaaataatatatattttttcatatcaagcctcccttttagtcaggtgtattttcccttagacttacaaatgttgctttcttttattttagcttctcctgttgagaatactgttgtgattccatgatcctttgtgactatttttttcctctttgcaggcttttaggatcatgtcatctgtctttagtgatctaaatttttattatattccttgacattaggttcatctaacccttttcataaatatttcttcagtttctgttttctgcaagtaccttttttacttactttgctcattacctcgcctttttcatatgtccagtgatccttagctgtctcctcttgtttgaaagtgggaaactaaaacacattggaagctctatatgcctagtaaaatttgtagactggtggatgtcactgtggtgtagtttggtccatttcatcattggtatcctggtgttaatatctgtagatttcttttctcttggcctagtaagtatttctgacaaagaaatctttcccgcttggcggttcaagtctaactgcgattgttttcaatttcagtcagatgtggcaaaggggaaagtgcagtttaaatgctcctacttaatatctctggttttcatgtattgcccttaacttcacctgtgtcttatgccactaatatcacagtctctctgattaagaaactcaagagagtaaataatcttctgataggtttgggaggggctcttcggttttactaccttcttttttttgagaaaaagcactcctgggctggagtgcagtggcacgatttcggctcactgcaatctctgcctcccgggttcaagcaattctcctgtctcagcctctcgagcagctgggactacaggtgcctgccaccattcctggttaatttttgtatttttagtagagacaaggtttcaccatattgatcaggctggtcttgaactcctgacctcaggtgatccacccgcctcagcctcccaaagtatggggattacaggtgtgagccactgcgcccagccagtttaactacttgctatacacaattttttttctgcgacaaaagacacattcaactatacacgcttttaacaccctctgtttgcatgcctcttcttttttttgagacagggtcttgctctgttgctggagtgcagtggcatgctcatagcccactgcaacctcaaacctctgggctcaagtgatcctcctgcctcagcctcctgagtaggtaggaacacaagcatgcaccaccactcttggctaattttttatttttacacagagatgtggtcttgctaagtttcccaggctgatcttgaattcttgacctcaagtgatactcctgccttggcctcccaaagtgctgggattacaggtgtgagccactgcatctggcctgccccttttttttagtggtgtcttgcaattctactaatctttataggtttctccataaacagtaatctgtctgcttctgggttttctccattgctagcatgtttccattctctctgggttgctgaattaccagtagtttgcttttcaacctaaaaatgtttgctgacatgtctcatctactcctttgtctctctcttcatccttctgagtttgtttttaaaaatctttaatgagatgttaagagagagcagagataaaatgaaagcctgcctctgtctttttatggcattgaattccatactgtggtcactcaacagcagtgtagtgtattagtccattttcacactgctgataaaaacattcctaagactgggaagaaaaggaggtttaatttgacttacagttccacatggcttggaggcctcataatcatggcatagggcgaaaggcacttcttccatggtggtggcaagagaaaaatgaggaagaagcaaaagtggtaacccctgataaacccatgagatcttgtgagacttattcactatcacgagaatagcatgggaaagactgaccctgatgattcaattgtctccccctgggcgccttccacaacacagggaaattctgggagatacaattcaaattgagatttggttggggacacaggcaaaccatgtaagtctgtcatttatttatttctctactgtgctgatactgtgtccacacttctgctaccacttgtgacagaggtcccactaccatccacatttggtgcttcactaaaaggactcgggagatttgacatatagttgaactcatgactgatacttatttttatttgcttttttaaaaattattattttactttaaattttagggtacatgtgcacaacgtgcaggtttgttacgtatgtatacatgtgccatgttggtgtgctgcacccgttaactcgtcatttacattaggtgtatctcctaatgctatccttcccccctccccctaccccccagcaggccctggtgtgtgatgttccccaccctgtgaccatgtgttctcattgttcaattcccatctatgagtgagaacatgcgatgtttggttttctgtcctcgcaatagtttgctcagaatgatggtttccagcttcatccatgtccctataaaggacatgaactcatccttttttatggctgcatagtattccatggtgtatatgtgccacattttcttaatccactctatcattgatggacatttgggttggttcgaagtctttgctattgtgaatagtgctgcaataaacatacgtgtgcatgtgtctttatagcagcatgatttgtaatcccttggatgtatgcccagtaatgggatggctgggtcaaatggtatttctagttctagatccctgagcaattgccacactgtcttccacaatggttgaactagtttacagtcccaccaacagtgtaaaagtgttcctatttctccacatcctctccagcacctgttgtttcctgactttttaatgattgccattctaactattgtgaaatagtgtctcattatggttttgatttgcatttctctgatggccagtgctgatgagcattttttcatgtgtccgttggctgcatagatgtcttcttttgagaagtgtctgttcatatcctttgcccactttttgatggggctgtttgatttttttcttgtaaatttatttaagttctttgtagattctggatattagccctttgtcagatgggtagattgtaaaaattttcttccattctgtaggttgcctgttcactctgatggtagtttattttgctgtgcaaaagctctttagtttaattagatcccatttgtcaattttcacttttgttgccattgcttttggtgtttttcatgactgatacttattatagtcattcagccaggatacacagctgggtcagtaagggaaaaatgcgcattagcagagtctggaggaatccatatataggcttcctgtgttcctcaaggggccatatagaatgtactcattcccttcagcagtgaaatgcagtaacgtgtgtacattttttctcctcagagaagccttttgaaactcagcctgttttcactgggggttggtcccataggcatcccctgcctaccaaaattttacgcactcccagaaggaaagaaagcagatgttcaccacagatcacagtgtttatttatacaaacagtctaggcaggctggcgcagcaggtgcaaccttctctgttggtaatggagggaacattctaaaagttaagtctccagatgccaaccaaggggtagccctgtaagctggtcctttaaatatatcaggcctcctatgttaactctttcctgcagagtgaatctcaatactacagtgttttacgtgtctattttgaactttacatagataagattgttatgtacttctgcaggttgcttttttttctggttaaaataataatttatattattgtagtttatttgttccattgttacgtatgtaatatggtatatctatactataatttatttatttaataagtttattcagtcttctgtccacatagttgctgtttagagtaatattgtttctgtgataggttgtatgaaatttcagctttactgaataatgccagattgttttccaaagtagctattactttagaaataaaataaaaagtagtataaaactcttaacagctggtttgttgttttagaatacttgtttttccccccatttaaaaaacaaatatatttcattgaattggtaagttaataaaatagttctaatgttgtatttcttctgtgctcagtgccagaaatcacatccaaagtcagttccagtttcttcaaagaagaaagaagcctctctacagtttgttgtagaaccaagtgaagccacaaacagatcaggttggtgccatctccatgggcattatttgcttggatatatttaaaaaatgagaaacgctaatggtgcatgtgttgctttgagtatgaaggtcagggtcagcctagacagaattgtgaattgtgaaatggatgaatttgtttttgatttccttacaactccatggtcagtgctctttttctctcttcttctccatttcctttagtcagtgatacatgctactactttttaaagttttctttctttttatttttcagattaaaagagtgttactccattgagttaataaaggtttaaaataagaatttagtcattactcctatcattctgctgaggtagcctttaaatagttctgtaccttaattggtgcccataaatgaaaaaaaaaaaagcatgtgtgtttgtatgtgtctgtgcctgtacctgctttcagaaaaggctattataatttccttttacaccaatagtgtaagagtaccttttacctgatagtctatttactattctacgttcttgcccattcattgatattaagcaatctcctttttactttagtgtccatttccatgattgccagagtttgagcacctttatgtttattggctgttggattttaattgttaaatgtgtgacttttatagctttaagtttgttttagttaaaagttctgtcttatcccaacttagatttttcatctgaaaacctttttttaaaaaataaaattaagtctttaaccatctggaatgtgtttcggtatgtaacatgacataatcttctaagtttgttttcttccagttggtcagttgtgtcagatctgtttattaaattaaaaaaaaatctgttctcttctgaatgtactacttttattatatattaaatctcacataacattcaacatacttttgaattttgatatatttgttttttcctctgtcaacacaatactcttgttactaatagtagcttcatagtatgtcctgatataaataccttcactattccactgccattctgcagccttttttctttctatgagcttttagttttatccaattccaaataaacttttggaattctaactagaattgcatttaatttatgtagtaatttcgtgagaattcacattttttatgttatttaggttttttacaaaataagttatgtttctttcttataaaaatgttaatctggagccaggagtggttgctcatgcctgtaatcccagcactttgggaggctgaggcaggtggatcagttgaggtcaggagtttgagaccagcatggccaacatggtaaaactccatctctactaaaaataccaaaatttgccaggcgtggtggcaagtacctgttatcccaggtactcgggaggctgagtcaggagaatcgcttgagcctaggagctggaggttgcagtgagccgaagattgcgccactgcactccagcctgggcgacagagtgagaccccgtctccaaaaataaataaataaataaataaatctgaaggacactgtcaagagtgtgaaagggcaaccagactaggcgaaaatatttgcaaataatttacctgaaaaggatgatagagatttataatcagaatatataaagaacttctacagctcaacaacagaaaaaccaaacaacccaaataaaagatgagcaaaggactttacattctgtgtatagacttttctccaaagaaggtatgcaattggccaataaatatatgaaaggatgcttgaaatcttcagtcattagagaatgcaaatcaagaccctagggagataccactttacactcactaggttagctattatttaaaacaaaaaaaggaaaataagtgttgaagatacggataaattaaaaccctcatgcatcactggtgggaatgtaaaatggtgcagccaccatagaaaacaatttgatagttgctcaaaaagttaaacatagaactaccatatgacccaatacttccctcctaggtatatacccaaaagaattgaaagcagggatggaagcagacatttgtatactaatattcgtagcagtattattcacaatactcaaaaggtataaacaagccaagtgtccgtcaacagatgaatggataaacagcatgtgatttatacacagaatgtaatattagtcagtcattaaaaacaaagttctgctatataacatagcatagaagaatcttgaacacattaaaacatgcaaactgaaataaaccagacaaaaaaggacaaaaattttgtagttctacttacatgaggtatttataataggtaaatttagagataggaagcagaatagaagttgcaggggattgtggtagggggtaatggtgatttaatgtttgatgtgtacagaatttgtttgaaatgatgaaaaagttctagaaatgatgatggttgcacagtgttgtgaatgtacttaatgccattaaattgtacactcataaatggttaatattgtaaatttcatgttttatcataaaaaatattttaataaagcctgtctcctggctccccattctcccctccctcctagtattgggtctttgactttcttgttaaggttaatcctaactgtactataatttttgtactattctgaacatttttttaaattatgaggctaatttttatatcaaaattttaattcagcacttaccaaggtttttaaaaaaattaattctagacctttaaaaatttgaatcttttagttttctttaagctatataaccatgtcatcagctaaagagaggttttatttgttatgtttaatctgattatttcagtcttcttgcctttgctagaatctctgagtcagtgttgtttaataatgatgatattaggtatccatgtctgttctatgattttaactgaaattagtactgtgccacttaaaataataattgtgggtagtttggggtaaatttagtttatgtctttaatttccttttcttactattattagctagtacttcagtattatgttaaataacagtgatgggtccaagcactgtggcgtaggcctatagttccagcactttgggagtctgagattggagaatctcttgaggccagatgtttgagaccagcctaggcaacgtagtgagaacttgtctctacaaaaaacacaaaaatttagcttgtgcagtggcatgtgcctatagtcctgcctacttgggagactgaggtgggagagtcacttgagcccaaaaggttgaggctgcaatgaactgtgctagtgccaccccactccagcctgggtacagagtcagaccctgtctcaaaaaaaaaaaaaaaaaaaaaaaaaaggatggggtgaaaattctagcgttgttcctgctcttagaaaacatttgatctttcacattaagatgttagctataagtttttaatagatgttttttatagggttgggaaattttctcctgccagtatgctgagaatttttaatcataggtaatgtggattttgtcatgcattttttgcataaatccatatgatcatatgatttttcttctctgaactgttgatatggtggcttatacatattgatttttgaatgtttaaccagccttgcgtaaaatttccatgtggtcatggtgtattactgatttgagctctttttcccttttcaaatgtattcatttggcataaatttccccctcagcactgttgtagctgtattccacaggttttgtatctcatgttttgtgttcatttcacttattttgatgtatttttaaatatcttttcagagtttagcctattggttatttagaagtgtgttaattttccagtgtttggtaatttcatattatcttttccttattaatttctgatcttgattcctttatgacatagtatgcactgtgcaatttcagttctacatttatgaagatttgttttatgacccaagatattgcatgtctttatgaatgggcatttaaaaaaaatgttttctgttgttgggtgtagttatctataaatgtcaattattgtgcactattgctattttttatacattgttggatgtgacttggtaaaattttgaggatttttgtatttaagtaaggagagattggtttatagtttttttaatgctgtgtttgtatggttttgttatcaaggtaatatttgccttattaaatgagttgggaattattcccttttctaatttctggaaggaactgtgtaaaattggtgttaatcctttaactatttggtgtaacagtctccggtgaaatcatctggtccaggagatttttttttcaagaacttttaaatagcaatattaattctttaatagttataggactattttgattatcaatttcattgtgactgaattttggtagtttgtgttttctgaggtatcggtccattttttctaatcatctgtcaagtttgtaagcataaagttgttcatagcactaccctattttttttttgagtttttttaaatattttttttactttaagttctgggatacatgtgctgaacatgcaggtttgttacataggtacacctgtgccatagtggtttgctgcacctatcaacccgtcatcttggttttaagccccacatgagttaggtgtttgtcctaatgctctcccttccctttcctccctccccccaccacaggccctggtgtgtgatgtttccctccctgtgtccatatgttctcattgttctactcccacttatgagtgagaacatgcagtgtttggttttctgttttagtttgttgaggttgatggtttccagcttcatccatgtccctgcaaaggacatgaactcatttcttttttatggctgcttagtattctgtggtgtatatctgtcacattttctttatccagtctatcattgatgggcatttgggttggttccaagtctttgctattgtaaatagtgctgcagtaaacacagatgtgcatgtgtctttatagcagaatgatttataatcctttgggtacatacccagtgatgggattgctgggttgaatggtatttctggttctagatccttgaggcattgccacactgtcttccacaatggttgaactaatttacactcctaccaacagtgtaaaagtcttcctgtttctccacatccttgccagcatctgttgtttcttgtctttttaatgatcactattctaactggtgtgagatggtatctcattgtggttttgatttgcattcctctaatgaccagtgatgatgagcttttttttaattatgtttgttggctgtgtaaatgtcttcttctgagaagtgtctgttcatatcatttgcccactttttgatgggattgtttgtttttgtttttcttgtaaatttgtttaagtttcttgtagattctggatattagacctttgtcagatggagaggttgtaaaaatattctcccattctgtaggttgcctgttcactcttttgctgagcagaagctctttcatttaattagatcccatttgtcagttttggcttttgttgcaattgcttttggtgttttaatcatgaagtctttgcccatgcttatgtcctgaatggtattgcctaggttttcttctagggtttttatgatgttaggtcttaaatttaagtctttaatgcatcttgagttaatttttgtataaggtgtaaggaaggggtccagtttcagttttctgcatatggctagccagttttcccagcaccatttgttaaacagagaatcctttcctcattgcttgtttttgtcaggtttgtcgaagagcaaacggttgtagatgtgtggtgttatttctgaggcctctgttctgttccattggtctatatatctgttttggtaccagtaccaagctgttttggttactgtagccttatagtatagtttgaagccaggtagtgtgatgccttccactttgttctttttgcttaggattgtcttggctatatgggctctttggttctatatgaaatttaaagtagttttttctagttctgtgaagaaagtcaatagtagcatgatgggagtagcattgaatttataaattactttgcacagtgtggccattttcactatattgattcttcatatccatgagcatggaatttttttctctttgtgtcctctctcatttccttgagcagtggttagtagttctccttcaagaggtccctcacgtcccttgtaagttgtattcctaggtattttattttctctgtagcagttgtgaatgggagttcattcatgttttggctctctgcttgtctgttattggtgtataggaatgcttgtgatttttgccattaattttgtatcctgagactttgctgaggttacttatgagcttaaggagttttgggactgaaacgatggggttttctaagtatacaatcacgtcatctgcaaacagagacagtttgacttcctctcttctctcttcctgtttgaatacactttatttctttctcttgcctgattgccatggccagaacttccaatactgtgttgaataggagtggtgagagagggcatccttgtctcgtgccagttttcaaacagaagcattaccctatttttggtggctgcaaaatctattgtgacatcatcccctattttattccacatattgatggttggtgtcttcttatagttgtcaattttgttagatagaggtttatcattttgtagttttttttcctgcaatagttttctgtatttttctattttcagttttattgatttctgctctttattttttcccatccttctgcttgattgggtttattttgttcttttcttgatggataaattttattttctactttataattcattactgtttattttgttattcagattgttgcagatttggctaatagaagctcttactttggttccagtgtccctttgacatggcccatttttgttgttgtttctgagcactttcataccttttagagccacaagatgctctcctgccccatcccagaatcaaccatttcttcatggaatcatgatttcttttactgggtaatgttattagaaaccaagatctgagtgctaggtgtgctgtcactcctgtagagttgttgctgctagaccctttcaactgatagagctgggtaaatgtatgtgtgtgtacaataacttgtgtatcaacacatacctataaatatctttaaatgtaactatctgtatctatgttgaagtaatcataagttcatattgatgtctctgactctaatccattaccacgtggattattctagcctcctcctcttgcttatctgtaaactcccattacatgaatgagaaactgggcgttcaccattcaacatccatttacttatcttttacatttctgtatacatgtaaaagagtgtcagaattgttgactcatatcctgtggaaaacagttttatcaactagagaatagtgcttatgtacagtttcttttgccttcagtcttacagacgtcattcattttttgtttttttgagagagtctccctctgtctccctggctgaaatgcagtggcgtgatctcggctcactgcaacttctgactccagggttcaagcaattctcctgcctcagcctcctgagtagctgggattacaggcagcagccaccacgctcatctaattttttgtgtttttagtagagacggggcttcatcatgttagccatgccagtcttaaagtcctgacctcaagttatccgcctgcctcagcattccaaagggctgggattataagtgtgagccaccatgcccagctgattcattccttttaatttttttttttttgagatggaattttgcccttatcacccaggctggagtgcaatggcacaatcttggtgcactgcaacctccgcctcctgagttcaagtgattctcctgtctcagcctcccaagtagctgggattataggcacacaccactgcgcccacataatttttgtatttttagtagagatggggtttcaccatgttggccaggctcatctggaacccctgacctcaggtgatccacccaccttggcctcccaaagtgctgggattacaggcatgagccaccacacctggcctttgattcatttctgatctttcttaggtcatcacctttccccccatccacttcattgaggttgtttctacatatacattgaatgtggcatatgtaatacatgtgatttccatgattaggtcataaaaggctatatggctctgcttggcatgctggatctctctctccttctctctctctcttcctgtctttcttattctctccagttgcccttggaacccagacaatatgctgtgaagaagcccaaagtagccattatggagagaaaagactcccagcctgcagtcaagaccaggtgtcaaatatgtgtaaacaagctgtcagatgattccagggctcagacttcatggaagaatccgtcccttctgtgctctgctgaattgctgacttactgaatccatgaacataacaaatagttgttttatgcagccaagttaagaagttatattatgcagacatggtaactgaaacaacgaattcccaacttaaatactactgttagttatttctgttgtcaggtattttaatattttttaactttacaagactttttgttttagtttgtttatatacacacgtcacttcctttgctcttttttaaagaagtgtattttaaaatattgtataatataaacataaaattgtccactttatttctgagtatacagttcagtagcattaagtacattcacattgttgtgaggctatcaccaccatgaatccatagaacttctttcatttttcacaactgaaacactgtacccattaaacagtatctctttttccattagccctggcaaccaccattctacttttttctgtccatgaatttcagacagaaaatttatctgtgactggcttatttcactaagcataatgtcttcaaggttcatccatgttgtagtatgtgtcagaatttcattctaagactgggtaatatttcattgtatgtgtataccactttttatctattaatctgttgatgggcacttgggttgttttcgctttttggctattgtgagtaatgctgctatgaatattagtgtgaaagtatctctttgagttcctgctttcagttttaagtttttaaggatccactgtgcacttttcatagtgactgtcattctacattcacactagcagtgcatgcacaaaggttccatttttttctacatcaacagttgttatcttttgtttttataaataatagtcatcctaatgggtgtgatgtagtatctcattgtagttttgatttgttttacatcactgttattaggaaaatttaaaataatatttaaaaatcactacttactgataatggctaatatccaaaaaacttttttttaaaaaatgctactttgagagtttctttttcatttgttacaagaggatttgtaattgattattaaagcattttatgatgtttgctttaaaatttattgttaaataattttaaaatctgattcatctcatttatgtctattgatcattatttcttacttttttttttttttggtttgttttggttttggtatgacgagttgttttgattgtattcctgagatttggttacttatgttaggggattcttagactacttaaatcttttgttacagcacatagttgccctattttggtttaatgtataggttctttcctgtgttatttatttatttatttatttatttatttatttgtttattttttgagacagagtcttgctctgtcgctcaggctggagggcagtggtgtgatcttagctcagtgcaaccgccgcctcctgggttcaagtgattctcatgcttcagcctcccgagtagctgggattacaggcatgtgccactacgcctggctaatttttgtatttttagtagagatggggtttcgccatgttggccaggctggtcttgaactcctggcctccagtgatccacccgttttggcctcccaaagtgctgggattgcaggcatgaaccactgcgcccagcccctctttcctagttttatgagttttattttcaatgatagttaagtgttcagagtaatagtggtattttgttctacttcattttctgatgctgttaggattctagctcagttcctgttggtgctgtctggggtgggtagaagatgccttttgatgtccatgttcacttgtgtggggttctggttagaagctgctggtcctgggtttccttatatcattgggtggaggacagggggttgctggcctctcttacgctgttcttgcctcagattagactgtctgctggtgccctggttgtaaagtagggactgggatggcctggggtgtcaatactatcagtggatcaaaatgttgccttgggctgtgaaggtcaggggtttcactactctacagcttcatgtgggtcataccgcctgccatctatgattgtagaagcgggactggcttggtatgagctcctttactgctacagtcccatagcacagcccagggctttgttgctttgccaatgcaggtagtaaggagtgctccatggccgagagtgctgaatggggcttgagtttcctcattaggtcttcggtgggtttaccttgttcagagaatgcatttccacccagcctccaccctgtctttcacctattggtggttacaggttatactagcaaccagtccaggggtatatgggagacagacagaaaacctaaggcttgtctgtttctggtcttgagcttcctagctagtctacctttttttcttccagctttcagagtcctgttgttgattgatggataatttccagggaagttagttgtatttagagggagaagcagggaaatgccatctcgttctgaagggtgagggttaagagaatatggatacattcttttaaattttctcattatagataaatgttcatatacatatatactgtgtatgtatatatacacacatgcttatgttgtatctctctatatctgttatatctatattccatgtgtgtatgtgtaaatatatcatctagctgccctaggtcaccaatttttagcccaaagatagaagaatcttaagtacttacttattttaatcatagatctttgattctaatcttaatgactttgagttttctgaaaactatttctgattaaattattgcagaatttttaaaaagcctgcttgattctcttattattcttttaattgacaaatatctttatataattttcttctagttcaggcccatgaagttcatcagaaaattctggcaactgatgttagttccaaaaatacacctgactcgaaaaaaatatcaagtagaaacataaatgatcatcacagtgaagctgatgaagaattttacttatccgttggctcaccttctgttcttttggatgcaaaaacatctgtatcacaaaatgttattccatctagtgcccaaaagagagagacttacacttttgaaaattcagtaaatatgctgccttcaagtacagaggtttcagttaaaaccaaaaaaaggtaacattttatttaaataatgttaacgcactttaaaaattttactttttgtattaaaaaatggtaattcaatcttgttatattattttacactaaggaaggaggaatattaacatgttatgagaaagtatacatttagcatatattcagtttgtaataattaaggaagggcttaaagtgtacttcagagaagtttagaggttaacttttctatagtctggaataatgtgttttctctctgataatatttgattgcttcctaagagaaacaatttgtattttctcaatattttttgtaattgcaagtgtagatgtgtatcaggtcacttcaagggtagcagagcataagtattattgaggatgctatgctttgtggacagctggtttctctttcttgaccttacctttggcctttaggaaacaaagtggattcaaggtcttttgcatttggagatctctgtaatgagtgtaatttctatttagagtattgtatgattactggagccaaggagttaagtatattctaagactttgatattcaaagtttggtctgtcacagtgctctaagattgccctgagaaccattgcctagctatacatttcattgatgtatactttagccattattttctctttcatgtttttctattgataaatacaaaagttaattttcctgagcagtttatcttatgtatttggaatgcacaaatcagcatttatgtcttaaataaatgcctagtacagaattttaaattggtctgtattgtctctgtaaaggagttcaggaagacttataactcaagaaacgttacgggagcattcagcttaccctccttttaaccttttaggttaaactttgatgataaagttatgttaaagaaaatagaaatagataataaagtatcagatgaagaggataaaacatcggaaggacaagaaagaaaaccatcaggatcatctcagaatagaatacgagattcagaatatgaaattcaacgacaagctaaaaaaagtttttcaacattgtttttagaaacagtaaaacgaaaaagtgaatccaggtgagttattaagaaactgccctttgagacatttttcttttatattctatgaaccatatataaggattcctaatgctatttaacttagaaataagtaatttaattaacaaaaattttaattgaaattttttctgacctgtaaggagagatggttttttaccagtcagtgagtcactcccaaagccattttttaatagatactaaattagacttgaaagaaaacaagtttattcagttttcattgccttctggtttgtctgtgtgatatcaaagactgaagtcaatgcagtatttatgtatgtatgtatgtatttattttgagacagggtctcgctctgtcttccaggctggagtgcagtgacgcaatctcggctcattgcaacctctccctcctgggttcaagagattctcctgctcagcctcccgagtagctgggatcacaggcacctgccaccacgcctgtctaatatttgtatttttagtagagatgggatatccccatgttggtcaggctggtctcgaactcctgacctcaggtgatccatctgcctcggcctcccaaagtgctgggattacaagcttgagccaccgcacccggccgacaatgcagtatttagaaatcgttatgttaggctgcccttatgtcactatcataggtatcagagtgctagtgaatatactaggaagtttttattgctgggcgcggtggctcatgtctgtaatgctagcactttgataggccgaggcgggtggatcacttgagatcagaggttcaagaccagcctgaccaacatggtgaaaccccatctctactaaaaatacaaaaattagtcgggcttggtggcacatgcctgtaatcccagctattcgggaggctgaggtaagagaaacacttgaacctgggaggtggaggttgcagtgagtcgagacggtgccactgcactctagcctaggtgacagagtgagactcagtctcaaaaataaaaaggaagtttttataaaaacatgttaaatgaatgaatgaaattccccttttgttcagtctctgcttcctgtagttgattaattatttttatgtgtatattttaaacctcatatggatattgtcaccaccatctgaaacaaatgcgttatacttgtgggctaattatataatgtctgagaaattattttttaatgttctttttgatactctagtgagtaaagttcatcttatgtttaattgttgtagtcaaatataactattcattattcccagtgctttctagcatcattgcttccacttatgctcttccttttgattgtctttcttgcatttccttgtgaccaaatcttagaaatcctccaagatctagcctaaatgctacaaagcgtttcatagtttttgtagctaattagaagccatctttccctattgtaaactttcatagtgtcaagattgtttcctaaggatatcatttctgtttaacatccattcattgtagtatttgtattgactttgttctttattagtttttatagagttttctaattatataagtttgtgaaactctaccattagagagtatattttttagagtatttgctattttacattataagatttgtcaggagtttgcgattagaggaatagagaaggcattttcatttctgattccttgtgtatgttctaattaaaagagaaaaacataatctaatttttgcattctgtctttgtttctgttatggctaaacatagctaactaagccttcttatcctagtgaaaaagtggaaacgagtgcgtatgccagctttggagtttggatgtttaccttgttttttattttgtgtatctcactgcaatatgtggtgtgcttaaagctattaaaacaatcagggaaatgtaaaattagtcagtctatcagattactgtccttggaataattcctcccttctctaggaaagtttcctgactaattggaggaggtactgtgtaatctcaatgcactagtcttaatttattcaacacctcattaaatgcatgaatctctttgtatgttcttaacatgtacatgcttttatgaaaatttaagaattaatgttgatgttatattataagccataagattgtagttgaaattgtctgtcttactctttagccttttacaacactgggcatgggaaataacaataatattcatgatataggctttctgccttttagtaaaatacataaagtttgggctaggactatggagaaaggtctagagttgggaaacattgtttgacttcattatttaataacattctgtagcattgtatgctttgtgataagacttgccttttatttttcctgtttctgtggcactagatttcttttgtgcttatgctacctttctagatacactccatttatttctataccatgattataatatgaaaatatatgtgaaatacccaaacttggaatgcatttttacacacatgctgtcataagttgctacacacttagcggcttaaaacaacatttattattttatagttctgtaggtctacaatttacagtcctatagtaatattagtaatttttacattcattcaaccgtctgtgtatttggtgttgctatgtatgaagaactgtgggatgtaaaaaaagataggaagaaattgtccccaatctctctctctctctctttttttttttctgtctgagatggagttttgctcagtcacccaggctggagtgcagtggtgcaatctcggctcactgcaacctctgcctcctgggttcaagtgattcttccgcctcagcctcccaagtagctgggattacaggcacccgccatcatgcctggctaatttttgtatttttagtagagacggggtttcaccatgttggccaggctggtcttgaactcctgacctcaagtgatccacctgcctcagcctcccaaagtgctgggattacaggcgtgagccaccacatccggcctcctcaactttttataatttagtagtagtccattcaaatattagacttggagtgttctcagaaataatcttgttgacttattttgaatgtgaagaaattcagaccccaaaagttatatatacaaatatataatttaatataagattatatataatagtggcattcattttggactgtgagtcaatgtatctgagttataattatatctctctgggcttcagttttagtatatataatgggtgggtgggtgggatcaaatttgttgatgtctagatttctagctctaaatttttgtgatgtcattactattataaataagggtgaacagacatagaaatgtgaaaggagggaaagatttgtaagattaagggaaaattgaggagatatataaacagtttaaaagaaatttagattttatttcctagattattttctttactaaacaaatataaaagctttatttttttgaactgttaaaagtatcaccctgtttcagtcccattgttaggcatgcggcaactgctccacctcattcgtgtcctcccgatgatacgaagttgatagaggatgaatttataattgatgagtcggatcaaagttttgccagtagatcttggattacaataccaagaaaggcagggtctctgaaacaacgcacaatatccccggctgagagcactgcactccttcaaggtagaaagtcaagagaaaagcatcataatatattacctaagactttggcaaatgacaaacattcccataaacctcacccagtagagacatctcagccctctgataaaacagtactggatacaagttatgctttgataggtgaaacagtaaataattatagatctacaaaatatgaaatgtattccaagaatgcagaaaaaccatctagaagcaaaaggactataaaacaaaaacagagaagaaaattcatggctaaaccagctgaagaacagcttgatgtgggacagtctaaagatgaaaacatacatacatcacatattacccaagacgaatttcaaagaaattcagacagaaatatggaagagcatgaagagatgggaaatgattgtgtttccaaaaaacagatgccacctgtgggtaagtgtttatattaaatataaccatgagcattattctacccattttatgttttttaatatcctaacttagctttggcaagtaggcaaagtaaacctaaatgaacaaagagcctgaaaagcctataggttcttttctagaacctttttattttatatataatttaattctaactcatatagtttttgtttatcttgtgagatggcagtatatatagagggcaaagtgaaaagaaaaggctagtaaacaagttagtatcggaagatgaataagacagaatgataaattatttagaaaataaaaatgttaaaaaaaatcccagggtaccgtgggactattttttatagagataaaagtccattctcttccatcattcactcatgtgtctaacagttgttgaatgccatacactgcattaggcactgtaatcacaaaaattactaacccattatttctactgttaacaagatcattctggtgggttctgtagaataatagataatatacatacatgcataggattaaaaggaaggatacaaaattttgatttatccataatttcttaggaaaagacatatgaaggaagtatacttgaaagatgcgctctataattgtaaatattaaacattttctgagtacctgctatattctacacactaatttttacatatattctgtatctagattggttagtgaatataatgctcattaattaccatatcagttgtattaattttctattgctgtcatatgacaagttactacacacttattggcttaaaacaacaaacattgattatcttacagttctgtgggtcagatgtctcactgggataaaatcaaggtattggtggggttttctttctttctggtagctctgggaggaagtctgtttctttgccttttccaccctcttgaaactacctatattccttgactcatggtcctcctccaccatctgcaaaactagcaataccagccttctcatgttgtgaatttatcttgcctcttcttccatcatctcatctctctgaccacagcttttaaaagaaacataattagattgggtcaacctggatgatccaagataatgcctctatttcagagtttataatttaatcacactttaaatctcctcttcttaagttgaaaaaaatcattatttcaaaacaggaaagcagtaattgcctacttttacttaggacgttataggaaggaactgtatttttttttcagtttcagaagatacttatttttttggctgaggagtatataagagttatcaagcagtgtgaaaatttgcatttaataggaagttagtgcttacttcagcagcacatataattgacagaaagagaacatgtgacttttaaaaatggagatgaaaaggccacaggataaatttaagaagttcctgtaattgacggtttttttataatcttgtggttttctgaaaactcttttagtagattgtgaattggttttatggttttctttattttaggaagcaagaaaagtagcactagaaaagataaggaagaatctaaaaagaagcgcttttccagtgagtccaagaacaaacttgtacctgaagaagtgacttcaactgtcacgaaaagtcgaagaatttccaggcgtccatctgattggtgggtggtaaaatcagaggagagtaagtatttttatttaaattgtgtttgttcatagacaaaatcattctgtaaggggcattatgtttgattttatatttctatatagagaatatcatgaggaccaagttaaattgggtcatcaaaaggaatattaaatcaatggtaaagatattccttgaagcgttaatatatacagtattttaggaatagggataatagctgtgggaaaacaaaaccccaaaccagaaatccctgctttcatggagcttgcattctagttgggaaaggcaatataaataatccagctattttaatgtcctggctgtgagggatacaaagattgataatatgaggttctgccaccaaggagtttataatctaaaagattatagtttattacacataaaaaagtaaattacttgtgttggaggttcccaagactaccctcagatttggtaatttgctaggaggactgggcatatagttgtactcatggctgtgattcattacagtgaaaggatgcagtgcaaattcagtagaaaaaaagtgcatgggttaagtctggaggaaatcagcagaagcttaaagagtcctttcccagtggattcccacaggagctgcttaattcctctagcaatgagttgtgacaaataggcaaaatgtctattagggaagctcactagagacttagtgcccaagatctttcctgggggtggtcacataggtactctctatctagcaagtactacaattccagactccctgaaggaaggcaatatttgcctaaaccatattttttgcataagcagtttaggcccacaacaccacgtttgccaattaggaaatgacgggaacaatcctgaaatttaagtttacagggctaactttgaaagcaggcccttttaagggtagtatactcagacctgctttgctaacttttttctgcacaatatgaaacatttattgttttgggagaattgtccctttttaaagaaagtgatcctgaaaagattggtggatcataaggtagcattcacatacacaaatactattgactttggggcatttagattaataagtgaatgattagtacaactatggcattgtatatgtgaggccttattgctatgaattattaaatcattgagattcttgatggatagcagcaagtatttattttgttgcagcctttggattttggagtgagatctgagttcaaagtatcactcttccactttgagtagattgctttgtttagtttctcattctgtaacatgattacctcattgagtttttataaggtttaaatgcaattagcatagtaggtggcatatgttagtattgaagtgttaaataatactgttactgctttggggaactcacttttctgccccaggttgcctgaaatgctaagtactatgtggcagatgaatacataaacagatgggtaaataaattcttacagaacttggataaatgtgctagatctctgaaactatcaaaaaacacttatttaagagtcctgaaatagatgttggatttttgatcaagctgggagtcgaaaaagtggaggaatctttatatatcatatagtctaaactctcatctgatggaagaagaaactgaagtctgaagttaagaagaacaacttgacctgcccccagcctgcctgtcgtacgtgtgacactgttgcccttccatatatatgaagaaatgtatatggagtacttgccatggggcaggaatgaggtaaagtaggaccaggactagggtaagacaatgagacactagggtgaaaaatttaaggcagtcagtcacaggattgtatcagttcgggctctgtacttgcacagacctgaaaatgagtaccttcttgaattttccagctgaggctactcttgcttcaccatagtcctgcccctgtcattaggcattgggaatatacatagataaaataccaatcaattacttgaggtcaaggagttgttagtctgctggaggagagaagtagagataagtaaacagtcgtatgtgtgatagcaagctacctaagacttggaaattagggaaagcttcctgaaggatgaactaggagttagctaagtgattgagtggagtaaggaggaagttatggaatgttttaagtagaagtagcttgtgcagagatctggagcagagagcttgatcttttctttctttaatttagtgtgctttagaattgtctggggggcctattaaggcacaggttactgggccctgctctgcaaagtctttgattcactggggtctgaggtgaggcatgataatttacatttcaaattcccagataatgctgatcttgctggtctagagactgcctttggacaaccagtgctttagagaaactgtagattgttcattactgatggctttttttggtttgtttgtttggaggggggttttgggaattgtggtttatgaaataagcaaatctagatgtagatatgaattgatgttgaagtatttggacttcatcctgaagctatagataataactaaaatactttaattaagcagagttgtaatgatccagtttttgttttccaaaggtgattcttgcagcagtgtagggaatggattgaagaaaaacaaggctagggagggggagattagtaaagagactgttttaataatccagatatgaaataatgaggacttctactaatgacaggagggagagcttgaaagatttgaaaggcattaataaagtagaattgatgggatttagggcgtgattgtggataggagtagtagtcttgcatgactcaaatttctgatttagatatctggatagaataggtagttgtatttttcattaagataggaaataaagcaagagaggcagatataggggagagcagtagatggatattataggtgtcagcatatagatagtaattaaagctctgggtagataagtccgtcaatgaaagtatatggagtgaaaagctgaagctgtcaccttggggaatatcagatattaaggatggccagaagggcagtgggcagagccagagagtgtttcttgaagcctgtgacagatttgaagggcctgtttcatatatctataaactgaagagctacattgtttaaagaatttaatttggaaataaatttagcctgagatgtgtgtgtgtgtgtgtgtgtgtgtgtgtgtgtgtgtgtgtgtgtgtgtatgtgtatatgtttatatgcaaatataaatgctgttggtatttcagtgagccaaatcatctggacaaacttactaactttaggttatcattgaatccttcaggtcctgtttatagcaattcttcagtaagaaatgaattaccaatgcatcacaatagtagccgaaaatctactaagaaaacaaatcagtcatctaagaatattaggaaaaaaactattccacttaaaaggcagaagacagcaactaaaggcaaccaaagagtacagaagtttttaaatgctgaaggttctggaggtatcgttggtcatgatgaaatttccagatgttcgctgagtgagccattggaaagtgatgaggcagacttggctaagaagaaaaatcttgattgttctaggtaatgtctgttatgtgtacaatatagttacttttgttgttcagcatttaataatttgtgctatttagtcatttatggacaggcagtaattagcatgaagagctctgcactctgacatacctggtattaaatccagcctctaccattagctggatgacacacaggcaaagtagtactctgcacttgtttcctcatattaaaatagggaatagtacatagcacctggaattatgactgttaaatttaataagatattattgtcatccaagagttaaactttttttttttttttttttttttaagagacagagtcttcctctgtttcccaggctggagtgcagtggcgtgatcatagcccactgtaacctcaaacttctgggtcagataatccttctgccttagcttcctgagtagctaggactacaggtgtggaccaccacacctggctaattttttaatttgttggagaaatgaggtcttgctttgttgcctaggcttgtcttgaacgcctggtgtgaagtgattctcctgccttgggctcccaaagtagagattcaaaaaacaaacagacaaaaaacacataacataaaatttactgtcttaatcttttttaagtgtatagttcaaattgtttccttttaagtgagattaatgtgatttcaatagttaggaatatagcttaatacttttcttcttaggatgataatagttaacattttttgagttcatactatgtgccaaatatttgctagatacttttaatgaattcttattagttccaacaacctattgaggtaatacatactttgtgttggaatcagtaaggtgctgaggatatactgaaataaatgacagtgtgtcctaaaatatattagcgtatatcattatagtgcataaagaaatcccatacccattctgtttcactttttcaggccattctctgcttttctctctcttttattttattgtgttgctggaatttgctagtattttgttgaggggttctgatcggtagcttgctttgcttctgttgtctttgtttagttttggtatcagggtaatactggctttatacaatgagttgggaagtattatctctctattttttgaaacggtttgtgaataatttgtcgtaattctctttgaatgtttggtaaaagcagtgaagccacctgtgcctgagcttttctatatgggtagtttgtttttgattactgattcatggtattttgagactgtttcctcttgaatcaattttgataatttgtgtctttctaggagtttgtccatttcatctaggttatttaatttgttggcatacagttgttcctagtattctcttgtaatcacttttatttcttttgactttaatggtaggacccaggaggatactagaacctgaagaattatacagtcactaggaagagtgtatcttgtttgcatatatttggagtaaactaactaccaaagagatgagctcagtccctctgaggaccctattgcccctcagtaggctgactagggatatcaaagaagccaattttagttgtttatggattctccagtaaaccatgatagattaactgtaatatatatcaagctgcttatagataaggtctccttatgtccctttcaccaccttccttggcaggtgtcttctccatttctctcatcagaatttttcaaattgggactcttggtaggtcctagaaaccagtttccttccttagctagttgcaagtctcagaacctgaacagggtgatctgatattcgttatagccaatattacattgtctttgtacccacctgtgtatcgtttctggaagaaaattttattttgaagaagtataaacactcatacatttatcatttttatagatctacaagaagctcaaagaatgaagataacattatgactgcacagaatgttcccctaaagcctcagaccagtggatatacatgtaatataccaacagagtcaaacttggattctggagagcataagacttcagttttagaggaaaggtatgcgtgtattgtaaggataatagttgtatatattagttacccattgctgtataacagattacccaagaactttattttaattttgttaaaagcttaaaaacacttattgtttcatagtttctatggctcagcaatctgggaggcttagctagctagttttggctcggatattctcaggaggtagcagtcatctttctggttttaaccctttaaagtcttgtctggaactggagaatccacctataaaatgtctcacatcgctgttggctggagaccccagttccgttctggctgtttccagtagaccttagtttcttaaccatgtggccctctcagctgctgaatatggcaactggcttcccacaaagcaaatgctccaagagaaggtgtgactatgatggatatcacagtgtcttttaatgacttagtctttgacattgtacaccgtcatttctactttattctgttcattagaaacaacttattgagtccacactacattcagggagaggtggaattaggctccacctattgaaaggtggtgtattaaagaatttggacatataatgttaaaatgaccacatttagtgatcaaattgaattacctactcttaattatatctgatgtcatataaccttttaaaaaatgaataaagggtaaattttagcaaattctcagacttttaagggatggctaagatttctttactatttgtgaggttatgactaggcttatcctgggttcataataggtagaaagagatttaggactaggagaggctgaatcatctctgacaatttctggaccacattttaaattccattggtttttggctatatttttttttaattaaaatatgatgatttctttctttttttataatttgattttcaccacaggatgttatcatttgaatttactaagtctgttactctgatctgtaagtcataaattcagtacttatgatgctcaactgtcagttatgggatgaaattgtagtctttgtttaatgcagcaagtacagtcagccctccatatctgtgggttctgcatccactgattcaacccccatggattgaaaatattcagaaaataaaatataaaacaataaaaagtaacaatatgacatttaaaataatacaaataaaaatacagtataacaactatttacatagcatttacattgtattaggtattatcagtaacctagatatgatttaaagtatacaggaggatatgtgaaagtcacatgcaaatactgcaccattatatataagggacttgagcatccttggattttggtatccacagtggatcctggaatcaatcccccacaaatactgagggatgactatatatttttgatgacttgtaacatcactattggttttataagaaagacttatggcagttttaggagaaaaatgatcattaaggcaaatacattagatatatgtattataaaagcattaattttgtggtttcctttttttcttaagtggaccttccaggctcaataataattatttaatgtctggaaagaatgatgtggatgatgaggaagttcatggaagttcaggtaaactattgttttttttctgtcttgatttttatggcattatgaatatggagtaaggagtgctatgttttgtttacattgtcactgatggcgagtgtatattgagtacctacctcttaagacccttagttagagattaataagaccctgtacctaagtgagacagaaagaaaatgagtgacagttttttaagtagaacataatgaaatattggcacttaaggtgtctactccagtatttaaaattgttaagctaataagggtatacatgaagcagattagtgatctgttgatgattactgaagctggttgatggttgtattgggttcattatactattttctctattttcaatacttgaaaatttcctttttttttttgtttgagacggagtctcgctctgtctcccaggctggagtgcagtggtgcaatctcagctcactgcatcctccacctcctgggttcaggcaattctcctgccttagactcctgagtagctgggattacaggcacctgccaccacgcctggctaatttttttgtctttttagtagagatggggtttcaccatcttggccaggctggtcttaaactcctgaccttgtgatccacctgcctcagcctctcaaagtgctgggattacaggtgtgagccaccactcccggccttcagtacttgaaaattttcatactgaagtttaaagatgcctcttaatagagaattttataattttttcatgctcctaaaaatgcgtgcttgattgtaatctgttatacttttttttctaataatcactattcttttaactttttaatttttcccccgtcattagatttattgtattttctcttttaacttgaatgctttctgtgtttttctgctttttctttggtaaagaagcagcattcaatttccctcagtatagttttggcttaatttgatagattttgctatgtagtgttattgtagtatactctaaattgtagtgatttttctttgacccagcagttatttaagagtacattagttaagagcttggtctccagggtcatggacctgggattggttctagctctactacttactagctacgttcttttttttttttttttttgccccattcaccactgatcgggaagcatcactatattatcttgagtaagaaatttcagtgttcttaaacttcagtttccttatctgtaaaatgatatcagctccaatcccataagctgatataaagatgaatacatattctttgcttagtttaatatcaggtgtatgttaaatagccaatttttgctgttattctaagaagttgtgttttattttgttcttttagtattttctggtttcattttattgttctagaaaacttagtctattttatttattgtttgaattcagtaagttttttttgtgttctagtgtctagtgtatgcttagtttttataatttttccattggtgcttgaaaaagggaataatttgtatacagatatggatttaaagatatatatccagttattttgttgataacataagtggatatatttttttgaatatacttttaatatttatggaattcttaaatatgaaaaattatggaatatttacttattattttaagggtaggggtgtgtcagtgaacaaaactgacaaaaatttctgccctccagcttaatttctggaaggggcaggatggcagacaatataaaaagataacaaatttatgatttgttgggtgttgagagtagagaaataaagcatggcttttagggtgggaaatgaagtttacatttttaggtagatgggcagagaagtcctcactaaggaagtgatcatttgagcaaagatttgaagagatgagacagcaaaccgtgcagctgtctgggtaaatagtgtaccaggtagagggaagatgaagggcaaaagttcttatgtggtcaagagtctgtcttgatcgaggaacaccaagaaggccagagggttagagcagaggaagagagcgaacgagtagtaggaaaaatgatgtcacagaggcaacagaatgaaagatcacataggatgttaaaggcaaaattttactaagagcgatgggaagccattagagggttttgagcagaagagagacatgacttgacctgtattaacagaatcactgcagctcctgtgttaggagttgactgatggggttgaagggatggaggaaggttggaagcaaggagactagctggagagatgttgaaataatcctagtgagaggtgttggcttagaccaatgtggtagcagtagaaagtggaaagcaggaggaggatttttaggtatttttgagggtaaagtcaacaggattttctgatggacgatacgtggtgtataagaaaaagagaggcgttagagagaacttgaaggtttttggcccgagctcctggaagaatggcaatattactacctgatctggggactactggggaagaagcagattttgaggaaaagaacaggatgttagatttggacatactaagcttgatgttctcaacctatgtattctttttatttgagatctattaaggactgctagagttgaagtaaagtgttcccactgcaactgtctttgcccttgtattttctgtagtctttgttatgtacatttcagtgctgttactgatcacataagccttcatatggagtgtacctgctttggtcaaatttatctgcttcgttgtgttaaatgctttttactttgtagtttgttttgtctaatattagtattgtgacttctgctttcttttggttggttgttgtttctttatctttttatttaacttttattagagaattaaaagtggctaagaaacagcatatgattgaattgtttttgactcgctgtgtcagtactttttcctttaataaattgtttaatatatatacacttattgtcaacagatatacttgttacttctttgtaaagttggtagacattctcacatattctagcaaggactcaggattttttttttctttttaaacacaatgaaccaccagctaaatagagaacataatcttgagtcatgatctttttttctttaaactatcaccgtattgctattttgcttcatgagagttaatgcttatgaatagaaatttgaaggcagccttatttcttctttcctttgtagataacctgttttcttccatctccatacttactaggatcctttaatctttgaaatttaggagttgtcccttgtgttagtcacttaaaaaataatttattttgaaataatttcagtcttatacagagatcccatatccccttcatcaagatttcacaattgtccacattttacaacatttttccatctccctccctgcctcctctaataaatacacgtctattatcatacatcttttttctgaactatttgagagggaattgtagacatgatatattatttcccttaaatgccccataatgtatttcagcaagacaaggatataactaccctcgaaccatacaaataaggaaatcagcattaatacaacacaggttcattcacagactccattcagatttcactagcagttccttttcccttctagctcaggatccagtcctggatctcagagtttcttcttcctcctggttcaagatccagtcctggatcgtcgactgcatttagctgccatgtcccttagtttccttcaacatggaacagtttcttagtttttttcctaacttaactcatgatcaaatgtgtgccattcatatttgacaggaatactacagaaatgatgctatagggttaggagttaggggatgtaatttgtgcatcacacaggaggcacacaacgttcacccatctacatgatgcttttgttttttgtttgtttgtttgtttgagatggagtcttgctctctcacccaggctggagtgcagttgtgtgatctcagctcattgtaacctccacctcccaggttcaagcaattctcatgcctcagcctcctgagtagctgtgattacaggcacatgctaccatgctgggctaatttttgtatttttagtagagacaggctttcaccttgttggccaggctggtctcaaactctggacctcaagtgatctgcacacctcagtctcccaaagcgctgggattacaggtgtgagccaccatgccctgctgacatgatatcaatcctgattacctgttcatgttattgtctgccaggtttctctactgtaaagacactgcttttctcttataattgataaatattattgtggagtgatattctgatactcttaatagcctgtttcttgtcaaacctccattcaccaaccttaacatacattcaagactcccacttgaattatcagccactaatgatggtaccacattattttctattttctgtttctttaattccttccgcattaattagttgccagtttttctcccgcatgccaattattttattcatgattctttttatttatatcagtatggactactactattttatgccatggggttgtaaaatcttgaccatttattatgatacttgaattgtgatagatttggtcactggattttctttcagctggtctctgtgtgcttttgtcatgattctgtgaatactgtctttgttttttggcataagatgttccagtctttttcctgccccagctctgggatcaattactgctccaggaaacctggttctttttagtggaagatggcatttagaaaccaagatttgggcacttgacgtgatccttgtttgggataccattgcttctagtctttctcagtgtacagagataggaaatagatatatatatacacacacacatacacatatgtacacaccatatacaatacaggcatctatatctatttctatatttatatttatacaggcataccttgttttattgtgctttgtgtcactgcattttggagatactgcatttttcacaaattgaaggtttgtggcaaccctttgttgagtaagccttattggcaccattttttttttcaatagcatgtgctcaccttgtgtctctgtgtcacattttggtaattttcacagtatatcaaactttttcattactatgtcttttatggtgatttgtgatcaggtgatctttgacattactattgtaattgttttggggcaccgcaaaccacagctacttaagaaagtgaaaattcatgtgctctgactgctctgctgactggccagttccccatctttctccctctcttcaggcttccctatttcctgagacacaatattgaaattaggccaataataaccctacgatggcttctaagtgttcaagtaaaagaaagagtcacacatttttcactttaaatcaaaagctagaaatgattaagcttagtgaggaaggcatgtcagaaaccgagatagtccagaagctaggcctcgggcaccaaacagccaatttgtgaatgcaaaggaaaagttcttgaaggaaaagaaaagtgctactacagtgaacacatgaatgataagaaagggaaactgccttactgctgatatagaggtttcagtggtctggacagaggattaaacaagccacagcattcctttaagccaaagcctaatccagaggaaggccctaactctctttaattctgtggaggctgagaggtgaggaagcagcagaagaaaagtttgaagctagcagaggctggttcatgaggtttaaggaaagaagctgtttccataacataaaagagcaaggtgaagcagcaaggtctgatgttgcagcaagttatccagaaaatctagctgagataattgaaggtgtctttactaaacaacagattttccctgtagacaaaatagccttctattgaaagaagatgtcatctaggacgttcatagctgaggagaagtcaatgcatgacttcaaagcttccaaggtcaggctgtgactctcttgttaagggctaatacagctggtgactttaagttgaagctagtgctcatttaccattccagaaatcctagagtccttaagaattatgctaaatctactttgctctattagtagaacaacaaagcctgggtgacagcacatccatggcaatgcaccaggccacccagcagctctaatggacaaagatgaggagattaatgttgctttcatgcctactaagagagcattcattctgcagctcatgcatggatcaaggaataatttggacttttaagtcttattatttaagaaataaattttgtaaggcagtagctgccacaagtagtgattcctctgatgggactggacaaagtaaataaaccttctggaaaggattcaccattctagatgccattaaaactatttgtgtttcatgggaggaggtcaaaatatcaatattaacaggagcttggaagaagttgattccaacccttatgggtgattttgaagggttcaagacttcaatggaggaagtaactggatgtggtggaaatagccagggaactagaattagaagtggagtctggagatgaaactgaattgctgcaatttcatgacaaaatttgaacagatgaggagttgcttcttatggaagaacgaaggaactgatttcttgagttggaatctactcctggtgaatatgttgtgaacccttgaaatgacaaaaaaggatttaggatattccatgaacttagttggtaaagcagcgacagagtttgagaggattgattgcggttttgaaagaagttctgctgtgagtaaaatgctatacaacagcattttatattctccagggaaacttcattgttgacttattttaagaaactgccacagacaccccagcctgatcagtcagcagtcatcaacaataaggcaaaataccctatcagcaaaaagattaaaactcactgaaagctcagatgataagcatttttatattttattatttttattttttgagaatgagacagaggcttgctctaatacccaggctggagtgcagtggtgtgatctcggctcactgaaaccttttacctcctgggttcaagcgattctcttgccgcagccaccaagagtagctgggattacaaagtgtacaccaccacacccagctaatttttttaatttttagtagagatggggtttcgccatgttggtcgggcttgtctcaaactcctggcctcaagtgatccaccctcctgggcctcccaaagtcttgggattacaggcatgagccactatgcctggctgatctttagcatttttagcaataaaatatttttaaattaaggtatatgtacactgatttttttagacataatgctcttgcacatttaatagactatagtatagtatagacataacttttggctgggtatggtggctcactttgggagccacccaacactttgggaggcgaggccggtcacttgagcccaggagtttgtgaccagcctggccagcatgccagaaacctgtttctacaaaaaatacaaaaattagctgagcgtggtggtgtgcatctctggttccggctactcggcgggctgaggcgggaggatcatttgctgccaggaagttgaggccacagtgagtcttgatcccaccactgcactgcagcctgggtgacagagtgagacttagtctcaaaaaaccaaaacaaaacagcaaaagaaataacttttatattcaccaggaaactaaaaaactgtttgacttctttattgcagtatctgttttactgcagtagtctggaactgaactggcaatatctctgaggtatgcctgtatttttatttatttatttttaaatttttttttaagacggagtgtccctctgtcgcccagagtggagtgcaatggtgtgatctcggctcactgcaacctccgccttctgggttcaagcgattctcctgcctcaacctcctgagtagctgagattacaggcgtgtgccaccatgcccggctaatttttgtgtttttagtagagatggggtttcaccatgttggtaaggctggtctcgaactcctgacctcctgatctacctgcctcagcctcccaaagtgctgggattacagttgtgagccactgcgcctggccgcctgtatttattacaagttcttctcaaatagtgagaaacctgactcccattatcctcagtatatttacttgtttctttggttccttgtatcactctgacactgcctccgaggcccagtgtcacaggagaatttccaacagagatgagacctctacttgttctaggggagactgcataggaaattgaatttttgggggtgggggtgggggtggggtggggggtacacagatttattaagctagacttcacataccatataattaatccacttagagtgtacaaatcaatgatatgtagtcattgacacaatcgatgttagaaccttttcataacccccaaaaagaaacccctttaccctttagtagccgactttcatttcctttccctgggcctacccaattactaatctacttctgatgtctagagatttgcctgtttctgacagggaaattagatgttatgatcactgaagtttcttccaaaccagcaattttataaaatatctaattcaatcattcttaacaatttttgtttgtttgctttcatggactcatttgagaatatgataaaagctcagacctgctttttagggaaaaaaggtatatatttcatacaaaattgtatttgcagttttaggtggttcatggacattgtgtcccagttgtatattgctgcgtaaccaaccaccccaaaacttaaaggcttaatacagtgattgatttatctttcatggttctatgaattgacttggcttagttgggtaattgccacttgagtacactcatgaatttatatagttaaatgcaagctgctggggctggagtcatctgaaagttcaaatgggttggacattcgaggtaacttcctcacttacatgtttggacccagctggaagaactgggacattgaggttggccaagcatctcttttcctccatgtggcttttccatgtggccacatgaggtttcctcacagcatggcagtcttgtgttaatcttcatattgttgctgtcttcccctagagtgagatcccaagacttctagatggaacctgtagattgtattaggacttagccttttaagccccagaacatcatttctgttgcatactattagttaagcaagtcactaactccagcagagattgaaggagaagggaacgagactctgcttcttgatacagaacatttgtgcatagaaaggcaaagaagggatgacagccatctttaggtgctagttaccaaagttgagaacccctgagcttattggcacactgctaaattcagtacacttacactattttagaactttaaagagaaagttacagatagttcataaatagcatattaattatccattatcaggccctacatttttatccacaagtggcttatttcatctttccatgagcaatagaaaatctgttgttttttttgtttgtttgtttgttttaactgttacactgtttagaataaaaaccaggggtgtccaagggagcgaatacagtcatgagttcttagtttctgtttctggttggtccaataaaaccccttcctcatccctcttttccacttgtcgccagagacagaaactaaaaagcatggtttcaggctgctaaaggtctaaaacaaaacaaaacagaacaaccacaaaataaggtggattggacaaacttgcaatgtattcattgtagcaaagtctagagaaatagttcttttccttagtttttatagttgagcaatgaaaagcaaaaggagtaataaaatacattatcaggtcaaactttatttaaaatactcatactgaaattgaccaggaaacacattttaatttaacatggaattagcagtcatttcttatgatattatcttttgcattttgtagatgactcaaaacaatctaaagtgataccaaagaacagaatccatcacaaactaggtaagaatatttttcttttttaatattttcattgagaaaaataccttaagtttctgtttctaaatataacttatttcttcttaagcaggagaaatacgattatgtggattaattggcagataaattaaaattatgcacttagtttttatgaatttcatagtaagtcaccacaagccacttgaattagtctattgtccatttataaatcctattgccctctcactttttgccccatagtagggggcatgatcctcccttagctatgaagctagggtggagaattttgtcaaagaaactgtaactaccaggtagatggcttccttgacagcatctccttccactttaatccagttgactcctaaacaaagcagtagctaggatagtaagtagacaaagctaagaactgtggaacccatggagaggcccatgtaaagattaacaatccatggttcccaaagagatatttgccagtcaagatacatgatagttcccacctttctgtgatgttgggtggctttccatgtttctccctttatttgaggctgtgagtgctctttcactcatactcagattaccaataggagtgaagctttctctcattgccttactccagaacttagatattgtcagtattttgtgggcctatgtgatgagagactgctatacctctcaatacttaatgcttgtcttggggtgaaatgatgaatcaggagtagggaaagggaaataaaaatgttcctgagcagggcttcagtatttacagaggggaacattgagcattatgcctaagagcagtaggcaacttctcgttagcttcagcatagctttagcaaacaaaaaataggtaagaacatgggaatttgaagataagccaacaaactcaatttagtatacagaactttgcattgttcagataagatgagtgtacatttaacattgtcaacgctgagtattattaggtttttaaatatttgccaatttggtagcctgtttttccattggcttttctttaattgttagcataaatatttgttttttctagtcttttgtctagaaaaatattcatgttctaaaaaataaagctttcatgttctaaaagacagtctttccactgctaagtaccatcaactaaaaactatgtatacacttttgtctgacatctttttatagtattgccctccaacacaccaaatgttcgcaggaccaagagaacacgtttgaaacctttggagtactggcgaggagagcgaatagattatcaaggaaggccatcaggtaaaacttatttatgttataatatctgtcaataaaaaatttgtttactatgtgccagacactgcactacatgtttatatacattaccttacttaatcatcacccccccaaattttgataataggatttaaattcatttttgtctgattaatgtagagatgctgatattttctctttggtagctgaatgttgttattcctgtatcatctgacaagatttccaattgcataatataaagcgttagattagaacgtgagaaaattgtaactggtaaaggtaaagtagttttcattatttttcctattaaccattttccattttctcatagttttctacaaagtagtgtagggtgggcaagaaagtgtagtgttaatcgtagagttattttctttcttatttttgtagagatgaggccttgctatgttgtccaggctggtctcatcttatgggctcaagcagtcctcccgctttggcatctcaaagtgctgagattacaggtgtgagccactgtgcctggccatatttctttctttgatggatatatctaagtcaaaggactaaactcatgtggatttctataaatagttcattgctagccccctccttttttttttttttttaaaagcctccactgatgactgttgatttcaggggagcaataggaccatctaatcatgtttcatcatctaatcctgttttatcagcctctgatttagggtggtagagatataatgaaattggttggtatttgtgttattttaactattagctgcagacatatattctttggtactttgaaaggaaatgtgccatattaaatttaaggagttttgtttcaagattttgtctttcccatgtatattttactttttttgttaaatttcaggaggattcgtgattagtggagtactatctccagacacaatatcgtctaaaaggaaggcaaaagaaaatattggaaaagtcaacaaaaaatctaataagaaaaggatctgtcttgataacgatgaaagaagtatgaacttatttctgaaagtaacttttagattttattttaaataggagtactttgagaagaagctctttgcaaaatatgaaatttacttccaaaaacttcagaaataataccataggtaaaattcattttttaatgtctactttcttccaaatggaaagtaagctaattttattcttaaaaaattattaatagcatattataaatttcttcatgagtaaatttcccagtcaaatgaaacccaccattcctatgcccaagctatggttaacatagacatttctaaagtgttttatatacctctatctcacttagagattatgcaaaacatcacttaataccttgataatgcaagagtttacatgttaaggcttacagaaaataggaagtttagggtgtttgcttttatattaaatcattatgggtttttaagtttgaatttttgtttatcagagtgatttataaataggaagagacttctttgcgtttgacagttttataacttctctatagctatattttgtactgaactttttgggattgagaataattttaagtaagtagtttgtatttcaatggtatttcttttgcagagactaacttaatggtaaatctaggtatacctcttggagatcctttgcagccaacgagggtaaaggacccagaaacaagagagattattctcatgggtaagatcaggcatgatactgaaaatacttaattaaacaatttgtaagaaaatattgcttgcttgatgattggcctgtctactttccctttctctccccaattctatcagtgctaaagtccagaagagtctaattccaacgagcaacctatgtgaagacaactgtgggggaatattgatatcagacagctccaggggacacttaacaccccggacttgtcctctggggcacaagtagtgctacaatcaggaatgtcgtctcccccaacagggtctaggccttctttgaccaggaggacacatgggaacagaggctgtttatggggaattgtagatagatagttggcagactcaaggatacgcttatcatgaagccaggcagggattgtgggtagggcacagacaaacttctgggcctacagatggcagtaatgttacctgggatatgaatcctttgtgaggatgactagcaagggcatcaatcagttgtacagatgccaggtttaaccttaaagctggtgctgcaaagtcctggaagcctcctgctgtattggattaaatatttagtctctagcaggtcatgtaagatccccaagggatgggctatagtgggataggagtttatggattacgcaactgtttaacaaccaggctctctctctctctctctctctctctctctctctctctctctctctctatatatatatatatatatatatatatatatatatgaaatatttaaatatattaacaactgttatgactgtaccattgagtactaagggctgtttgtcctatatcagaggagaagtaggtcaaatcagaaacgcggtaatggtagctgggcgtggtggtgggtgcttgtagtcccagctgcttgggaggctgggacaggagaattgcttgagtctgggaggtggagattgcagtgagccgagatcatgccactgcacttcagcctgggtgtgcagagccagaccctgtctcaataataataataataaaactagttagttaattcctaaaaaaagaaaggtagtaataatggtactcctacttaaaattttggccatgaaaatagatttcatttaatatcttaacaccttagcaaaggtatctctatatgcagattatttatttggtaacagagcttagaagtatggagttttgtttagtgtcttaactgaaagcattgctgtactctaccaggttattgtgagtgttgtcaaaagttcatttcttatttgtttcttgaatctactatatatatatttctatatatatatttctatatatttctatatatatatatatatatatatatatatatatatatatatttatttctatatcatgtagtctgtaggatcactaacattcccaaatatcctgggaaacagaatcagacattgatgacagaataatttattaattatagatctggaaaagtttgttaagtaatggaaatttttgtaagtgaggtagtaatttatgaacaaccattagaactctgctttctcacaaactttacctaataaaaattattagtcaagcaggaaaaaaaatctattggcatggtgatgatacatttgtggtttatgttaaactttaaaaatagagaattcttttttttatctcagctaattctattttctgtctcagttcctataatactgccattttgttattcagctggtgctaacagtgcgtactttttgccagacaatattttaaatagtttacacacattaactcgttgatattcacagcagctcattaatatcgaatagatgaacttattattatttaattttatcgaaaaggaaattgaggcacagtgagagagagcttaagtaacttgcctaaggtcatgcagcttttaagacagagacaggatttgacctctggcattctagctccagagttaatgctctgaaacaactctctaaggcagatttatatccagaaatgactctttattatatatatgtgtatatgttatatcattaaccaatactgctgttgttttatatttgtattactgttttactcctagatcttgtaaggccacaagatacatatcaattttttgttaagcatggtgagttgaaggtatacaagacattggatacaccctttttttctactgggaaattgatattaggaccacaagaagaaaagggaaagcagcatgttggccaggatatattggtgagtactttttttatatatttatgtttcactcttggtagaactctgatttattggatttgatgagacattaaaatgctgttttctcagaaatgaaattcgattactacaccacacagagaaaggtttttatttgttaaatctgtttagagtcaaccagccaacagttatttgacaatatctgttctctgcatagcactgtattttgagattcagaaatttaaggaatgttctttacttaaaaacatcttaaatataggtttgcaaacaaatcattagaattttagtgctgggggggattatagagattaaatctaattccacatttctatgataatgcagtagagaaataggttaaaagacttcttcaaaaatcacttacatcccagttaccctgatttgatcattatgcattgcatacaggtattaaaatgtgacatgtaccatgtaaaatttttatatatcaataaaacagtaacctgagaaaaaagtaaataaaatgagtgagattataaaaaaactacttaactatttagacatagactcaggactaagctagttgcttcagtaagtgctaaataatatactattatatgtaacaatattactggctgaagttgtaatgagattcaaggtgagtcagtttctatcttctccttctttctctttatctcctttcttccacccccacccccatttagagacatacacctctgcaacattggtctgttttatatgtgtgtatgtgtgtgtgtgtgtgtgtgtgtgtatgtataacaggaatattttatatatataaaaaatatttgtagtctgagtttgaaaattgtagaatatagaatttgaaaagcaccaaattttaagaatatttaacattataccagcagttaaaaaatatagctaaggaacatctttcagtatctgacatttcaggagtctgaaattgtgctactaaagtatcacagtcagaatgattctctttgccaacaaacttaaagtaaattcaaaaaggagggaaaaattgtgaagactcttgagtttatattaacaaagaagggcaaatttaggcaaggcaaggaaaagatacatatgaaagtcaaagattattactacatcagtatagttagaatcatgatttaaaataatttaacaatattcattaattcaaactgaaaatgttataggcctccagttattattatgagtgaaaataacacattttaaaagcatagatggtccctgtataataataaagtaactaataatgaggataaacatgaattatcatcactgaagtaatagcagttacctattaaactgtaatgcctttattatacaaaaggaaatttgagtaacagatgtttaaaagtgtgtaatctggctaatattcaaaggaatacacatttaaatccaaatgacactttatagttactgagttaatggaaattattagaaaagtattcataccctgtaacctgtgactcatttctagaaatttttcccagggaagtaatttggaagttcagagtgaggggtgctgaacatatgtagttatttattgaatcattgatggtaattgcagaattagaaaccactacaatgtgctacaggaagaaaatggttatattttaattttgacttagtaatgggataaaccattctgtgatataataaacagttatacagaacttatgtgttccaggtactgcactaagcacattaaaattagtttgagcattttattttgaagaacagccatatatgaagacccttgggataaatgtttaagcaaatatgcaagataaaagttctttgtatatagtatctatttttctaactagaatttaaaaatgtaaataaaatcttgaagagaatacatgttttactctgtgattatgtagttattttagttgattttatttcttctatatattacctttaactttttataatgaaaataaatgaaaattaaagctgaagttttttttaataagactcgtatttttacattttaaaacatgaagcacacttacaaatatatgcttttgaaaaagataataaacaggacaagatggagaaccagcataggccattaactctctttcaaacactgctagagaatatttaaaagagaagagtagtaggtttattaaaatcaaactacagaagaatttacatattaattatgagagctggttgtagaacttcccaggagacaagaaggaaattaaaaagtagaaaatattaaagttaaataatgtagagaagagagaaaagcatgcctaaatacaaataataagaatttcaggagagagaaaaaacccaatgaaaaatggttgagaatatttttaaaattagacaaatgtttcagagctaaaaaaacaaaaaggtgacagcaacctacttaaaagaaccagttccttggaggaatgcctgattctaggcctgaaactgagcttggaatcgatagcaaactactaatcagaaaccattaagattgggtcatgtttcaggttccaacttgaagatgctaccactggctggctaaggatatgaaacttgagtattaacaagaataacttcagtagattgatatgtatcaattatatctaaatccatgaatttctaagactactactactactactacaacaaaaatttgttactgttggaggattctaggaagccaactcactttaacaactgattctgccttttctatataaactgtgctattaggtaatcaaataatagatgagtttgttcttattagaataatattccagctaatgagtgaagaaggaatgttggagttaaaatactaccatttgcaatccctgataagctattgggatctaggcatcaaggctcagtggctgacagataactaaaaagaatacaaccaagcattatgtgcctcctgatagaaaaatacaacactatccaagaagtagtcttgccaaccccatgccttaaaaaagaaaaaaaaaaaaaaaaacctaaaagcaaatacaaaacctgaatctgatcaagtctctagatttaactaccagtttacaagaaataaagtgtggtgaaatctttcaaatgatacctggggatgtagtcagcaaaatccacctgcatgaagatttttatgacaaactgcttaatgttttcaataaattaaatgtaagaaataaaaaagaaccaggtgaaacctagggaatcagggtttctcaaccatggcactagtaacatttttgattagatacttctttgttgtagtgggggccgtcctgtaggtaaggccctgtaagtagaagcttacctggcctctactcattagattccagtagcaccactgtagttgtgacaaaatcaaatatgtcttcagaaattgtccgttgtccctgagaggcaaaatcaccttgattgagaaccgctaatattgattgagaaatttaagaaacagatcaaccaatcactgtatgtggtgctaacctggatcctgattcaaagaaatccttgaagatatgtttaactgatgattggaaatttgactattaactagatatttggtattaaatatttattttttaggtgtgataacagtattgcggttatgttttttagaagcacttgatctttcagtacatactgaaatatttgcagatgaattatgatactgggcatttattttgaaataagatggagtgaggatagtagactctggcttgggcaggtggttagcattaagtattcatgagagttcatcattctatttttgtatgtttcaaaagctttcttaattaaatgtttacagaaatgaggagaggtgtgcttagagaaccaaattgaatagatgagaaaaaaacactagaaatatatactttttagtattacttttttgtctttttgattaaggcaaattatttttggatgtaataactttttttgtcttattaagttataaaaatacctttgaaacatttcggggggcttttttccccatttagggaggcagtatatcacagtgattagggaatgaattctgtaatctaaatgcctgagttcaaactccccccctttgccatttacattgtgaccttggaaaattacttaacctctctgtgcctcagtttcttcatccataaaaagctactaaagtagtcgctgtctcattagtgggcatatacattaagtgaataagaataaagttctcataatactgcttggtatagagtaagtgctatataagtgctagctgttattgttattctggtatattatgatcattgtacaaagtagtaataaaaaataaggaggagaaataattatctgaggcaaaacattcttgatggatgtcttagtcagattgggctgctataataagaataccatagactttgatctgtgtctcttataagggcactagtcccattcctgaaggctctgcactcaggacctaattacgtcccaaattccccacctcctgatcccatcacattgggggggttaagattccagagtgtgaattttcaggagacaaactaatttctaacaatggctgaatctcaaagtttgaaggccttatgctgtttattttagttgctcaaaaaaccaggtcactgccagtgtgtgctacctatgtataaagtatgaaatttggcatgtttgaatatgaaagccagcatgattgagagatttatcctcttttactttcttagtcttgatgcttgtttaacatatgattttgaggggaatagggatttagctttttgctttctttgattcttcaatcagattgagtagtttgttgtcctaagcatgtgacctttaaagaggcatacataaagcctaggtatttttttagtgtaggtgataatctttttgagttggagtctcgctctgtcacccaggctggagtgcagtggcgtgacctcagctcactgcaagctccacctcccaggttcacgccattctcctgcctcagcctcccgagtaactgggactataggtgcccgccaccacgcctggctaattttttgtatttttcatagagatggggtttcactgtgttagccaggatggtctcgatctcctgacctcgtgatccgcccacctaggcctcccaaagtgctgggattacaggcgtgagccactgcgcccagtgcggtgataatctttatagtgtaggtgataatctttacagtggctgtagaattttcataagccagtaagtaataaggaaaaacaaaataaggaaaaataaaagaaatctcttcctgtattacaatggtccccatcctttttggcaccaaggactggtttgtgaaagacaatttttcttccacaaaaattggtggtggcagtgggagttggcattagattttcataaggagcacacaacctagatttctcacatgcacatttcacaatagggttcatgtgcctgagagaatctaatgctgctgctgatctaacaggaggcagagctcaggcagtaacactcactggcgtgctgcttacctcctgctgtgtgagcccattcctaacaggccactgccagtagcggtccctgtcctgggggttggggacatctgtattagttttcagttgctgctctaacaaattacagctatgtgttactgagaaatgagtcattaagctattttgtcttatgaacgtcataagatgatatagcctactacgaacctaggctatataggatgataccctgttgcttctgtacttcaaacctgtacagcgtgtttctgtgctgaatactgtagacagttgtatttgtgtatctaaatgtagaaaaagtacaataaaaatgtggcataaaagataaatgttacccttatagggcacttaccatgaatggagctttcaggactggaagtggtcctggatgagtcagtgagtaagtgctgagtaaatgtgaagacctaggacattactgtacactactgtagactttataaatactgtagacttaggccacactaaattcataaacagaatttttctttcttcagtaataaacctcatctaactgtaacattttcactttatatccttttgttgttgttgttaacttttggactcttttgtaatacttaaaattcaaccatactgtttggctgtacaaaaatattttatttccttattctataagcttttttctattttttttttaacttttaaaacttttttgttaaaaagtaagacacaaacagcacatcagccttgggctacacaagattaggatcattatcactgtcttgcactaccacatcttgtcccactgtaaggtctttgggaatagtaacacacatggagctgtcatctcctataataacattggtttcttctggaatacttactgagggacctgcctgagactgtttcacagttaactttttttttttttatataagtggtaagagtacactctaaggtaatggataaaagtatagtaaatacataagccagtggcatagttgtttattatcattaccaagtgttttgtaccacacaaaattgtgttatattttattttttacttcaataggttttggagaacaagtagtgtttggttacatagataatttttttttttctttcattgagatagagtctcccactgtccccaggctggagtggcacgatatcagcccactgcagcctctgcctcccgggttcaagcaattctcgtgcctcagcctctcaagtagctgggattacaggatgtattagtcccttctcatactcctataaagaactgcccaagactgggtaattttgaaaggaaagaggtttaattgactcacagttctgtggggctgggggtgcctcaggaaacttacaattatggcagaaggggaagcaaacatgtcctttttcacatggtggcagcaaggagaattgccaagcgagggggaaaagccccttataaaaccatcagatcttgtgagaactcactctcatgagaacagcatgagggtaactgcccccatgattcaactacctcccactaggtccctcccatgacatgtggggattatggcagctacaattcaaggtgacatttgggtggggagacaaagccaaaccatattacaagagattatttatttagtggtgatttctgagattttggtgcacctatcacctgaacagtgaacactgtacccaccgtgtagtcttttatacctctcctcctcccacccttccccctgagtcctcaaagtccattgtatcattcttatgcctttgcatcctcatagcttagctcccacttataagtgagaacatacaatgtttggttttccattcctgggttactttattagaatgatggtctccaactccatgcaggttgctgcaaataccatccattatttcattcctttttatggttgagtactattctatggtacatgtataccacattatctacttgttgattaataggcatttgggttggttccgtatttctgcagttgcacattatgctgctataaatgtacgtgtgcaagtgtctttttcatataatgactcacttttcttctgagtaggtacccagtagtgggattgctggatcaaatggtagatctacttttagctctactaaggttttctgtagcggctgtactagtttacattcccaccattagtgtaaaattgttcccttttcactgcatctaggccaacatctactatttgttgattatggccattcttgcaggaatgaggtggtatctcattgtggtttcgatttgcattttccttatcattagttattgttgagcattttttttgtgtgcttcttggccatttgtatatcttcttttgagaattgtctattcatgtccttagcccactttttgatgagattgtttggttttatcttgctgatttgtttgagttccatgtagattctggatattattccattgttgcacagacagtttgtgaatattttctttcactctgggttgtctgtttactctgccgttgcctgtttactctgccaattatttctttggctgtgcagaagctttttagtttaattaggtcccatctattttgtttttgttgtgtttgcttttggattcttggtcatgaagtctttgcctaagccaatgtctggaagggtttttctgatgttatcttttagaattttcatggcttcaggtcttagtttcaagtctttgatccatcttgagttgattttggtataaggtggcagatgaggatccagttttatttttctacttgtgccttactggttatcccagcaccatttgttgaatagggtgtcccttccctacttagtgtttttgtttgctttgttgaagatcagttggctgtaagtatttggctttacttctaggctctattcagttccatggtctatgtgcctatgttcatttcagtactgtgctgttttggtaactatatgtttatagtatagtttgaagtcaggtaatgtgatgcctccagatttgttctttttgcttagtcttccctttggctatgcaggcccttttttggttccataatgaattttaggattgctttttctagttctttgaagaatgatgatagtattttgatgggaattgcattgaatttgtagattgcttttggcagtatgtcattttcacaatactggttctacccatccatgagcatgggatgtgttttcatttgtttatgtcgtctatgatttctcatctctttggttaggtatattccaaattattattattatttgtggctattgtaaaaggagttgagttcttgatttgtttctcagcttggtcgctgctggtgtatagcagagctattgatttgtgtacgttgattttgtatcctgaaagtttactgaattcacttatcagatctaggaactttttggatgagtctagggttttctagctatatgatcatatcattggcaaacagcaacagtttgacttcctcttttctagtttggataccctttatttctttcctttgtccgattgctctggccaggacttccagtactatgttgaatagaagtggtgaaagtgggcatccttgtcctctttcagttctcaggagaaacttttcaacttttccttgttcagtatgatgctggctgtaggttagtcataaatggcttttattaccttgagttatgctccttctatgccgattttgctgagggttttaatcataaagcaatgccggattttggcaaatgctttttctgcatctattgagctgatcatgtgattttttggttttaattctgtttatgtggtatttcacatttattgacttgcgtattgactcctctctgtcttttggaatcatttcagttggattggtaccaattcttctttgaatgtctgatagaattcagctgtgaatccatctggtcctggacttttttgttgttgttgacaattcttttattaccttttcaatcttgctgcttattattggtctatttagagtttctatttcttcttggtttaatctaagaaggttgtgtatttccaagaatttgtctcttttctgatagataaattgaatgtctgatagaattcagctgtgaatccatctggtcctggaattttttttttctttttcttttcttcctttttgagacggggttttgctcttgttgcccaggctggagtgcaatggtgcgatttcagctcactgtaacctccatctcccaggttcaagtgattctcctgcctcagcctcccaagtagctgggattacaggcatgcgccaccaattctggctaattttgtatttttagtagagacggggttttgccatgttggccagcctggttttgaactcctgaccccaggcaatccacctgcctcagcctcccaaagtgttgggattacaggcatcagccactatacccggcctggactttttttgttgttgacaattcttttattaccgtttcaatctcattgcttgttattggtcttttcagagtttctatttcttcctggtttaatctagggagttgtatatttccaggaatttatctgtctcatctaggtctggtttgtatacataaaggtgttcatacgagccttgaatgatcttttgtctttctgtggtattggttgtaatatctcccattttgtttctaattcagtttatttggatcttctgtcttctttgttaacctcactaatggtctatcaattctgattatattttcatttagttctaccaaatggcctgatcttcatctgctgggtttaggttttgtttgtttttatttctctagctccttgaggtgtgaccttagattgtgtatttgtgttctttcagactttttgatggaggcatttaatgctattaactttcctgttagcactgcttttgctgtatcttagaggttttgatagattgtgtcactattattgttcagttcaaagaatttttcaattttcatctttatttcattgttgacccaacaatcattcaggaggagattatttaatttccatctatttgcttggttttgagggttcattttggagttgacttccaattttattcgactgtggtctgagagagtacttgatataattttggttttcttaaatttattgagacttgatttgtggcctctcatacagtctatcttggaaaatgttccatgagctgatgaatagaatgtatattctgcagtttttgggtagaatgttctgtaaatatctattaagtccatttgttccagtgtatagtttaaatccattgtttctttgttgactttctgtcttgatgacctgtttactgctgtcagtggggtattgaagaccttgagtataagtgtgttgccgtctatctcgtttcttaggcctagtagtaattgtcttataaatttgggagctctggtgttaggtgcatatatatttaggattgtgatattttcctgttggactagtccatttcttattacataatggccttctttgtctttttaactgctgttgctttaaagtctgttttgtctgatataagaatagctactcctgctctcttttggtatccatttgcatggaatatcttttactacttctttaccctaagcttatgtgaatccttatgtgttaagtgagtcttttgaggacagcaggtactttgttggtgaatgcttatgcattctgccgttctgtatcttttaagtggagcattgaagtcatttatattcaatgttagtattgagatgtgaggtactgttctgttcattgtgctagttgttgcctgaatactttgggtgtgtgtgtgtgtgtgtgtgtgtgtgtgtgtgtgtgttttatagaccctgggagatttatcctttaaggaggttctattttgatatattttgagtttttgtttcaagatttagaactccttttagcagttgttgtagtgctggcttgttagtggggatttctctcgccatttgtttgtctgaaaaagactttatctttctttcatttatgaagcttagttttgctggatactaaaattcttggctgataattgttttatttaaggaggataaagataggacctcagtcccatctagcttgtagggtttctgctgagaaatctgctgttaatctgataggttttttttaaataggttgcctgatgctttggcctcacagctcttaagattctttgctttgtcttgactttagataacctaatgactgtgtggctaggtgatgatctttttgcgatgaattttccaggtgctctttgaacttcttgtatttggatgtctagattgctagcaaggccagggaagttatccttgattatttcctcaaatttttccaaacttttagatttctcttcttcctcaggaacaccaattattcttatgtgtggtcgtttaacataatcccaaacttcttcaaggctttgttcatttttttttttaatttattttctctttgtctttgattgggttaattcaaaagccttgtttttgagctctgaagttcttctactcgttcgattctattgttaaaactttctaatgtattttgcatttctctaagtatgcctttcatttctggaagttgtgattgttttttatttatgctatctatttctctcgagattttttcatcaaaatcctgtatttttaaaaaaaaattctttaagttggttttcatctttctctggtgcctccttgagtaatgtaataatcaaccttctgaattatttttctggcaattcagagatttatttgtttggatctattgctagggagcgagtatgatcttttgggggtgttaaagaaccttgctttatcacattaccagaattgtttttctggtttcttctcatttgggtagactgtgtcagaggagacatctggaggtcaagcactgcagttcagattcatttgttccatggagtgatcccttgatgtggtgctctcctccttcccctagggattatgcttcctgagaggcagtctgcagtgattgctattgctcttctgtgtctagctacccagcagagctatggggctccaggctggtactgggaagtgcctgcaaagcgtcttgtgatatgatctgtcttcaggtctctcagccatggatctcagcagctgctccagtggaggtagcaggggagtgaagcagactctgtgacggtctttggttgtagttttgtttagtgtgctggttttctttaatattggttgtgctagcaggtggctggccaccagccaggagatggtactttcaagagagcatctgctgatacaaggttgccacaggttgcctgggtaagtattcaggtttctcaggtgatgggtggggccttatagctcctgtcttaggctacagggcagttagagaaagaccatcaggtgcaggtaggattgattaggtgtgtctgagctcagactctccttgggctgagctttttgtgaccactgtaggggatgaaaatatggttcccaggccactggagttatgttcccaaggggattatggctgtctctagtgcatcatactggtcaccaaggaagtgggggaagctggcagactggcctcacccagctcccaagcagccaggctaggccagtctcactcctactgtgccccaccaaaccaagtttgtatccagacagccagtgagcaggactgacattttgcgctaggctataagtctccctgctgagaaagcaagctgggctttcaggccctgccccttgctgcctaccctggcttgtatctgaacttcctattcgcccttcccccaattctgcccaggaaaattcacgcttcatcaaaattatttaaagttcagctggaagtttccttctttctgtggtcctcccccagttccactggcagccatccccaaggaaccctatgagataaagtcagaaatggcttccttgggtttccttggaaaccaggagtacttaacagggctcttcctgcctctgcttctactattatatttcccttggctctctcaattcgtttcagctctaggtaaggttaaatccttctctcatgacctggattttcagcttccccagtaaggatgtgtttggaggcagactttcccccctttcacactttgggcactcacggttgttcagctgtctcatggagtttgcagcagcaagccatttctttcaaagagtctgtgaattctttcagttttcttggtatgttcctgcagtagttcttctggcaaaaaagttcatgatgtgagtttccacatgctgttctgtccatctgagtgggagctgcaagttagtcctactttctatcctccactttttcctgtatgtgctatacttttatgtgactggcagttcagtagatttatttacatcagcatcaccacaaacatgtgagtaatgcttttcactgggacatcatgatggctgtgaggtcactaggcaatacgattttttaaatgccattgtaaccttataggaccactatcatgtaggcagtttgctgttgactgaaacatcgttaggcagtgcatgactgtatcacaaatttaatggcttaatactcttgggctgggcgcggtggctcacacctgtaatcccagcactttgggaggccgaggcgggcagatcaccaggtcaggagatcgagaccatggtgaaaccccgtctctactaaaaatacaaaaaaaaattagccaggcgcgatggcgggcgcctgtagtcccagctactcaggaggctgaggctggagaatggcatgaaccctggaggcggagcttgcagtgagccgagatcgcctcactgtactccagcctggatgacagagtgagactccatctcaaaaaacaagaaacaatactcttgtattatctatctcacagttatgtagagagaaccatgagcttgaccaggtattctctttagagtattacaagactggaatcaagatgttgacaggtttgtatttctttctggaggctgtaaggacgaatctgcttccagtctgcttccagtctcgttcagactgttggcagaactcagttttaagtggttgtgggactgaggttcccatttcctcactggctgttggccagggtgtcattcttagattttagaaataactcatgtttcttggcatatggccccacatctttagtgccagcaacggtgcaagtccctttcatgcttcaaatttctgtgactgttccttctctttcgtttcttctctgcttccagcaggagaaagtactctatttttaagggcttaatgtgattagattgggcctacctacattatcaaagataatctccccatctcaaggtcccttttgccatgaaatttaatgtatttacaagttctggagattaaagccagcacatttgtggggagtcgttattcttcccactacattttaaggttcctttgaagtattatcatggttcagttttgaatgagatttttatttttatttttacaggttttttatgttaactttggtgaccttttgtgtactttacatgaaacaccttatatattaagtactggggattcgttctatgttccttcaggtaagacaatttatttcacttagacaacatgtatatagttgtttttgggcactatggaaatggaagccacagtggtcaaaatgaagtgtgatatgactgatggatgtcagaacagtttggtacatattttcctttcatttgatcattaggtaagtgtattagcattttgtggtggtttttttttgtttttgagacagagtcttgctctgtcacccaggctggagtgcagtggcacgatctcagctcactgtagcctccacctcctgggttcaagcgattcttgtgcctcagactctcgagtagctgggactacaggcacgaaccaccacatccggctactttttgtatttttagtagaggcgggattttgctatgttagccgtaacagatcacctgacctcaagtgatctgcccaccttggcctccaaagtgctatgattacaggtgtgagccacagtgcccaaccaattagtgttttgatacatgagaacaagagttgtttactactgaatatgaaaatattggctgggcatggtggctcatgcctgtaataccagcactttaggaggccaaagtgggcaaatcacaaggacaggagatcgagaccatcctggctaacacagtgaaaccccatctctactaaaaatacaaaaaaattagctgggcgtggtggcggacacctgtggtcccagctactctggaggctgaggcaggagaatggcatgaacctgggaggtggagcttgcagtgaccagagactgcaccactgcactccagcctaggggacagagtgagactcggtctcaaaaaaaaaaatacatttatgtatatagtcagcagatatgttgtattacagaggagaacaaaaattatttaccccatgttatctctaagaaattatgtttttagaacattattttaaactgtttcaagaatggtatgcttcatcagctatcgaacagcagaagttattgtaaataggcattttaatccacttgtcattcattcactcattcaacaagtatgattaagagactactatgggccaggtgcagtggctcacacctgtaatcccaacattttgagaggctgaggagggcttgaggtgaggagttcgggaccagcctgggcaacctaggaagaccctgtgtctacaaaaaatgcaaaagttaaccaggcacggtgatacacacctatagtcctagctctcgggaggctgggacaggaggactgcatgagcccaggagttcaaagttgcggtgagctgtgattgtactactgcactccagcctgggtgacagagcaagactctgtctcaaaaacaaaaacaaaacaaagtgtctactatgtccatgtattgctgcaagatttgggatatataaatgaaaaaacaggcaaaaatccctgcttttatagagcttacattctgttggaaggagacaataataatagccatacttgcataatccttagtatgtcagcactgttgtgaatactttctcaatttctaatatatagaaagtcacagtgatagtactcaattctaataagcctgtcacatgtgatacttgcggtccatctgtatttcacttttgctgttatttgttacctcatttatttaagagtagcatttgcctttttaaaattttgagattttggccgggcgcggtggctcatgcctgtaatcccagctctcagggaggcaagaggcgggaggatagcttgagcccaggagttcgagacctgcctgggcaatatagcgagaccccgttctccagaaaaagaaaaaacaaaaacaaaaaataagtaaataaataaaattttgagattttattctacttaacattgtaccttttatattcatctatatatgagtatgtctggttagaggaatccacagcagttctgtagacctaataaagattggtttcagaaagagattttcttttcttacactctcgactgattcatctccgtatttattttcataacgatgtgaaatttatatttctgttctctcaagcctcatctggatcacgtgtcatggttagctgttgatgtagttcatggaattaaataagttactttaggttaggtgaattgtttttatcttgtgtcctatactacaactgtcaggtgatgactacatacttaatcaaaaagaatgattcatatgtaaataatttttattttcttatcactttacttttaggtaactattataacatcaaaaatctccggaatgaggaaagtgttcttctttttactcagataaaaagatgaaagatcaaccaaccttaaatatatgtatgtatatatgtatatgtgaaaaacagtttgtatagttggaatatttgtctttgtaattacttgtgatgttttaaaataaaaattttattcagttttctgtagacttgtatttgataaacatttctaactcacatgttttttctgatttttcagtgactgtacataatagcttgtagcgatgtccatatttatgatattatttttataatttgacaagaatatgaaaatgaaatatagaacatttctgtgtcaaaagagacctgattaatatgtctactcattaaaaaacatcttttccaaatactaattttaaatcatttattattaaataatccaatgggagagaactgtggtaaaaggcatgtttgtattaatttcctagaactgctgtaacaaaataccacaaaatgagtgacttaaagcaacagaaatttattatctcagttctagaggctagaagtctgaaatcaaggtgttgtcaaggccgtgatgtctttgaaaacctgtaagggagagaatccttccttattcctaacttctggtggtttactggcaatttctggcattccttggcttgcaccggtagcatttcaatctacttgcattatcacatggtattctcaccttgtgtgtctgtgttggcatgacatctatttagtatattacatgtaaatgtttttccattatgctttttggttcatattttctgttggaggcagtgtccttcgccattgctttctgtatgtggcctcaactttccctttttaatatcaat

SEQ ID NO: 592 - DNA, 7489 bp, Homo sapiens
catttcaatagtcgcgggatacttgaactgcaagaacagccgccgctccggcgggctgctcgctgcatctctgggcgtctttggctcgccacgctgggcagtgcctgcctgcgcctttcgcaacctcctcggccctgcgtggtctcgagctgggtgagcgagcgggcgggctggtaggctggcctgggctgcgaccggcggctacgactattctttggccgggtcggtgcgagtggtcggctgggcagagtgcacgctgcttggcgccgcaggctgatcccgccgtccactcccgggagcagtgatgttgggcaactctgcgccggggcctgcgacccgcgaggcgggctcggcgctgctagcattgcagcagacggcgctccaagaggaccaggagaatatcaacccggaaaaggcagcgcccgtccaacaaccgcggacccgggccgcgctggcggtactgaagtccgggaacccgcggggtctagcgcagcagcagaggccgaagacgagacgggtaaagggatgcgggatatctgcaggagggtgggtcgagcagggtttggcattggcttagcaggcagagaagagtggcgagaaggcatgtcctgggcttttggaagggggccagggtctggagtgcagttggtgctggtgtgtggtttgccacagtaggagttctcccatattagcatcaggaccccgccaacactgtgtgtatgctgccggtctgctctctatagggggcatctgcctgtacataatggggtcaaaccaagctctaaaacgtgtagtcttcgctcagctccgcgcctttctctccacttttaaaccccaggcactgctgtaggactctgacccctatcctcctcacgcttaagagatgacctctactttagaaaagcgtgtacaaaatactttgcttttggcaaattccgccattttagccggatttgctctgttgctccaccctcgggcgacagtggtgaaccaacaatttttttgctgtctttcctaaacttgtcacgtattggcctgtcacccgacccttcttgtggccctgataagttttgcataattccacctagtgttatctattgatagcctttgtgggaatgcctgtgacaaatgggaacatcccttctcttttgaatactgaaactcttctttgtcccagaaagtttaattcctgatagagtatttgggagaaaaagcaaaggccaacacccataagagaaagaatgcaagactagtaggctcaaagccagttattaatttttttttaggttgcaccccttaaggatcttcctgtaaatgatgagcatgtcaccgttcctccttggaaagcaaacagtaaacagcctgcgttcaccattcatgtggatgaagcagaaaaagaagctcagaagaagccagctgaatctcaaaaaatagagcgtgaagatgccctggcttttaattcagccattagtttacctggacccagaaaaccattggtccctcttgattatccaatggatggtagttttggtaagttttaaggaaaatctgtgtggaattacggtaattataattattagatgatattaatgatttgcattttaagatgtcttatgtagtcattttgactatagtgagttaggtttaatgtaacaaggcttagaaaggatgtgacttatctcagatctcacagctaacacttgacttggtgacatacaaaaagatccttatccagtgctctttcaggttcactgccagtcacatcaatctaattataattagatcttaaatgcttattttaatctgatcccataaatgtgttcttggttgggagaatagatttcagttttatttaactcacttatatatcacttagtgctatttgaagatgcagtcttaaatattgtgattacataacgtctcttccagttttataattttgtttctataaaaccagtctggattagcatctgataccagaaagtgacacttttcctcctacaagtaaatagttgtaccatggctgtttactcttacccatgtattaaagtagcttctgtaaacagctctttgcagtttgtactatttctttgccctagggatattgagtcactggacagctcactaaatccaatctcattttagttttagttgtattgattgtgaggaaggaggggtgagcaggaaaagtcctttggaaataataatttgtgtgtttttatcaaaattttgcagaaaatgtttaatctcaaggtgatctttgaagtgaaaggaataatggatgatactctttgcttcaaaataatttatactacaaaaaataaattatttatagtgttaatccatttgcccataacaaacctaatttcttaataacacttgttaatagaggccatttaactgatgctagctattgcctacttgtgctttatatatgtcagactctgggatctgcagtttctcttgggacaaatcttagatattatctcaaaacttggattttaaaagtgttctgtcctaacagaaccaccatgccatttgctcctttctgttgtggaagatggatactttaagataatacctgattctcattttcctgttaggggcctaccaatatgtttttttttttttccctcattaactaaaatcattccaaagttctatgtacagagatactgagactagggtaaaatattctacatattttgtcatgagaagctctttttagtttgaagaaataagtgctttgttaatatgagattccttccatggcagtcatttttagctattaaactaaataggcaaacaattaatttaatcatatcttttgaattgtcccagagtcaccacatactatggacatgtcaattatattagaagatgaaaagccagtgagtgttaatgaagtaccagactaccatgaggatattcacacataccttagggaaatggaggtaaaggttctctgaatccagtttgtataatgtatttgttaaatgtggctaaatgaaattgagaggataatgtttaaatttttaaactaatgaattattctaatgctacagttaagtttatagcatgtagcctctcgtaattaatggtaaaataatctaattgcagtttttacactagaataattttaacactataaataattttctcaataggttaaatgtaaacctaaagtgggttacatgaagaaacagccagacatcactaacagtatgagagctatcctcgtggactggttagttgaagtaggagaagaatataaactacagaatgagaccctgcatttggctgtgaactacattgataggttcctgtcttccatgtcagtgctgagaggaaaacttcagcttgtgggcactgctgctatgctgttagcctcgtaagtctaccttggtttgtttaaaagtgatcacgaccttttgtctagggaagaaattgatttttttaatggtgaccttttaacatacaccaggcagagtcagtgactactttagggatggcaatgtgctggggcttagggcagtggaggaggatgaaactgttctaatctagaacactaattttcccccaactggattccttgaacatgatatagtacactaggttacaaattttaaaacattttccttccaatattactttctggcatataagcagtgtctcttttattaagaagtaaaggctgggtgcggtggctcgcgcctgtaatcccagcactttgggaggccgaggtgggcggatcacttgaggtcaggagtttgagaccagcctggccatcatggcgaaaccctgtctctactaaaaatacaaaaattagctgggcatggtgatgcatgcctgtaatctcagctactagggaggctgaggcaagagaatcgcttgaacccaggaggtggaagttgcagcgagctaagattgcaccactgcactctggcctgggcgacagagcaagactcttgtctcaaaaaaaaaaaaaaaaaagaaagaaaaactaaatttaaaaatgaaaacatgaaacatgttttcctaagacttgtatttcctaaattttcagctacttggtgaactctggcattgttcccatctcgagaagtctcatgcctttcatttacttcctttgactgaactggggaaaatatctcaaaagtcctttattgatttgggccttttaattagcaattagctatccagtctctactagaaatgatgatcaagtgtctggaaatgcagttggtgtggattttggattcattccatattctgctaatgggatttcagaactgggataaggaagcttgcttctcttttaggactgattacttaaaacttttttcattgtagaaagtttgaagaaatataccccccagaagtagcagagtttgtgtacattacagatgatacctacaccaagaaacaagttctgagaatggagcatctagttttgaaagtccttacttttgacttagctgctccaacagtaaatcagtttcttacccaatactttctgcatcagcagcctgcaaactgcaaagttgaaagtttagcaatggtgagttaactttcattttgttgaatggtgattctttggtaataattaggggtaagccctaattcctttgtaaaggaacctagttcctttgtacagcagtggtgaagagatttagtattcagagggagattaatgctgcagtatggaagaaagcctactgctggcaaaagataatctatatcaggaaagcactagaagcagaggtctaaggatgacatcttggggatgggtagtcagaagagttgttttttaaaagttaataaaggagggaaaatacaggatgaggatggaacaaaacactaaaatgattgatatgtttaaagatgaggctgtgagatattttttctagagttgctacagagccgttatcaaaggcaggaaaaaattaggttagaaggcagaggtttgacatttgaattctaaacgctcttgtgatcataaagtattttttattccagtttttgggagaattaagtttgatagatgctgacccatacctcaagtatttgccatcagttattgctggagctgcctttcatttagcactctacacagtcacgggacaaagctgggtatgtattacggtcttcacacacctatcttgtgactgaaatgcctgtgccagattaaataataattgtcctacaaaactgagggttgcctagatgttcttacttggaaaaacttcaaatatatatagttgacctttgaaaaacacaggtttgaactgtgtgagtccacttacacatggatttttttccaatcaaatgtggactgaaactacagtattcaggggattcacaacccatatatatggaagggtgactgcaggacttgaatatgtacagatttgggtatatttgggaagggtcctggaaccaatccctcatgtacactgagggatgattatatactgtttaaggcatgttacctgttgaacagtgtttgttaggtagtaagcttagttgtaacttggattgaaaggtgagcttttttaaaagcatctgacctgttgctggcagggaaagtagtagaaaatggatcgagggatggaataatggcctgagaaaactagtagttggaaaagttaaagattagtactggaatttaacataagcttaatgccaactatttactgtgtttggtgtgttactaaaagcaaaactcaggggttctctattcccttctctgtagcctgaatcattaatacgaaagactggatataccctggaaagtcttaagccttgtctcatggaccttcaccagacctacctcaaagcaccacagcatgcacaacagtcaataagagaaaagtacaaaaattcaaagtaagaattaacttggatattgaagcttacttttctagattatggttcagagatctttgacattttaaccttattcatgaatctgccatagcctccttgagaagctgttctctaaattggttatgtgtttgaagaaggttgtagttcatgctttctgccctgggtctgggggagaagagagaaggaagggggcatgcatgtgtgtttcagggaccagacagtgtttctaaaaccatcaagtcggtcagacagaaatagcattttttagttcccaatacatgagtacaaacattattccatgatctcctttacccagtgagtgtttactaaaaatgctttttttttccctacttacaggtatcatggtgtttctctcctcaacccaccagagacactaaatctgtaacaatgaaagactgcctttgttttctaagatgtaaatcactcaaagtatatggtgtacagtttttaacttaggttttaattttacaatcatttctgaatacagaagttgtggccaagtacaaattatggtatctattactttttaaatggttttaatttgtatatcttttgtatatgtatctgtcttagatatttggctaattttaagtggttttgttaaagtattaatgatgccagctgtcaggataataaattgatttggaaaactttgcaagtcaaatttaacttcttcaggattttgcttagtaaagaagtttacttggtttactatataatgggaagtgaaaagccttcctctaaaattaaagtaggtttaggaaaacagaccctcaaattctgacattcattttcctaagcaactggatcaatttgctgacttgggcataatctaatctaagcatatctgaatacagtattcagagatagatacagtagagattccccagactttttcgctctttgtaaaacctgtttgtttaggttttgcgaggtaaactcaacagaggttgggagtggaagagggtgggaagcttatatgcaaattaacagacgagaaatgctccagaaggtttattattttaaagcacattaaaaacaaaaaactatttttaaaatcctgctagattttataatggatttgtgaataaaaaatacccagggttctcagaatggaataaatatcccttttaatagttatatatacagatatacaactgttagctttaattggcagctctcttcttttttcttcttttcactggctttttacttggtgctttttcttgttttgcactggtggtctgtgttctgtgaataaagcaaagtaagaatttactaagagtatgttaagttttggattattgaaataagaggcatttcttagttttccagtaggatctaaaatgtgtcagctatgagtaagactggcatccaagaagtttatattatagatttaggtcctaatttttataaatcacaaggtaaaaaaatcacagaacagatggatctctaatgaaaaagggatgtctttttgtttatagtcatgtggcaagatgagagtaaaaccagagagcaaacctctataagtgttgagtatatgtatacatttgaaataaaccagaaatttgttacctta

SEQ ID NO: 593 - DNA, 277125 bp, Homo sapiens
gctaccacaccagattctgaaggggaggagttgtctggaaagaccagagctgggtgctggggatctggagcagctcgggacccgcgctgcagggagctgggatgggagaggtgagggagaggaggatgggactctgggagaaagagagggggctgggctggcgctggggatggaagaggcgaggtgaacgcactcaagcggttacctgcagacagggagagacagtggcaaatacctgccttcaattaaacgcatatcaatttgtgtgtggggtcagtactgcacatcatcaagcctcttgggtataaaaccttcctactggaactctccagccccgcccccaccaccccacgcgcggctccctgctttctcttgctttggggtgaggctggggatgtgggtggctccagagttccctgcccgcagtttaggggcgaagtgatcggtgtgtgcgcgctgggcactctgcgggttaaaaaggtttagcagaaagggatgcagatggaggcgggaagccaggctaagaaagggataccgacctccctcctcgggtcggaggtgtgaactgggaagcactgcgcagacctgagcgaggtggcctgaatccaggggccgggcaagggggtggtgtgaatagaaatagcacatttcccaggctttcagccccggtactctgccatccttccagttccatgcactcagccaggtctccaggctggagcaagggctgggggtcaatgggtccttccttctctcgggaaacgttcttctggcgcgaagctgggcggagggagagtcggacattttcctctgcttctctcagggcagctggcgtggccacctcgcaaggctgcttctagggacacgagactcgggagggtcagagactttcaggccgggccttcactcccttccccggggcacttgggcaagagttccagctcttggctacctctggcccgcgcgtgagttcagacacccagcacacgcgacccccgcagggaaaccccgggaagctgcgcgcaatcgctggggactcgccagggctccacttcccaagctccgcgccccctgcgcccaaagaggcagggcggagcagaggccgccggcgtggaggaggcgagcgcggggctggcccgggagccgcccccggggagggactgagacctgccccaggagtcgagggcgagcggcggacccggctgggcccggcgcacgccgaggagagggagcccccgccaccgccgctgcctccgcgtgctcagcctgtccccgcccagggagccggagcctccaactaactccgcccgccgctccgccgcccgcaggctccggcttccgtcccggacagagcccgtggtcgcgcaggttggtgttgttgccgctgctgccgccactgcgaggcggtcagggcaagggtgagggtgggggcgcggaagggggcctgggctcgggatcctgctgccaccaattcctggtgccccaggaggttgttgctttttctcccgggctgcccgggtcgggggtggggggatggggcggggatccagcgatgcggccagggaggattttggggactgagctattctcgcatttcccaaacctctctcacgacccttcatcaccattattaagtccctggccagtttgtgaggggtcgtcctcccctccggtccttctcacctccgcacttctccttgtgccctctccctagggggtacaatttgttcattcgccttttctgcccccaacttggagaactctccgtgacgcctagaaagcctcctcggttctccgcccgcccttcagtctagtttggggaagtagaggccgccgcggagtagcaacctggggtgtggagtgggggcgagtgccgggaagcagtggaaattccttcccctctttctttcccgtccttgcccagctttgctctcttcctgccgttttgccagcctccgaatgtaatacgcgggcgaagggcgatctccaaggcagaatgggaagtatccaccacttgggatactagttaagtctaggttcagtcaccttcccagctctgtggccttgggacccgccccatcggaacctgtatgttgtcatctgcaaaatatgcgtcagctctgcctgccgctgagggtagttgtggggctcccttgggatgacttagggtattacgtgattttgagcacggtctcttgtctcgtgcagctgcctgatggcaggtcctgtgttctgatcgtctgagttcaggtcctttggctgagatgtgattatctctctgggtgatttggtcagtagctttgcggggctaaaaggcatgtgttcctggagctggtcattggggttcagagttgaaatcgtgtcgtccccaccaatccctgtgtacaaagctatggaccttacatcctgtgcctttgtggtcatagaaattcaagtagaaggaagatcttattggactttgtttgcttcagatgttttacattctttacaatcgcttttctcttctaggtgcaaacttaaatttactgctaattctaataatccaggaaggatactttcattttagtaaaatcagacatttagctcaaataacatgtgacatattgtttgtaaattttcagtttataatcacaggcacaaaaaagcatagttcatgccattctagttactttataaagcaagtaaatggcctaaaaaatcagctttacaggaagtcagggctgcagtgaactgtgtttataccactgcactccagcctcggtgacagagcaagaccctgtctcaaaaataaataatcagctttagaattgatattaaatggtaagccctgtcgttcctgcattcctgacttaataggcattttcattccgcgatgcactctgctatatgctttaaagatataaagatatagagtatgttccttgtcctgaagggccttccaaggtaacttaaagactatgtagttttatttcatatttttatatgaacagtcttctaatgactatacatggcaagtagaatgaggtcaagaatgcattatcaaaggccctttaagatcatcatttggccggctgcggtggctcacgcctgtaatcccagcactttgggaggccgaggcgggcaaatcacaaggtcagaagttccgtaccagcctggccgacatggtgaaatcccatctctactaaaaatacaaaaaattacttgggcatagtggcaggcacctgtaatcccagctacttgggagactgaggcaggagaatcgcttgaacctgggaggtggaggtttcagtgagctgagatcactccacacactccagccctggtgacagagtgagactctctcaaaaaaagataaaactaaataaataaatagataaaaaatcatttggtgagtttgcataattggaagaaataacaagtttgttaagacattgctttctaaaataaaatgccatgtgctcctacttcatcaaggtgcacttggaaataaaatgaattctgtgtttttagaatgaaagcttaggaaaacattctacacatgtatgatgtgctaatcaaatgttaaaagctatagaaattttaattctaacttccttcaactgtatgttgtggttcccacatacagtttttttctcaactccttgaggaaggaaattataatgcctagaaaaaatatacagagatttaatgtaagatttttaataagctggaccttaaggcctggtgggtcctgaagtgactctggaaatttgactttaaaagttacgagacttggtgagactgagtgtggtggctcatgcctgtaatcccaacactttgagaggctgaggcgggagtattgcttgagttcaggagtttgaaaccagcaacatagtgagaccttctctctacaaaaaatattaaaagaaaaaaaaagccaggtgtggtggtgcacgccggtagtcccagctactcaagaggctgaggagggaggatctcttgaaactgggaggttgaggctatagtgagctgtgatcatgccaccacactccaacttgggccacagagagaggccctgtctcaaaaaaaaaaaaaaaaaagacttagaattttgtttttttttttttttttttttttttttttttttttcttggggcaaagaatgagcaagaattccacctggaaaagattgaccagggatcttgactttctgtctaggttgtattttgtgtgactcagtgacatctctgattcttttcctcctcctaggaagaatttatctatctgctatgtgcagaatttattaggctttacatactgggctttgaggctttgattggactctcacattaaggcatggcaggctgaggggcagcctgagggacataatgttaactttacacttggctttattgttccatacctttgtttttctatttgtgaaatgagattaaagatccttcttactgccctggaagccgtgtcatctggtataatagccataaatgcttcttgtgtgtataagaactttctttaccatttgaatgcgaaagctaattattaaaaccacatacaaatagctcaaaagatgggctgtgaataaagctgctgttggtgtcatgtgctctcaggtatcctggcagaaatttcagtcatcatgtatccctacaatttactgtgttgtggagaataaggccttcattttatctggggttgaatgtttacctctccaaaatgggaataatgaaatactaacctgaaaggactgttgtcagcattaaatgagctaatccatgtgtggttcttagcacattgccagtatacagctattgctctatgactcaagtagttattttagtttctccagggtagggggaggggggaaggaatggaatttcagtggtccacattttaaaaatgaatacatatataaaaatataaatacactcttccccaatattttgaaatagccattcctcagctaacttttttcattcatttatgcaacaagtgtttattcagcccacactaaacgtttggctttttcctaggcactgacatacaatggtatacaagacagttatagtcactttcttatgactgaaaggtctagagagggatgcagatctgtaaacagagaattataaatttataaagaaaatttttaaaaaattataatgccatatgattcatgccatgataagggtagtgaagagaacctcagaagataggatagcagggtcctgggtaggtgaatgtcacacagtgcatcatctcatcctaattgggttggtggtggtgaaggaaaacttcctagcagcatgaatacatgaagacctgaagcatgagtggtagttagcagctgaagaggtgggaagattgaaagagaccaaagggagcatgatgccttagaatggaagtcaggcagaaaatgttaaacaatacataggtaagagcaggagggagaggcgtggcaatctggagaatccaagctgtctaaagggaaaagtagatactcatttcagccaagtattgtcaggttgggatgcaggccaagtgttgccagatgccttgatttctaaagaggagcttaaaattcatattttataaatatgaaatctcccaaatatgaactaacccaaatgttttaaaaactattctgtgggccaaaccagacaaatctgtagttggaattcaacctagggccaccactttatgacctctacatgtaagaaactgagaggagtttaatgtggctaaaggcataaaccttaaacggacaagcaagggaagcactggctttgtggaacttgctaaggaggggtggcctaattctaaggacagtgggtgacattgaagactgaaacaagatgagatttgtgttacaagatgcagtctagctactgtatagagaatgagtgggaggaggcagtggtggaagaaagataaccatttggaagcttaccgtggtcataggaagaaattaagtgtggctaaaagcaaggtattcaagcaggtgggagatgagtggatttcagagatatgtatgatacccctatgttgggattcaattctccattagtcactcagacttttgcatgtcttgtgagcaaaggcatttactgctttcatcccagactctcttaaagacatttgtatggtagatagttttggaagatagaggtattctttccctctgaagcaaagggcaggtaggttttactgtccagtttaaaagattcaagtaccctaagctcagggttcccctctgacaatgcagatcatcaagtatctgcttcacatcacatggggggaactgagtttcaggacattggcacaactatgctgatactactgctactgatatttttgtgagtagtatagtcctttgtttctcaccctagaattttctgtcttcttccagcatccccatgaaactgtggcaccctgatttcgttagcctgcaagtaggataaaaatctcagacccttaattattgatagccactagccacattgtctgtttaaatttaagtataaattaattaaaaatggaatacgattttaaaaatccattcctcagttgcagtagccacatttcaaatgcttaatagccatacaaggctagtggatactgtactgggcagagaagatatagaaaatttccatcattgcagatagttttattggacattgctggtttaaagcttcaaattttgtttgtgttggtgagtgagtagagacagtagaagttgttgatttcgacagcataaaaatgatgtttgacttcatgttagattcacaggagtccctttaatacaaagaaaatatttctgtttggataacctatacagtacttagttcaggcctcttggggaaaagaaaagtggaaaagtatctacactgtcaatttggagactgggcagactgggaccatgtagcaacagaagttctacatataaacagcgttactcaaatcatgtgtgattgtgagattaggatctgtgcccaaaggagattgaactgctgaacactgtcttgagctttgtctactaaccatgcttaacacaaaaggacaagaattgcatgttaacagtgagggtctggagcatagccagtccagcagcacctcggcagtgcctgctgcaacccagctgtgctggtgtggtctcacagaaaggatggaggacaggaacaagatttccagatggctcttgttcagggagtttaagagggtagcttcaagaaaggagggaactggactcaaaaaatataaaacataatactttaaagtacaactttaaatgacaccgcagaattaaggaaacaatcaaagcagcagatctgcttccctatcagataggagaagctcattttgtagagagtgtgggccacaagtactgggaagcaaatgcacaaagaataataggtccagccaacagttgcagtaacaaaggacggtttttacctgcattgagtgtacagttcactgctgcatgtacaacataagcaaaacaaaaacagtggtagaaataaataaaagtaaagtctgaggcccttatggaagaatcatactactacctgctttttccgtggctaaaaatgccttataaatttcatatcttgagaatttcacttatttatgccaaagtaagtttgttttaaaatagtactcatttgtagtgcagtaacattttacttatataaagattaattcaagcttttaaaagtctgaagtttagaatattttaaagatagaatttattatttttaagcacttatgttatcttttagaactcttttgaagggaacttttatgaagatattagttaattttgaatagcatgataattgttgcatgtaactggaggcttctatagtgtttaaagaaaactttttgtaggttatatgtatacctgttatttacattactaattacatcaacaaatccttattttcatagacattcctttcaaattcagtgaattctgggagagccgaggtcatatgctattagggtttgtataaaggtagagtcccttgcataaagcaggcatttgttaactagtgagatttttccccatttagtttaaaaacgttactttgttaaatgtctttttcttttaattgtgagttttgaaatcttatttttgtaggggtagaaaactctggttatctcccccaaattccccttcctcagccctgctgaatctggtaaagtcacttgttcagtgtgctttcatttttcctttctcttttatttgccacagttcttacctgtgcttcaggcttgtcttgccttgtgcctctgttctcttcatataaacagcatgaaattggaaatactcattgtctgttgtatttctgaagatcagaattttccccagtttcatgctgtcctttctcaggcagggtgtggtaagtcatcttttgagaactgtttccagtaaaactggagtatgctgttgaaactgttggtgtgccctcttcagaaacaaaaccaggagacttgctgtttattgcatgagtcactgatgggtttcaatgagtggaagcaatattagattttttttttcatgctcatcaatgctacatcttattttaaaagaagcctgaaataaggaaataaaagtaagctaataaactccttctttccctggggagaatttagaattatattggttctagtgtttggggaataaagcggtaacaatgagggttaaaaaaaaattaggccttgtcctttaacccgtgataccctgtagtgctcagagctttctggtgtgtacattttctcaagctgcacatgagtaactttaatcaggagcgaagtggttctttctattatatgccatttcctctgtggcccctgcctcacttagctattactgtatgcctaatcgaccagagtgaaatgcctttaaaacattttccagggaactaaggactttttgcagaatttttataatagaaaatgccaaggagaggaaagttttaatggtttctctgcacagataaatgtttccagagcagactgatgatgagtcaaggagctgttaataggatatgtaaatgtaacctttcacctagttactgtcactacctaagtcataactacctggtgtcagtaaattatttgaactagttcttgtctagttccctaattaaacagactctcttggtcccatgattatccagtagatagttagcactgtttcagcttgcattgtcctgggttcctccactctccttctgttttaataatagctctaagtcctattatagattttcactaatatctttgcctccagctttacctcagtattagtggaaaaattttttatctatgtatttgacagtgacctctagctcttgggtttcacttattcaacaaatattcattcagtgtcagccatgtacctagcactgttcttgaccccagagatccaataatgagcaaaaaattcctggtctgcattatcatggagtgaagagtataggaggaagacaatccctaataaaatttacacacgacagcaacaacaacaacaacaacaaataattatgtataattacaggcagaggtaaatgctctgaatagaacagtagaattttgtgggcttatataataggaacctgaggaagtgacacttgattgatatctgaagtatgagtaggagaatgtgagatagggtaggaagaaaagtgttccagaaagcagagagaactgccatttgtgcagaggccctttacagaagggaacagaatgaaatcaagtaactgaggaagatcaaggggagagaagagctactgtgaggctggaccccttggctggtggccggccagtccacaaagggtcttgctggccacatgaagaatttggttttcctcataagaacataggagagtgttttaggtcggagctggggacttgatgtgatttgtgttttggtaagatcatctgtgggggcgtgagttggattggggtgtgcatgtcagtggggtgaaattgggtagctcttgcattaatttaatttgacatgacagtgtgtaccagtctggtggtggatactgggaagtggcagtgaagatagatcgaaagtgttttggggggaataccattaattgaactcgggaataagttggggttttcttttatttattcaaaaaatatttagcgactccctactttatgctactctctgtgccaggctctaggaataaaactctgaacagtacataaaatgtccttggactcatggagcttacttattaatgggagtgacagataatcattaagtgtaacatatatattaaaaacatatatataataaatatatatataatttcaggtactaataagtcctgtaaagaaaaattaggcaaataagggaatggagaatgatagcagagggtcctcttacacaggatggtcaacaaaaacctcttgaagaggtagcatttgagcaaaaacccagatgaagtcggggaactaactgtgcaaagattctctacgaagcagcggtaacaggtataagatattgaggctggaacaaaggaactctgcctctatacctccaccaccaaggaataccaagaaggccagtatgtccagaaatacggggcgtgagggaagaaaagtgttaagaatgtcttgctggtagctaaaacttaaagcatctatatggggtcattatcttcagtcctgatcagtttttcaaagtcccttactatatcaactacaatcccaggttgctccgccactaaactgattttaacacagctactagaacagcttcctttaccacaacagcaaaccgtgctcaaaaactgtcagtggtaactgcttgtctgtcttgtcaatgacaatcccttcatcagcccagctaaaagtccccaatcttacttcaaccccacatgctgttgcaaccctttctgtacttcttattcagttgaaggcttccctttaatgtttgtttaggctttccacataatttattcttttcttttttggcattgtttttattcatcatgaagcctcttttctttctattggcctatttccatcacttccttcaagagttattttttccaccagtttcttctgatttattccagcttacctggatcacagaacccctcagcctactcagtctatgtgatgttatttttgtccttccttgagtcacttgaagaagctctacttttaaagtgccaccattgttccaagttaaaatattcatgattgtattcatttttcctagaaaagatttggcaccagtagttgccctgccatgtatatatgtgacattggccaaaacagtcaacgttcaggtttcttgtcaataagatgaagataccaagcctcccttctttcattcagtgtagttgtgaagaaaaagtgaaataaaacatgtacaaagtgttttaagcaaatgtacgacattatttttaatattttaggtgggtgtagtccatatcctcatctaaattgcaggttcttcacaccatttcacatagtgtagagtcatgtaagtgtgtgctgcaggaactctgtgagggttcttaagcttccagccacaccatgcaagcttgggccgacttcatctacaacctgcatattagtttcctggggctgctgtaacaaagtaccacaaaccgggtggcttaaaccacagaaatgtattgtctcagagttctaaggctaaaagtccaacatcagtatattggcagggttggttctttcagaaggctgtgagagagaacctgttctgatagcctcagatgttccttggcctatacatggttccttgtgtcttcacatcatctttcctgtcttcctctttgtgtgtctgtctctgtgtccaagtttcccctttttataaggacacagtaatattggattatggtctaccctaatgacctcatcttaactagatcatctgcaaagaccctatttccaattcgtcacattcacaggtactggaagttaagaattgaacatcttttttttttatggggacacaactcaacccatatcggcatgatacaatacacatacaagaaagggtaatcacaaatgtggtgaattagttctgtgttactaaatggtaaattagatgtagagctagtttcccatatgatacaaggcagcagcccctaacctttttggcaccaggaccggtttcatggaagacagtttttccatggactggggtggaggaaggttttggggtgattcaagtgcattacatttattatgcactttattgctattattattccattgtaatatataatgaaataattatacaactcaccataatgtagaatcagtgggaaccctagcttgctttcctgcatcttgactgtcccatctgggggtgatgggagacagtgacacatcatcaggcattagattctcataaggagcttgcaacctagatccctctcatgtgcagttgacgttaggattcctgctcctatgagactctaatgccgcagctgatctgacaggaggtggagctcaggtgataatgtgagcgatggggagtggctgtaaatacagatgaagcttggcttgcttgcccactgctcacctctttgctgtgcaaccctgtttccaacagaccaaggccagtatcagtttgtggccagggggctggggacacctgatataaggaaaaataaatgaaatacttgataaaagttgcatgtgaaattctgaacattcacataacttattttagaattcaacaattcctgttaattttaacttggtctaaattagagtacagcaggccagccaagagaaggagcaaaagtactcattaatttttcctccaaattttaatagtacattcagtttttatactgacattagtgaaaaaatatgcaattcatatatttattcgtataatttttatgtggactttttgtgtgatttattttattgcttcagttgtggatttttttttttttttttttttttttttttttgccatcatgctcccctttgactttctgttctttctttcttcttttcttttctttgtctgtaaaatctagttcctgcagaccctttgactttctggaaggccacatgtggtttcatgaaacagattgacctccctctgttaaacaaccagaagggtttatggtttttatcttattaaatgccctagcctttggttataaaaatttacttttctcttagaattaaaactttctttaatattatatacattttttctcatcagttttcattttgtttttattttgcattgctgttttttgatagtgcagaaaagagttggacacattttgaacggttgatgttggagaatatataagtgcaccttttgtggcgttttatccagatttggcattaagatgtcccattttatcagatgagcatgctttaatcttcatctggcctcttattctggtgttaggacagcctttgcttgatgttgaggaaggtatctgactctgctgttttgcttccttatgtacctggcttgccagtttaaaagtttcaccattttaagtttcctaacagagtggcacatagagcatatttaagaagcctattgtaggaattcacccagatttagtgaatagaaattgaatacttgacctttatctagaaaagttgctgttttgttgtcaaccagaagaactttcttagtacagcccctatattccaaatagctagattcttaattgctgtactttcattaaattgcttcattattattgctgcatcaagattttcactaaacgaaaaacagccatagattgtttatttctgcttattgttttttgtagaaaaaattaaggaagaagacatattagatttcactgctgttgtagaaataaatttcctcttggtgtactctcaagtagatgttggaaaatgaggctcacagaggttaaagtagttggcccaaggtcatataggttgtaagtgctgggaccaggatttgaatccacagactctggcttggggacctgtgtcactctggcaagcttgtcgtgtgggaattaataagctcatcgatgtaatgcacttagagtggagaccagtgcacagcaagcactcagtctactactgtgatgacagtgacaaagaatactgctagttctataattactataatggtgttaactactgttattaccattaacattttccactctgattcatacctaaccatgtcttttaaaaatttttctaaatttttttaatttttaatttttgtggataactagtaggtatatatatttatggggcatatgagatattttgatacaggcataccatatgtaatcatcacatcagagtaaaatgggtatccattacctcacacattttttgtgtgttacgacctaattgtacatttttagttattttaaaatgtataattatattctcattgactacagtcaccttgttgtgctatcacgtactagatcttacttatcctttccattttttatgcccattaaccatcccaactccccctctaacctctccacttcccggtctctggtaaccgtcattctactatctccatgagttcaattgtttgtatttttagttctcacaaataagtgagaacatgcaaagtttgtctttctgtgcctggcttatttcactgaacataatgacctacaattacatccatgttgttgcaaatgagagaatctcattctcttttatggctaaatagtactccattctgtatatgtaacacattttctctgtccattgatctgttgatggatacttaggttgtttccaaatcttggccattgtgaacagtaaatatcagagtgcagatatctcttcaatatgctgatttcatttcttttgggtatatacctagcagtgggacatatataccccaaagaaaggacattactgaatcttatggtagctctagtttttttgaggaacctccaaacttctccatagtggttgaactaatttatattcccaccaacagtgttcaaaggttccctttgttccacatcctcaccagcgtttgttactacatgtcttttggataaaagccattttaactggggtgagatgacatctcattgtagtttttatttgcatttctctgatgataaatgatgttgagcgccttttcatatacctatttgtcatttgtatgtcttttttgagaaatgtctattcagatcttttgcccattttttaactggattatcagatttttttttccagcagagttgttggagctccttatgtattctggttactaatcctttgtcagatggatagtgtgcaaatattttctcccgttctgcagattgtctcttcactttgttgattgtttcctttgctgtgcagaagctttttgacttgatgtggtcctatttgtccattcttgctttggtggcctgtgcttatggggtattactcaagaaatctttgcccatacccatgtcctggagtgttttcccaatgttttcttgtagaagtttcatagtttgaggtcttagatttaagtctttaatccattttgatttgatttttgtatatggtaagagatacgggtctagtttcattcttttccatatgagtatccagttttcccagcaccatttattaaagagactgtcctttccccaatgtttgttctgggcaactttgttgaaaatgagttcatttagatgcttgaatcactttttgggttctctgttctgttccctctgtctatgtgtctgtgtttatgccagtaccatgctgctttggttattagagctgtgtggtataatttgaagtcagttaatgtgattcctctggttttgttctttttgctcaggatagctttggctattctgggtcttttgtgaatacatataaatcttaggattttttttctcacttctatggagaatttcactggtattttgatagggattgcattgaatctgtagattgctttgggtagtatggacattttaccgatattgattcttccaatccatgatcataggatatctttccgttttgtgtatgtgtctgtcctcttcaatttctttcatcaatattttatagttttcattatagagatcttttacatctttgattaattcataggtagtgaattttatttgtggcttttttaataggattttaaaaaatttcttcttcagattgtttggctgttggtatatagaaatgctactgatttttgtatgttggtcttttgtatattgatttgtattctgcaactttactgaatttgtttattagatctattagttttttggtggagtctttaggtttttccaagtataaggtcatatcatctgcaaacaaggataatttgacttctttcttttcaatttggatgccctttatttctgcctcttgtctgattgttctagttaggacttccagtactgcgttgaataacaatagtgacagtgggcctccttgtcataaagatcttagaggaaaggctttcagttttttcccatccagtaagatactagctgtgggtctgtcacatatggcttttattatgttgaagtgtgttccttctagacccagttttctgtgagtttttatcatgaaagtacattgaattttatcatatgcttttccagcatcaatcatgatgatcatatggtttttgtccttcattctgttaagatgatatatcacattgattgatttgtgtatgttaaatcttctgtgcatccctggaataaatcccacttggtcatgatgaatgatctttatttgctattattttgttgaggatttttgtatcaatgttcatcagggatattggcctatagttttctttttttaatgtatctttgtctgtttgtggtatcagggtaatattggcatcacagaatgagtttggaactgtgttttaataatagttaataatttcccccaaatactctctgtagtccatgaaaaatagctttgattgtgtctctaggtttttcgtttgtttgttttaaggtgataagagctgtattgatccctgaaggggtttatatttgtttttaaacctgctgttacagcatgttatataatattttgtacagtggcaccatttgaagattgcggctatgtagagaaaacaaaaaagccagttttcgttaagcattttgggagttataaactcctattggccattttagattctcttcagaaaagttgagagaggtcagtactgtaaatttaaaacctttatttttcattacaatatatacttgattccagggcatggagtttaggggtggttgggaactatgtcacctaataacctctttggtttccattgctaaacattctatagttctgttatagtaatcattttggttgtcttttcaaagtgaaaacaaacccatttgccaagtgggaatgaaattgaagtttattgttagtgctgcattctaaacaggggaaacatagaagataggaagaaagtagtcttagttttgaaagcacagccctcctggtattcaagctaccaactttgcaatgtttaccaagcagtttttcatctgtacaacaaccttggtgaagatgtgtctggcttcttctcctaaatactttgtcttcatgtctggtggcttggtctagcattttcaactacaggatcacaaaggaaggaaactggaggagtgacctttcaaattcttgagaggaggaaatggatgtttacactgttgttggctagaattttgaagcctttcaaaaataaagttgctctgtatgccccagattttatagagagaagtccagtgccaagttgaaaataatgttttgtaatggtttgtcaccccagtggcttggatccccctgccacctacctgcccctagaggggctgtgatatgctagaagggctgtggctgggtttaaaagaagaaatgtttatgttttcttgtcctagtaaactatagacatcagaatcataataattgttcccatttgttgaggtcattttgtagagtggagaagaaaaccagcttccttctggcattagacatttgggtcaagtcttaactctgcctcttactataatagctgcgtgaccttgggcaaattactgaaaaacgctctgagtgcctcagctttatcctttttgaaacagggatgtattggtgtcacttcatacagtgtggtggttgtaattattctttgagattaatgcacataaaatgcatagaaaatgcttggcacagggttaactgcttaataaatgttggatatcattattattgtatgttgtaaaccttacctagagtacctctaatgttttctataaccctgcagtgtaaaccttcatccctattttacagaggagaaaattgaggcttataaaggtaattgttttgttttgcatgtgagggtgtttgaaaatggcctgttttgtgctgtcttcctcatcctgattcttgccctctgtggttctctaccaacaccaagcttgtgaaatagagcaaaaggggattgcattttgtgttttctcaaacttatgtgctaggatgcttgtgcaattcaagagatatgcacatggttctcaaataagtaaactatacaggcccctttcaaaggaaaataccctcacttccagtttgacttaattatacttgtcgtagtattacttaaatatattcaaagttggagtaatgtcttagtttatagcacttatacagctataaaataaaacacatttacaaattaaatgccaacaaaactataacacaaatacaatttgagaaattacattaatttatgtgacggatgttgatgttttgctgaaagtaaacttcaattttgggttcatctatagttaggatggattttatgttcaaactgtgtctaccttttaatttcatgattttaatgtatcacagattttcaaatatctggagtttcatatgattcaacctatcaaaacaatgtattttgaaataatatgtcatataccttggtggtaataatatcaaggttttggcagttcagagcaataggacttcaggaatgccaattttaatgggtgttacttgacaaacttggaaaactattttacttccttgggagtcaagacattggctcaatatttaagtgcagatctcatgctagacccagccctgagcttaggaggcctagagtcagacttcctgggttcacagttgctacactgtttttacatacaaattcctatgaaatttacattttgttgtaataaactaaaagtactgggtccataagtatgaagatatatagttgttgctttgtattgtatttgattgctatttacagtgcagtgacaacgtagaggagttcacagtttaccatatgctgtattaggagttagcatacttttcctgtaaaggaccaggtggtaaatattttaggctttgtaggccacatgtgatctctgttgcaactactcaactcttttcttatagcacaaaagcaacaatagacaatacataaaattttatttagggacattgaaattaaattttatatgatttttatgtgtcacaaagtattgctctgtttaaaatttgttttcaacaattaaaaaatgtaaaaaaacattcattctcagcttgcaggcagtgcagaaacagtgagcagggcatttggcttgtgggcctagttatggaggccagccctagacaacatttaatacagtaaaaaggtttctcctttttatttttaattcattagttaattaacttatttactttttattaacttttattttaggttctgggggtacatgtgaaggtgtgttacataggtaaactcgtgtcacagaggtttgttgtacagactttttgtcacccaggtattaagcccagtacataatagttatcttttctcttcctctccctccccactcaagtagaccccagtatctgttgtttcattcttcatgttcatagttcttatcatttagcccccacttataagtgagaacataaggtatttggttttctgttcctgcattagtttggtaaggttaaaacctccagctccacccatgttcctacaaaagacatgatctcattcttttttgtggctacatagtattccatggtgtatcccaccacattttctttatccagtctgattgatgaacagttaggttgattccatttgtttgctattgtgaatagcgctgcagtgaacgttgatgtgcatgtgtctttatgatagaatgatttatattcgtctgagtatatacccagtaactggattgctggatcaaatggtagttctgcttttagctcattgaggaattgccatactgcttctgatttccacaatggttgaactaatttacactcccaccaaaagtgtgtaaatgttccctcatttttatttatggcagcagtatagtgtggggattaagagagccactccaaagtgagactaccttgccttcgaatgtgacctttctgtgtcagttttttcatatggaaaatagcagaaaattttctttctacctaaaacacttgtgggaggatggaattagaaagcagatagaaagcagacatacaacagtaaaagccatgtatgatacagggtaagaagtctgtacataagtattgctatttctttaattactattgagatggtacagtttttcaggtgcttattgaacatcttaatttttttattcttttgtgacttctgtattcatatgtgttatttgttctttacgtattgatacatgcgaactatttataaaggttatcaacccattgtcagatattttgcaattcattttgtctctttgttggccttttggttttataaatggtggattattttttaacatacttaatgttttaatttttgtgtaagtcagttattaaagataattatttcagttagtgaagataaattcaatgtcttctcttttttatttctttcatttccctctattgtttttatttttataaaaatattcttgctgtgaggtcagataatagttacctatagttttattctagttgtattgtaatttcacattttatgcttaactacttagttctggaatttaattttatatatgttatgatatattatctatgtattttttccatggattttacaaattgattcaacatcattaattgaataattattccttccctattgatttaaaataccacttttattgtactttagataatttggttaaatggaatatggcctaaaaaattttttttaaagcaaggttgtcaatatgacactattctttggtctgcagtgttggtactttggtgtaatatgaagaattttgtgttactttaagaatttttgtctatttttagaactttatttttttaatttaatttaattttaagttctgggatacatgtgcaggacgtgcaggtttgttacataggtaaacgtgtgccatgatggtttgcttcacctatcaacccatcacctaggtattaagccccacatgcattagctatttatcctgatgctctccctccccaccacaccccgaaaggccccagtgtgtgttattcccctccctgtgtccatgcattctcattgttcagcttctacttatgagtgagaacatgtggtgtttgtttttctgttcctgtgctatttgctgaggataatggcttccagctccatccatgtccctgcaaaggacatgatctcattcctttttatggctgcatgatagttcatggtgtatatgcaccacattttctttattcagtgtatcattgatgggcatttgggttgattccatgtctttgctattgtgaatagtgctgcaataaacatatgtgttcatgtatctttataatagaatgatttttattcctttgggtatatacccagtaatgggattgctgggacaaatggcatttctggtaatacatccttgaggaattgccaaactgtcttccacaatggttgaactaatttacattcccactaacagtgtaaaaacattcctatttctccacagctttgccagcatctgtggtttcttgactttttaataatcaccattctgactggcatgagatggtatctcattgtggttttgatttgcatttctctaatgatcagtgatgttgagctttttttcatatgtttgttggccacataaatctccttttcagaagtgtctgttcaagtcttgtgcccactttttgatggggttgtttttttcttgtaaatttctttaagttccttgtagattctgggtatcaagtctttgtcaagtggatagattggaaagcttttctctcattccgtaggttatcttttcactcttgggatagtttcttttgctttgcagaagctctttagtttaattaggttgcatttgtcaatttttgcttttgttgcaattgcttttgatgtttttgtcatgaaatcttttcccatgcctatgttctaaatggtattgcctagattttcttctagcgtttttatagttttgggttttacattgaagtctttaatccatcttgagttaatttttatataaggtgtgaggaaggggtccagtttcaattttctgcatatggctagctagttttcccagaaccatttattaaatagggaacactttccccattgttgtttttgtcaggtttgtctatttttagaactttaaaaaattgtggtaaagaaacagataaaatttactctcttaaccatttttaaatgtacaggtcagtagtattaagtttcttcacattgttctgcagaagatctctggaaccctttttatagtactacaatactggccaacaatatgtatttcacattgttatgtaactataactgcatttatagttctcagaaaaattttgttttccttttgtatgtcacacatttcttatcagggttactttttcatatttagtggtgtttttggggttttgtttttaaattttgtaaatgggtgcttcttcccccctgcttccttgtattttctgatttgtttttgcaagtatgcagaaaagttttttattctaattgttttataatttcacctttttattcttaactacttaatactggaattcagggatatttgtattgtagggcagttttctaaacatgggactttatcttacttgaaatggatctttttcaaaatcaccatgtagcaataaaaatgggtaatataaatatggaaaaagtgaagcaacattatgaatggatataatctagagagaaaggggagtttttttaggaactgaagactgttcaaatctcattgttactcattgagatctgccttgactatgctgtttaaaattgcaaacattcacttctactacttgattgttttgccctgctctcctttttccccataaaccttgttattatctaacatataatttactcccccagccctattatctgttcccactagaattgaagctccttaggttgggattttcacaacagtttcctgggacataccaggtgctctataaatattagttaaatgaataaaatttctagtaaaatcaagtatttaagtgggagtttctggaaaaaaaagacctaattgtctgagagagggattctactagagaatttaaaaattagcccaaacgaggccctttcttcccagaaggaatctgtaggtaaaattcacgataagaaaacagcccttcagctaagaggtaagtgatttatacttgaatatgtgaggaacatggaatgtcaccattcattcccgggcctgttttcctctgtagaggtattttatttccccccagaaatagacagcatattggcttaagccctttttaattttccctacaaagcagaggtcatttaagctattgttttctgtttttacggattataaaaagagagaaagttggtttgctagattagcgattaacatggggtggttctatgtatttttcttctgtgatgctgtaaatgaaaggtcacctgccaaatttcggtttgcccttgagagacctgcgatcattccttctgcaggcggaattgtggaaaacacctgaatggcattgtgccgtcttggggttagcctgctagagatcaagtaagcacctcttggacccctgttagacagaaaaaaaattaaaggagaaagcctgcaccatagagaattaaaaaggaggcgggtgagttgcctttctcctctcacctccccacatgtatttttttgaagagttgatttgtgttcccctgtaatacttgcatttgcacttctgcatggtccttgattttgccctatacttgtatttatatgtttatattcgttctatcttccccataagatggtaacattgtcaaaggcaaacagtttgtctttactttaaaattgcccagagcattctatatagtattttagacaaggagcattcaattaatgtttacctgacaagtaaacaagaggaaaaattaaggtttcaggaaggagactgtaacattaccaaaaatcatattaaggattcagaataatcaaaactggcatttggtctccctggcatttagaatgaaataaaaactagaccccatatgatggataaaatgaatcatgggactgctcaagtagattattattattgttttccttccaaagcctggtctgtggcattttgttccagaggaaacttgagagctgtggtgattaaatcttaccaaattagaaacctctgaaatgagtcatttttattttcattcacttcatttttacatggaagattgcatagacaagcaaccaaatgaacgaagcttagttttctggtgggttggtgatgacagttttctcagtttgtagttgtcgtggttcccatggtaatattttatatgtagatgctatacaggtcaggtttacccgtttgtgtttttggagggaatactttgtgtgcatttgaatcaggcagtccttaattctcagagatctactaatagtatgaatataagatcagaatagaatagaattatctgttgtggaaaactccttggatttgccgtcagaaaacctgatgggcttctctctgtgcctctaacttgtcttctgcaaagtgaaggaattgagtgaggtactttataatacaaagattctcaaccctattggatccagtgtctcctttttcatagcatatgttttgcagtgccctctttattaccaagaaatgaaatttatgtgtaatataacctgcctaagtgtgtaattcaaaaatatgcatatatatgtgtgtgtatatatatgtgtatatatatatatgtatatatataattcctaactttaatataaaagagcaatacaggaataagtaatttataataagataatgtgtatttcattcaatatgtaaatgtttagttatgattacaccataagacctaatgaagtgttcaaaagcttgatcctatatgtagaataacagtatgtgtgacagctacaaatgcagattgatgtctttgttatattgaccactcagataaagtattcccccccttatctgtggtttcatttactgtgatggttaatacgtgtgtcaacctgattgaactgaaggatgcaaagtattgttcctgtgagggtgttgccaaaggagattaacatttgagtcagtgggctggggaaggcagacccacccttaatctggtgggcacaatctaatcagcggccagtgaatataaagcaggcagaaaaatgtgaagaggtgagactggcctaacctcccagcctacatttttctcccatgctggatgctggatgtttcctgccctcaaacatcagactccaagttcttcagttttgagacttggactggctctcaatgctcctcgcctgcagacggcctattgtgggaccttgtgatcatgtaagttaatacttaataaactcccatatacatatatatatatatatatatatatatatatatacacacatatatatatgtatatatctcctaatagttctgaccctccagggaatcctaatatagttacccttggtcaactatggtccaaaaatttggagagttccagaaacaaataatttataagtttttaattgtacaccattctgaatagcatgatgaaaacgtgtgccccctgctccatccaacccaggatgtgaattatttctttgtccactgtatccacattacatatgctacccacctcacctgttagccatctgggttatcaaattttaaaagaacatagcatatataggattcagcactatccacagttttaagcatttactgggagtgttggaagatatgccccgaggatcagggaagactactgtaccaccattggcattgttgttggtgatgtgatttttccaaaatgatgagcaattcttggcaaaatttcaaataaaactaaatattgtctttcttgattcatgtagtaacttcatttctaaacataaggggttttaaaccatgtaaaaaatacttgtgtttttatgtaaaatggatttgggtcgtaagcttagctcatcataaagacatttattacctatgtgatttgtaggacatttgagagttaagtaggatgtggtgccgtacttcattaaaaaaaggtcgtgcacattgcatggtgtacctcccgactgaactcctgcctactcttgctggcagctctccccacaccagccctgacaaccagatttctgaatctcacactagggggcagtactgcatcccatgaaaaatcattgctctaaggcaggtttcttaacctcagcacctttttctttctttctctttctttctttctttctttctttctttctttctttctttctttctttctttctttctttctttctttctttctttctttctctgtctttctctctctctctctctttctttctttctcctttcatattttgggtcaggtaattctttgttgtgggggctgtcctgtgcattggaggctgtttagcagcatctctggcttctaccccctggatgtcagtgtactcctcaagttgtgataaccaaaaatgactccagatgttgccaaatgtctcctggagggtaaagttgccccaggtttaaaagcactactctgagatctctatcagctccaaaaatctgtcatgagaatgatacagtattgattaatatgcaaacattgcatacaatacttgtagatattgctaacatttttgggccaggtgaagccagtaagaaaagcttttaataattactcatttttttgggtcatttaacactgggattatattattgcctggctttagaagggttgaaattatgtacagtatagggtgataaattttgtagtatgagagcataggagaactagaatttcaagaaagactattccaagaaggtcctttggcaagtaagagttcattgaattcctttctgacaagtttgacattcatgttaaaggttacaaaatcagaattttagttttgtaagaagtaatagaaattcagtgggtaccttctcattttacaagtgagtaaaaacctaaatgctaaagtgcagttcacagtttagttgtgaatcaggactttaatgcatggctttggtgtcccctgtgctgttccttttaccacattgcagtgctgctcagccaggctatatttataaaatatttttagctttctgcaagctctaagtcttgataggaaataaaagacaaaataacatttttctttaaaaccttgatctttagaatgcatgccaggaaaaataagtgagaaggtcagttattatatacagggacttgcattcatagattaagcccagaaatatttttaatactaatgtaataacaacaatttacatggtgcttcttgtggattagccgtgctcttctaagaactacacgtttttaatgcttataacaaccctatgaaaacagatactgttataatcatctcccttatgtaaatgaggcatcaggaacttaaaaaagcttgcccaaggtcgtaagggtaagtggctggtctgcgatctgaaaacagccagtctgcagtccacatccgtgttcttgtccactacttactccagccttaaactttgaactgaataaggatggattggttttgtatccttgctcatgaaatggatattcctaggagctcaacatttggagaatttcaaacctgaacactttagaacacattatgttttcttcaaagagtaaatcatacctcacacttctccaacatttacaccaaaggtgaatttgctctttataggatataagagcttctttcatcttgtccatatctgaagcacttaaagcagaactctggtatgaagttcatagccggaacgaatccagatctaaattgaaaggattatacaaagtcatcttccttgtttgtttcaccctttgttttccccccagaggaaggagagaagattttgaaatcctttattgcaaaatgagtttgaaatagatacaaataataaatatgattgacagctatagaggagaaggaaaaaacttggctcttgttttagaaagatacttgaaaggaaaacatctatgtttattgagaagtgagaagtacatgcaaatctttcaaacataatatttgaaagtgaaaatcacgtcataggatttagagatattcccaaagtcaatatttggttcttaagttccaggtagtggaaaagtcagaatcagttaagtacccagagcacttgctcccttcctttctccatttctctctctctctctctctctctgtgtgtgtgtgtgtgtgtgtgtgtgtgtgtgtgtaattttatttattactggtgaaactggtacaggcaacatgttggcttttttgtcaatcagtttttttttttgagaaattttgcttttgtgaaaaatctgccttttcaaagttttctttccttctattatactccccatatttttggtgtatctgagatgctaatggcctttcattttcaagtttttatttcccagttggcagtaccacttttacactttgaagatggaaacttggcaggaaaattgtatgtcagggtgtatttctgtgtggggttgcaagggcaggaaagaaaaaaaactcaaataagaggtattttcattgagtatgatcttagctggtggcatatataattacccagttatttctctcatgaaatgaatgtttatatttgttgtcatgaccaggatcagctacacagtttgtggggcccagttcaaaatgaaaatgtgggtgtattaccagatttagcaaaaaaaaaaaaaaaatagagatgcccagttaaatttgaatttcaaataaacaataaataattttgattatgtccagaatatcctgggacaaatatgattcagttttctatcaccataaattagtttaaatgaccattgcttagatctgtcttcaatttcagtgaaagcaaaggttaaaactcatctgagttgcaatagaaggtgttgcctagaatcattgattttttcaataccaacaccagtatttggaatcatccctttatttggtccccactgaagttttcccaccgtaagacaaggttcatagtaaaactaagcctgaaggcctgggtgggagaaaataatttgcagattccaaattcagtctcagtacaattttaggaacgaatatatatgaagaccaaagatctagaaattaattctctttaaactacctctgtgccagtttgcatactggaatgtctttgagtatcccttgggatgtgcatgcagcagtatgagggccacttaactagaatggaaaaggggaagatgaatagaacccagcgcctgccgtcagggagcataccagctggagggtgacagcctcaggaagacctaattgtagaacacttgaatggtttccctctcctcttggatcaagttcaaaattcttcatgatctacccccatctttttttttttgaggtggagtctcgctctgtcacccaggctggagtgcagtggcgcaatctcggctcactgcaagctccgcctccagggttcacgccattctgcctcagcctcccaagtagctgggactaaaggcgcccgccaccacgcccagctaatattttgcatttttagtagagatggggtttcaccgtgttagccagtatgttctcgatctcctgaccttgtgatccgcccgcctcagactcccaaagtgctgggattacaggcgtgagccaccgcgcccggctgatctacccccatctttctctctgttcttacctggtgctcctcttctccctgtgtaacctctaagctccaatcataccagcctttctgtccctagcacacctaagctgctcctgcctatgtgctattgggtcaagctgttttggtgggctagaatgcgcttttcagtttccccccttgcacccacacaccttagatttcaggtttccttggcaccgtaagcttggaaaaatttaggtatcactgttgtaagctctcatatgaccctgtcctcctccttgtacagtacttattacaaaagtcactaacgtttggtattcattaccttaaactctgattacttttgtgctgttcactttctgaggacaggtaccatctctgtcttatctaaccagatattcccagcagagaatgtagcctcttccatattaagggtgagtcatacatatatgtagaattgaattaaaaatatactcaacgtatttgttgaattgaattgatgttaacatttatgtgaaacatgactttgtgtcagtcactggcgggcatttactatatattatctcatttaattcacacaaaatcatttgggaatacatgcttttagataggcaaactttattattgttgttattcgtttactaggaatttttaggcaaagcaagtgcataaacaccaggtgagtggtcttaaatgccatgttaaggatttggaactttttactaaacaccagtgattctccatactttaggaaatcagaatcacctggaggattaaaaacaacaaaaaagcaatgcccgcatataattggtttaggattcagcaagtcattttataaaacttccccaaatagacttttttgttgttgttctttgtttttttatactttaagttctgggattcatgtgcagaacatgcaggtttgttacataggtatcccaagtagttttaatgcacagcactgattgggacactaaaaagtagtgatgctagcccagcagcattaacaccacctgtgaactagtaagaaatgcagatatctgggccccttcccagtttcacttaataagaaaagggaggggggagtccccagcaatctgtatcttagcaagcctttcaaatgaatctcatgccctttaaagtttgagaacctctgttataaacaattggaaacttaaaaagctttgtacttttgtgttttacaaaagaactttggtagatacgtgggagactgaataaataagggacaaaccagagggtaaggcaacctgttagagctgttacctttagaagtatcatgtggaggtaagaagatggcaataagaactagagtggtggttataggaaggaaggaaggtggtgggatcaggagatgtttcaaaaacagaaatggtgaaatatggtgactgattggcttgaagaggttgagggagagagtgaggtcaaagaaaatataatttctttctgagttagttaagtgacatcatgaaacaaggcagaaatgtgtttagaaagtgtaagttgggggaaaccataaaagtattgaatataaggtgtcttcaagcatctagtaagagatgtttttgtctcgttggaaatttggtttctggaactttggaaacaaatggggagtaaggagtggtgttggaagttctcaccattgtatttaactttttaaaaatcattcattcaagtggttatatatgtactaaattatttttttaacatgttcgttttatttcaaattgagccaaagatgttgaactttacacaaactataatctcttacattggatcatttatatgaagttatttttaataattattagaatttatggaatatgttagcagaattatggtaaagcaaagtttgcattttgtaaatttactgttccattcttgggtcaagtgtacagtgaacacattcattttcagagaaagaactgagaggacacaagcaagaatacatttcacatttcagctgttaaaggaggcaattttgtgtcatgtaagctcacagatcctggagccagactgagctctgtccacatgtagaaggtgtgactttgaacagacgttacttaaactctgagcgtcttcatttcctaatatgcaaaatggagaaattagtattattcatctcaggctttttgtaagcattgaatgagttaaaacctgtaaaagtactttgaatagcgcctagaatttaattcgtaatcattagtgtaagctcttattaatatcaattttttattctctacttagtcttattttctaaatcgttgctattaacagtttctgagttttttaatgtggtttctgttagttttatgaactgctgaacatcaaagggaatgattataaactagtgatttctaggaattaaattttgaaccattcatggagaaaatggagaaaggcatcacaaatgtagtataatttctaaataaatagcaactaaaaattactttccaagttagacacatgccattttttaggtcaaagttgcgggtcagaaaggtactgggctccagattcttcacagcttgaaatcttacttcattcatcattctgagcatagtcagtagcaaatcaataatttacttgaaaagaaacaagtaacttactactcttttgatatgtggtatagaggtcaagaatatatcttaaaaactctatatcaaaagttataaataagataactaccaagcaaaggctgattataattaataataataatgataaatcccagcagatatatttgacccctgtaatgagaagaaggtaacacctctggaagcagaaaaaaatcttactctcccatctgagatttgtaaattaaggctgttcattactgctgttgaattataatgatctgaatttcacttaaaatctcttaatttagaaatcattatgctggtggaaaggccaaggagaaatgcttcatccttagcattttatttatcctcctcaaaatagttttaccatccttatttttcaatctatttcaagtggggttgggagctggcagaagaagaatagatgtagttcttggtatttgcatctctaggtcccgccagacccacacagctcttctgacttgagcatgttccagccatgttctaaatgtagctaccattatcccgtgctgtctagagttcttatgttctgggacctgagacatattttctgtacctttcactaagcacaggaaatctatcccaactatggggacagatctgtcccaactgtggggacaaaactgcctcctttaacagctaaaatgtgaatgtaaatttttctatacctttcactaagcccaggaaatctgtgcccaattatggggacagatttcctgggcttagtgaaaggtacagaaaataggctactgtatggtctaaatgcctaaactcagcttgaacaagaccccagtcagcttcactcctggaagaaaactattgtgcagctcttagcaaggaaatttgtatttgatacttcctaggggacccgtagttccttcagagttacgaatcccttggtgagtgaatggaaaatccaaccaattatagagcatttcagagaaaaaaatgttggctattctcaggaaatgttgggtatttccagtattcatatctcccatctatggaactggagttctctaagccattatagtgagtctctggcttgggatttattaaattattcatgtatggtagatatttccaggttgctgctatcattattggcaaatttggcaaaatagatcaatttgcttttgatttaagaactaaaatagtatcatatctgtgaaaaatcctttgctattcctcaccgtaaaaatacttgaggaaagtcctatttcagttcacttgcactcacacagctccaatttacttcagtacaacttactggaatctagtaacagaaatcatcatatatttgatacctgggatgagaaatgagcagatctgaagtaattttcttttataatttaaccacagcctgctttgaattgttaacaaggtgtgataatttatatatttaaaataaacatttatgataagaaactgcccacatactttatttgaagggtaattacccttcatatactccataattcaccagctttgatgaaggtggcagtgagttattacggtctttactttgtcagaaagactttaatagctttgtcatgccactggtgtcataaagttatggaatgtatgcaagacataataactctatttatttttgatagaaactacgtttctctcctcagctggtcagtaattcacatttaagaattttaaaatggttgctttgtatctctagattatatttccactcacaatagagatgaaatgccttacctatttttatataattttaaaaagcacaaaggatcctcacaaattaatttttgttaagtatagtggaatccttttttgacaccactgagtaacagatcataacatctgtattatgggccagtggtgttacatctgatttttgatgatatgaagttaaatattatgctggaggagggtcatacttttacctgagacatattgctttgttcttattccatttggctggaattcttcctattaagtaactactattttaataacaaagttgtgagtgttgtggtggcattattaaaatacatatgtgtcatctgaaagtggagataaaatgtgttcattgtcaggggaacatgtcagatgcagtgacagaaatttggtggctcagtgctctgttggttgacactaacggtcagaggctaggtgtgaagaaactggaagagtatttatggatgacattaccaaagagagatggactttgatagagaaaagttagctaatactggcattattgggagttataccttacgtcataggtataaacagtacttttgttttttaatttgggttttaaaagcatgtggtgaaagataatgaaatagatccttggctgttaaaaattcagtatagagactgaatttgaggataattgattttttaaaaatcagaagacatgtttactggaagttggaattttaaaagcaaaacttatctagcaatttgatttctggatatgtacccaaaagaattgaatgcagagactcgaatagacatttgtatgccagtgtttattgtagcattattcgtaatagccaaaaggtggaaacaacctaagtggttgtcagcagatgaatggataaacaaaatgtggaatatgcatatgatgtaatatcattcagcattaaaaaggaatgaaattctgacacgtgctacaacatggctgatccttgaagacattacgctaggtgaaataagcgagacacaaaaggacaaatgtggtatgatttcacttacttgaagtacctagagtagtcagattcaagacagaagatagaatgctagttgctcggggctgggaggaagagagaatgtggagttactatttaataggtacagagtttcagtttgggaagataaacaagttcttggagatggatggtggtaatggttgtgcaacagtgtgactgtaattaatgggactgaactgtatacctaaaaatggttaaagtggctaattctatgttatgtatactttgccacaataaaatagcaaaacttactaaaatggcattataaagtaataaaatgcttccagtcctttagaaaagaaactaacaagacaaatgtaagggttagctaattattcatattcataaatattcagtagttatcattagactaaatttgggaaaaatacaattttcttatcttgtatgtgatctggggaatgatttgcccatatttaaaaaatattttatttcagtacttcacataattcttggaacatggaagatgctcagtaaatatttgttgattgttatttgtttattcaggaaattatagacatagcttcatgtgcaaaataatcagcttaactgcaactcttaaagtctgcttacatgctcagtgaacagatagaaaacacagcatttaaaatacaaataattaaaacatgtcctgtccgacataggagattatggaaacgaatgtgtcctggctatgccgcaaatttttgttgttgatataaaaaaacagtaactttatctgaggatggacaattggtttggctgaaagactgcctctaggatcgatagtgctattattcccattgtatagatgcacaaagaggtttagagagatcacagcagagcttgtagccatcttactgcttattttacaatgacagtagctttcaataagcctgtggttcttatgaggatgatttgactattatcctgggaatagatctaagtgatgagaaacctatcctaatagtgtggtattaggttagatagagcttcttcatatggtattaggttagacagagatacttttgccaggtagagaagcgatgcctctctcttcatttctgtgggcatagaatcaattttagcctcttacagaacactattttcattattctcagcagtgctattctagttatcagaaactgagcatcagatataagaagtcacataattttatttttctgagcaattatatttccccccattgttttcttgaattatacttgttcattatgaaaaattgtcaaatgcaaaaaaacataagcacaaagaagacaatatttttaaattacccattattttactacccagagataagcactgatatcatttgtttgtgtgtcagccattctgctgttctgttcatgcatatatgcacatatacaaacagagattcaaaaccataagacataaaattaagataactgagcaatatttttcactgagcattagatagtgaacattttctcctgtcactaaatgttcttttacagctgcatctaagtagctgcattacattttattttatgcctctatcagtcctctattattgggatcttagaaatttgtttttgctgttataaatgacactctgatgaaaatacttttagattaattttttcctatctctactttcttaaaataaatttctagaagtaaaattaagtagaagagtgtggatatttttatgtgtttgatacgtatatgccaaattgttctttaaaaaagccatgtgacagtttatatttctgtggcagtctgtatgagaacacccatttcccagcctgaaattagctttcttttttttaactgccaattcaagaatacgttataacttggattgataacatgaacattttttatattatttttgaacatttttatattatttttacttctacatgtggttactctgttgatgttttcctcttttcttttatatttgtaagacttatttatgtgttaaagacattaacccagttgtattttatttcttttgcaactactttttctccagcagattcttctgttttcaacattttgccaagtgttactgaagaaaaaataaaataaattttaaaaccaaaccaaaaaacctctttagatagctaactttatttggggtttgtttctgaatgcaagataggcatactgtagtaaattcccttctttcaaccctgggttgaaatcctgtcaattaattagttgtatttagtcttacaatagataaaccaggtagtttcacatagcctgtttctagggttttatctaggacatcgtaggagtttcttgaaggaaaatatagctatagggaacattttaatttggatctgcttcattactccaaatattgttgaaacaacaccagatgtcatctttactgggcaatatacaaacattgggagaagttgtacccatactaataagggtgaacataaaaaatggactattgctcagatttgtgttctttacagcagagtgtttgacaaactctttgatccttcttttttttcacaagtggagattagagccatttattgtttgggggttgtaatttatatttaaacatggtatgtatggaatttaggaaattcaccttagacatatgaagcttaacattaatgtgtgtgtatatgtgggtttgtgtatatgctggagggaataagaagtgacaaaagtaatctaaaatcttaatgttgagaaaaatattaaaggtaaatgaaatctttattgtcataaactgctctccaatccagtactgataaacgacgtggggaaagactatggaggttactttcaaaacaaacatttaccatgttccaggaaatacatgtgtttgtataaaaagcaggtagcaattacataaacttttttcttctttatctatttgccaagcaattggctgttaaggtctttttggttgcctttgggcactttgtgtgcactcttttctgcttttaaaaacataatgcatggtaacccatttgccactgactggcattgtgaagagttggaatggggcagtgtaataacatgaaaggctgatgacaaatttagtatttgtaatttggaatctcttctcagtacattagaagtcttccctatttaaaggaaccctgaaaccatcattttatcaagtgaagagtttgtaacacatgattaccattggttttcttacaaatcagaatacagcttcagtttttgaggctcctaccacagttattatggtggtctcttactggctgacactttgattatgagcaggaaatgtgctttctgcagccacacacacacaaaaagtgacacaaaagtattaggtcatacagtagcacgtaagttcagagtgcctcctagtggagtctagtgttgatcaagtaacattggaataattttttcattcctctaaaaaaatctcccctttggcatcatggttggttatgaatcttgggcctcataggagcacaacattctccactaaaataatgttttactcatactttttcctttcttcctttaaaaattaggtaagataccttctctgaatgtgtgaattttttatagaacaccgaagattctttgcgtttaaaattccctccgtgtaaattaagtccaaagtgcctaggcttttccatttctaatgtttaagttaaagacttgtaaattgggctgggtgcagtggctcatgcctgtaacccctgcactttggcagattcggaggatcccttgagcccaggagtttgggagcagtctgggcaacatagggagacccctgtctcttcaaaaaaaaatgaaaaaaaaaatagctgagcatggtggcacacacctgtggtactagctatttgggaggctgacgtgggaggattgcttgagcctgggaggtggaggctgcagtgagcctgatcgcaccactgctctccagcctgggtgacagagtgagacactgtctcaaaacaaaacaacaaccaaagacacttgtcagtggaaatgtttgaaattttggaactattagaatgtatttaactaaaacagctattgcttaaatgcagcattttaagtactggtttttttcaaagctcagacaagcagcaatatagaaatatccctggtcatttaagaaactgagccaggaacagattttaaaacacttttgaaaatattaaatgctttaagtaattatagcaagtattttatcctaagtttatatacacaattaatttatcaatttgtagtgattatagtaagagaagattacttttatacttagaataaaaaacttttaaagtcagcaatatgtgaaatatgtattgaatatattatgctatatttatctgagtattttggtttaacaaattaaatgcatatttttttctttttaaaaaatgtattgaccatatttatataactacttatctttttatttggtagatttaagtaaaatttattatttatttaacacttttgaatttatattatacttgaagtggtttatttatccttggccagctacccccttgagactctggctttctattttatagaactattttaatgatagtttaaacatgtatacctgttactggttattttctgttccccttatcttgggagttcagcataatgctgtgcggatcaggataacaaggtcccactgaggtgaaggagggaggctgggaatggctacagcctggagtggaggtgtgatttcagtaggtggaaggttgtcttcctgaaaggaattggcagaagtagattcttactgattcagatacattttccaccaactgaaggaaggaattattaaagccaatggtgaacaaagcatttcaagcattttataggaagtgactagatgaggagatttttttcattccttttttaatcagcaaaaaagaaattagtattattgaattagcagattcttcctattctatattaagaaagatttaatttttgtaccaaggaaggttaggtgaaaaaaaagatttattttttttgtagaaaactgaagatagtttgattcaatatgaaacagtgatatttatatttatgctgattccaccaccaaaaaattattacatgtacaaattaaatagagattatcagcttaaaaaatatagaacatttacatgtggctatgaacattctgatgctaatttttttgtttgatgactatgtactttaaaatctggcattgtctttcatgagatttacaagtcctgtgtccattgtgttgtttacttaggttatttggctttcctcaaacttaaacaagcattagctggttgctccaaagagtaacaaaagaagatgcaggaaaatgcttggggccaggtgcggtggctcacacctgtaatcctagcactctggcaggctgaggctcgcagatcacttgtgcccaggagttggagaccagcctggtcaacatagggaaaccccatctctacaaaaaataaaaaaattagctgggagtggtggtgggctctgttagtcccagctacttgtggggctgaggcaggagaatcacttgaacccgggaggttgaggccatagtgagtcatgatggcaccactgcactccagccagggtgacaaagtgagacaatgtctcaaaaaaaaaaaaaaaaaaaaaaagaagagaagaaaaagaaaaagaaaagtgcttggaatgggagatgagttatcctactttgatacttcttgtttcctctttctactgatgtctttctctgcacatccttaggtaaaactcaaaaattactattgagatttttgcaggaaccaaatgagacaggaagaaatgttttaaactgctgtctaacctctaatactggtgatgccgtttttggagtaccactaacagtttaaaagtgcttatcagagcaactctcgctgctttaatttgcgtgtacagattgctgttagtgttgttactatctgttttgtatcaggctagctaatttccttgtttattaactaaatgactttcttaatggctacccttttgacaaatgaagaaatcttagctgctctgagagggaaaaccaaaattaaaaattcacagtgaaagggatgaggaacatacgtatttgtgctgctgccgtgtggttggtgtgagagaaaaatctggtgattgaccttgatccctaacggaaagtcacaaaaatatgtataatttggtcttcagccataaaataaatggcaactctcttcacttaaagcagggattttcattcctttgttttgggtgcggaaaagggaatcttttccaacctcattatcagagagtttagtgcattttttcctgaaatgttttacaatttccattttgtcagacacattttgttggagttcatagtttattaaccatgagttattttttttagtttatacttgaagatttagaggcctgtgatattttgtttaaaggcttctaaatgatccaaacaaatcagaatatgcaccagcctcagcaaaaactcctgtgatctgttgacagatttttggatctgggcccttggaagaggcactggacatttgtaacaggaggtaatttgagatctgtacaaacaagtttttatttgttcaagttaatgagggcaacaccagtggagttggaccctctgtagctaatagtctgtgagctccatgggcccttcatgaagtcagtctccaaaggtcacctgcaatccatgttaggaaccaggtttgtcggtcaatagtctaggactcatagatcgatctgtgcctctgcaaccagggaatctgacatggtaccaaaatgtttatttatttcccagatgtcatcccagagtttgggcaatgagattggatatttgcagttccacacagtggaaattcaccttttaaataaggcaagaaaaattgatcttcctagtgtctggtaggagtctggtaggagtcatctttgctcttggtaagattataattctcttacctgtttattgtcatttttttgagcaccacagtcagccaaataagattagagaaaattgtgaaagagaaagcatttctttcaattcagtcctttcattcaactctctttgtactttgcctccttcattttctttcgtttgctcatcacattcagaagctcacattccctcatcttacatgagggaagctataaatttccctttttgaaatagtcatctgctatctgtgtaactatgagcaagctgcttaacctctttgtgccttggttttcttatttgtaaaatggtaatagatattacctgtgtcataaagtcgttacatggattgaatgcattaaggtgtgtctaacacttaactcagtacctggttgtacaaagtgctaaatgaccatttatctaattattgctaatggaacctaataatagaataatgatagagagccatatgcttcattgccaagtttcaaaatgctaaacaaaaatgaattgtgaattattttgaatgtgcaacagcacaagggctggtgttttgcttcttctgtaaaaaacagacttaaagaatatctttaacataccaaaggactgttgggtcattcttcagaagactactggcataaaagagattgtcctaagaatcccaggaataataatgagtctcttatttttattggaaaaggagacaacaacagccatggaactggttattttatgtatcttctgtaactttcatttctctcataatagacatggtgcttttaaaaatccaatgtgaatgctctaaatcataagatcattattaaatattattttaaaattaatatgtcatggtgagtgtatttctgagccatcacattcataaacatttagaatataacctcacccttttgcttagagaataccttatgcaaaatgattttgaaggacattttgtttcctagtatgtgttttcagcaggtggctaatggctttcgacctgctgtagcagtatacagaactgaatgtcaggcagaatattttttaaagctgcatttccattttgcataatgaagcacaataatttttctgagagtgccttgaatatttttccaaagaattattgatagagatatgtcattttggtaggaaagagaagagaaaattggcaatgttccagcatttaggttttaagaatatttaagtataatcagattgctaaatacaaacatttttttaaaatagtatcaggtcaaatgtatttacatgttagaagccatataaagtacatggtattagccttccacctttcctgtatgcttaggccattgttcctactactactactactaataataacacacttcaacctactcacttttctctttagtaatttccattttctcttgaaattcatacagtatattctatggcctatttttatacaactttaagaattatacatactaaagaataattttcaaattttgtgtgaaaatagacaatggcatatactatatataatgacagagattgcttagggccccaggattaacagtttcagatcattgtcaatgttagcttcaagttaagtattggcacaagtatttttatagaaccatagtctttgtcagtgtgtatcacactgaataacactcaaatttgaactcagtggaatttttgagataaagatgtgcattgcagccagatcagtgcccaaagtacctcgtggtatgggtgatgggagacaatcacaatgtaaagagttctgtttctcgtactgtatatattagagctggcattttgccactggactatatgatgagggaggaatattgtttgtgagctttgcatttaaagcataatttctgaagctgagttctaattttatttattcccttaggtaattactggttttcagcatgcgaaggaggtatattattgaattttttgaatggttaaacttgtatagtagatgtcttttctttaaatttaggcactaaaaattctcccgcatcaaagtagcttgtgattctcatttgtggctagagagttaatcatctttcgataatgctttgaagttagctttacttctttttttcttcacccagcatgggttcatgaataaaactaaccactgataggtatagtgtattattgctcttgcctatggctcttgctaataaaaattgcaaatctggttagtttgctggaatcaattcaatgtagtataggaatacatttttttctgttataaagccctctcacagaaaaaagataggaaggaaagcatggtgggtgaagggaaaagaaggtaattctggatttaaaatattttagcttttctgtctgtatcgtgttttgtctataacttatgtgagtttttacttctcactgtcctagaatctttaaaattaaaaatcctattgcttaggatgaaattactaaaaattcctgtaaattaatgtatatgaatctgctgttgtgtggatgaagtagcatagcaacgtcaataacttcttttgagaaaatgtgtgtgtttgtttttaaaagcagctaggtaagaaaccatcaactgaagaatagggtaggtgatgcaaccattgctaaaataacctggaattctgacagtttctaaaattatgtcagcttgcttacaagattacttaatcactaaatcacatcggatttggcattttaacaaacaggatgctttgcactaacatcatcaaaagaatagtgcctggatgcttgcttcacaatgcaacgtgtatatttagaaaccagagaacatgccagactgagtgatgattgtacaagacattccatactccatccagatgtatcaggctcaggtggaaagacccttaaactgtggttagggagatacaaaaaaggagcttatttttgcaaattttcatgcataacacattaggtgggaacattgtctccagagttggatacacccaatcagttttaactatttcaaggctggtccctttgggcaaataagttattctatttcagccacatatttcttagctatagcgtaggtatagtaatgatatcgaatttatactattattttgagaaaagtgccaaaatgaaacgggtaatgaacaaaaactgccagttccagagccttagaaatctttatcatttataatattttgcatataagggaacacactgttacacaggctcctacatggcctcagactccgtctcaacacacaacaccaggaagtccctactatttcacaggttggcattgaacatgaaatatatttgcactccctgagctaattcaactctacccgtcttttctcttctttctattttgttgacagcctccctaatgaaaatatcaattcacatacttgcaaaggtgaggatggagagattggttatccacaacaatgtttggggactgtgttgaatgctttacagagatttgtgttaagtaggtgaatcccaaatttacatttccagtcttatcctctaccacaagctccattcatgcattcattaattacctggctcctttatttcattgtctaatgggtatctaaacttattgtactcactattcactgtcctccagccacactgggcttccttatgttccttaaacattctaagctaatttctgtcttgggacctttgttcttgctgctttctatgcctagaagcttctattcttcgatttttatgcatcatgttccttccccttattcaaatgtcatttcttctgagactgaggtttctctctgccaactgtatctcagtcattcccccatccagtcagtctcttatccagtcactctgtggtatggttcttcagagccattttgcatgtatacgaaattgtaatttatttctttaatttttccttgttttacctctcactctaaaatacaagttctctaagagcagtggccttgcctggctcttagaagtgctctcagcaacctttagaagtgtcattcttttttccttcatgttataggtgacaaaagtgaggcccagggaggttaagtagcttgcccaagatcgcagagattggaagtggcagagctgggatttaggtcccatgctgtgctctaaaacactgtgcaacattgcttcctttttcacaaatgaaggtcagggacattaatgggagggagggggctacgctgagttcttggaactccctttgagtccctgggctggcagttattgtttgagtccctggtctggacatagacagacaagagctggtcctgatcactttatactctatcaccctgggcttatcttctcttcccttttccttttagacttagtgcccaagatatgtgtaattaatattttacaggaatgcatgaaatcccctactgcttgggaaaaaacaatgaaacatcagattttaaagaaactcccaaagggctagaatccagttttgaacccagatggaattttccacatggcttagaaaatatataagtatatatattttatatacttgctgttttctgagcatttcttacttgacaatggttacaactgtagctttctttttgtgagtttgcattaataacattgctttggttttaacttgcttactgtaacaagttattatatttaacttagtccttatcgactggagggttccacctcacctcaccatgtgatactgaagctgagctatttatattgttttaactagacatagtataaaataaaacaggttttcttgtaatttatatcattaaaacatataaattatctttcagcttttaggaaaagaaaaaatcagggcattcgattcaaatgggataattcacagcccgcagattataggggagtaattattgatgctttttattctaggacatttggtttatgtgggctgcatttgaccttttagaagctattgacatcatttgggaactgccagtaaacctgccttaatcagttaaacagaaggaatcgtagcactgtggaactgactggctgattaatttaaatccaaacacagtcctgcctgaataccctttgtaaaacccttgcacaaaaaaaccttgcttccttcagaagcgttataacccacatcctgctgtcagatcttgtcggctctgctggtcttcttaggctgcaggcatcatccttaacccctcttatgcttccttttatttcatgaaaacaatatccatggttagattcacaaaaatgctctacatttccctcaaagttccttatttgtatcctagggaaaaggtattttttttttttttttttttttttgagacggagtctcgctctgtcgcccaggctggagtgcagtggcgcgatctcggctcactgcaagctccgcctcctgggttcacgccattctcctgcctcagcctcccgagtagctgggactacaggcgcccgccaccacgcccggctaattttttgtatttttagtagagacggggtttcaccgtgttagccaggatggtctcgatctgatctcctgacctcgtgatccacccgcctcggcctcccaaagtgctgggattacaggcgtgagccaccgcgcccggccgggaaaaggtattttaaactccactaattgagagacgaaaatgggaacttatcttaaactagcttctttagaaaaagtatattagaacttaatccagctcttcctttgggacttataatcaaaattagaatcatgaaatgttgaagtaagtttttggtattagagtaagccatcatgtataattcctttgatttttagattcaaaacattgaaggctttataatttgtgtttagtttggggaaaatattaaagttaatcaactcttgggtgagttcagagctagtataaagatgtagttctggacctttaaatgaaagtgaaattaaaatcctttaaggataaaactttgcatagcttcagtctattacatagactgagaaaaggacccatacatggggcactctgctggggttggttgcagaagagggcagatatttatgcgggagaggtcaaagaattgccatagaatactttcatagcacatagcatgttgtattggagcagaccaacatccttattttaaatattaaaaaaactgaggccccacttaattactcaaactcttaagggcccttacttggccagtttctatttctgtatcacccagttacaacactgttccagaatacagatgaagcctctcaaagaaggtggtgtcatccgattatctgtagttttgtttattattattaattatgataactaccgtttatggagtgtttgtgatgtgccagtactgtatgcattatctttatcttcataactacatatgaggtagtactattgttcttccctttttgaaaatgaggaagtgatgtttaggaaagtcatggaggctagcctcagcaacatagcgagaccccatctctacacacaaaaaacattaaaaaattgccaggtgtggtggtgcatgccagtagtcccagctactcgagagtctaaagtgggaggattgcttgagcccaggaggttgaaactgcagtgtgctgtaatagtgccattgcactccagcctgggcaacagagagagattctgtgtccaaaaaaaaagaaagaaagaaagaaaggaaggaaggaaggaaggaaggaaggaaggaaggaaggaaggaaggaaggaaggaaggaaagaaggaaggaaggaaggaaggaagggaaaagtaatgcactcaacttgaatcaccaaagcagtcagacgaggtattttttttcctttgagtaggataagatggtagctagatgtaggtaagagaaatgggtaacaagagatgtttcttccatccctcgtaagttgcctggagaatgttaggatgaggtgagtaatgatgccataggacataagtaagggagaaaaattaaggccattccagccttaattctttagaaacagtggattcactgtgagggaatgggagcacacctgctctctggctgtgatgagaagcagtagaggtccaggtgaggagcagattggggcatcagggactctagaagccatgtgacacaggaggaaccatggaatcattttgagcctctgttttgttttgtttttcatttctaaaagtgaaattttgatttctacctttccctaccacactgggttctttaaaagattgaaaaaattgaattttaagcaccttagaaaaataggatataataaattttgtatttatttattgaataagtatttattgagggaatgccaaatgcaaggcacggtgctatgtatagaataagaggtgaatattgactttgtgtctacctttcagaagattaaagagagtaggaaaataagcaacttgataaataactatgcaaaagtatgttttaagtgcagttctcaaggttaagaacaccgaaaattctgagagggagctgacttctgatgatgggtcttgaagaactgatagggtttggaatggtagggaggagaaacaggagaagtgtgagggttgcagggggggatggggagatagatgtggaattccaggaggaagaaacagtaagagcacaggcctggaggagggaaagtatggggacatatttgtgcatcagattgtctaattagttgttgcttaaagtatcaggaggtctctctggtaaagatgggcttacgctgaaacggtgaaatgtgcacttgatttagcagctcacgggggagccttttagagttttggagtttggtggtaacctggtcaaggcagtgttttataaagatgcatcaaggacaaagtgatatatagaattattaaaggggcgagacactggagtcagggaagccagaacattataagatgcctgataaagaagacctaagctagaggggcagtagtgggaatggaacaggaagagaaggatcagggaaatttggttgctaactggatttaagggtgatggggagttacaacccttttgtcattagaagttcttggactactttttcattaagtcagtatgaattagttttaattaacatattgaaatccaaatgctcataataaagtcccacatcccactgtcacttttcagtccttggaacatcttaactggatttagaaaaagtgttctatcaagatcagaggaaccatgactgttgctcatctggactaggaggaagctcaacctagattatgaggctaagctgtatcaggattaggggtgttttgccttatcctcagaaaagtgacttagaggaaccagaagaatggccgctgtagctgacagtcagggctttagaaatcctggccaaatttcctctctcaggtgggactttaaccctcatttgcttctgaattggcacttgccatgatgaattcacttagtttaagaaagaagttagtttcagggtcttgctcaactctaaacatcaatttaaggtggctgactgggagagagatgagatttataatacttttgaaaactgatagagttatttctttaggaaatagtgctggtttgtctgtttcttatgaaagggaattttccttttttttttttttttttttttttgagacggagcctctctctgttggccaggctggagtgcagtagtgtgatctcagctcactgcaacctccgcctcctgggttcaagcagttctcctgcctcaacctcctgagtagctgggactacaagcacgtgctaccaccctggctaatttttgtatttttagtagagatgggctttcaccatattggccaggctggtcttgaactcctgacctcatgatctgctcgcctcagcctcccaatgtgctgtgattataggcatgagccactgcacctggcccctcatcttcccttctaactactgttttctttcagtttgagaatttacactattgtttggatgtctttgaagtcttaggatcctcttgggaaagaagtgtttttttctgaataaaagaaggtgtactgttatccagcaagaacatgtcagagctcgatggggccagtgttgctattgggtaggttttgcccctgctccaggtccgtttctaacctctggacctcatgcttctgtgggtgtgtacttcacaaggtctgtctcttgctgtccttgagaatcaaaggaagaggtaattttgttggaagttatcaattcaagaaatagtttatgatctctaataaggtggtgagatcacgctgaccaaaatatttagtgaagtcgtggaaggaaatagaacactaactagtacaagacactgtgacagtgttgcaaattaagaggaaaataaaaactaaatgaggcctggaattagggaatggaggttggataaattaggcctcttttctctaatgcaagcctctctaacaggccacataatctggccatgtggggccatttttctcactcacacttgatttttgtttctgctggtggtcttccatatttccttcagccattcatagtgttagagacctcttggtttggtcttattttcggatgtgctctttttgaaatggtacctttttaaaaaaacatctaacaaagcagctttactgttggactgttctttatgattgttacatctctggaaaagtcgaaacaagtgctccctttttgtgtgtgtattgcctagataacctttatttgctttttccaccctaattctgtttagacaggtgggtcatctcctcttaagagttgtttgaaacaaccttaaaatagtctggctagcctgttaggacctagaccactgaagctgtcattggccttctctgagggcaggtaagccaggattgcaagcccagaacagagttcgatgaatttccattgtttgaattacaatagtaactcatattcatagttaaagaccttttaaaagcatataatatgaacattggaagactctccttcaaacctagtctgcaattgacactgctagaagcaacacttctggccaaatgtcctgggtgtgtatcttctggacatttttcagtgcatattcagatgaatacatgtatttattttaaaatttgaatatatgtgtgatatatacatatatatacacacatacacacacacagagttttgtactgttaatttatagtaaactgcatttttgcttctcaaactcaggatctcagaagaacaaatgaaagaataggagtaattccattttgttggaaagcttttgtactttacctgaatctagaaaatctgaattactgtatgtttttgtgagggctgactttactgttttgctttcagaattttttctaatctatatgggaatgaaaagcccaacttatcaattaagttaaaattttctacatattccagattgtaaattggtgctattgtaatccattttactatttttgtaagcagtattattgttatacgtttgcgcactatttactcacaagggaaacattaaaaggtaggcttagcttcatctaaattgaaatagagataataatagtttctttgaactagctgagatctaaatatacagtacggaatgacaaccttcatttttgattgtgatatgaatatcttaagatctggtaagttacttgcttatctttacaattacagtatttgcaatagcaaaattagacctcagtattgtttaaaaacatgtcaatgtaatattcatggagaagaaaacaatagctttcttagtacagatgataaattatatacttattaaagtgttgcatctgatcaaataagtgtagtatttcattatagacttggtttgatgttgaaacattgttattttaagcaattactttaaactggatattttaaagagaggctgtattcctctgaatgtgggtcacagaggcagagaaggacaaatagtttaaagggagatttaaattatgtgtagtttggaggattgttagaagtagaagtaattctgcctgtgatggaagagacttaaccagaaaactgtggcagtagtcaacagataccttctgattttgtctgggtgtcataattaggcaattcgctggaggtgttttctggataagtgatgtattggcaaggatttaggagataaatagactgggcagctgccacctcatggagaagtaaatagagtcagttttcattgttttcagtaagctgacctccaaaggcatagatgtgagctttcttttgaaaggaaatgaagtattcaccgttaaggataaggatgtttgtaatgtgacagtgttaatgctagctaaatgagaaagccatatatgaatacttagactgttgctacctgggagcattatttattgacctgtgccttcgtcagagcttcagatgtgaggggaatgatgctaatagaatcatgtaaagatgtttgtcattaaaaagtcacatcgcaattagtagattcagaattcatcgagtcctcttgctctgtgtcacacccgctgcctctgtgacaaccttcatttcctacttagcaaatccaagcctggtagctggagccccaggaagttgttaaagcaattaaaggcttctgtctcccagcacattgcttggttaccatagtatcctctgcctccaagtctctcctgatgatgtcagtatgcatacaggggttgttcagatcatctacgtggggatgattcaccccacaataaagcccctctctctcgttgctcgctttccagtgtgatttcagacatctgtagcaatggaaggtaagtgccttgttttgcatattgaagaattactaaatgcttctattattctgtttcaggtttcttgctttctaagatatactactgactgaaatcatagtgaatgggagcatccagtcaattacttagaacagatttgtagtttgtacttaaagtgtgtgtgtgtatgtgcataggtgtgtgtgggcaggcacatgtggggtaggcttataaagaaaactgaatgcacagtgtaacgcctgctactctccctggtaaacagcaatagctttttatttcaaactattcgaaatatgtaacttccttaaaatattttgacaagtgtcacagggcaagtagggctaatttttaaaaagtgtgtaagtatattgtattggcatttgatatgttttacccagtttaaatgatattaacatttgaaatatctaagatggtatgggaagatactagaaagaagaaccatgctgagaatttgcatgttatagaaattaaaatatgtaggacaaagatttagttggtgaaggggagatgtatgaagttcaaagtacagtgataatcatcattccatagttatgccacacttttatagcttttcaatatctcacacaatttgattgtaaaaataatgcttctattattgtgatgaatgcaattagtgcttcatgaaagttttccttgaatatgtatccatccttcttaaggataatccagctatgttcagctttacagaaagaatatagtagaaccacttataacattcagacagaacagtgatacgtgaatattttccttgagaagttagtgctgtttcagtttttctctgacggtatgccttatcaataaacaataaataatgagacacatgaccggttcctctctatcagcctccttctgaatctcttcattctgagagttctgcccataaagttagtcttgcatttatttcttcttcttgattcccaaggaatgattcagtagtacattctgtgaagaatgtaatacttggccaggcacagtggctcacgcctctaatcccagcacttcaagaggcggaggtgagaggattgcttgagcccaggagaccagcctgagcaataaagcaagcaagacctgtctctaccaaaaaaaaaaaaaaaaaaagaaaacaaaaaacaaaaaaacccttaaatttaatggaagtggtagataacagcagtttctaattaattaatagatagctttgcagagaaaaagaacaagagtagagtggatggactggagaaggctcccatttctttatatagttgaacgtttattctgtgtggaaggtaggcagatggcgttgctgacaggtgggtaaatggtttagactgtccctccctagagaaatgtctaaaatttgcattttgtttcttgtatttttgaagcctttttaaatatacccttctgtctaacttgctttatttctgcatgagatgattcgcctttctacaaagaatcagtgagaagtacaactgtgagagagggtgaaacattgcttaaaaatttaaatttaattgcttttaagtgaaggatatgtcttatcttaaatatcgtaatgcttagtctttgaatttctttctgccctgaaaatagtctaaatgctttgacttcatttcttcactattttgaatacttaatcctgtttgtgtttgaaaatttacttgttcattgctatcagaaaatagttcctaagaagtaggaaaaattatgatactacctaatttagattataataggttaaatattgaagaaagtaagtcaatataaactgtttctatactgtttaaaaccttttcattaaaacactcacctaatacttatgttggaaacaagaataatatagtctaagctaaattatattaggtttttgttctttgccatgttaatgtgtggggtgacataatttaatttcttcaataactagctctttgtagtaataattacgaaatatttctgccattttgaacccttaaaatatccacgaaaatacacttttgctgacttgattgatatgagcagcactataaagagtgtactataaagattacagtttccttcatgcttgaatcagggagtagttccaagtagttttaggcagtgatttttaaaattggtttaggaaagtttttactttatttttatgctctaataaggatgttttaaattttacagatacttaaacttgtttttgctgaaatatggaaatgtcaggtctgtagacttttccagcatgagataaatgaaatatggcagaaaaaggatcaccttgtctctcactagaaagataagaagttaaggccaggtgcagtggctcaggcctgtattcccagcactttgggaggctgaggcaggcagatcacctgaggttgggagttcaagaccagcctgaccaacatggagaacccgtctgtactaaaaatacaaaattagtcaggcgtggtggcgcatgcctgtaatcccagctactcaggaggctgaggcatgagaattgcttgaacctgggaggcggaggttgtggtgagccgagatcgcgccattgcattccagcctgggcaacaagagcgaaactccatctcaaaaaaagaaaaaaaaaagttaaatcaaaccactatccaaaagaattagaaaaagttctgtggggaacatggacttggaaataaacattttgtccagtggtaggagaagcttgggttgtgagggactggttaagtgctttactcagttttctgtgttcactcagtggcagagcgagggctgattggaactggtgcccacccttctacaggccagttttcattttcatggcagcatactctctagttggagttgagcactttttcctaaccaacctttaaacttattttctcccattacaagagtgatgaaagtagcataataactattagttttctactgttggctgtaacaaattgccaccaacttggtggcttaaaaagtacaaatttattatcttacagttctcttggttacaagtctgacacaagtctcactgcactgaaacatcaaggtgtcagaagggctacatctcctttcaggaggctctaggggagaattcctttccttgtcttttccagcttctagggccatctgcattccgtggctcctggccacctccttccatctttacagcttgcaagtacagactgaatcttcactttgccatctctctggttctctgcagccaggaaatttatccactttagaagagtcatgtcattagattgggcccacctggataatctaggagactctccccgttttaagacccttaaacttaatcacatctgcaaagtcctttcggccatgtaagttaacatattcacaggctccaggaattaagacatggatatctttgggggccattattctacccgccattgaaggataacaaaatgcatggctgatttaatctacattaaattcacacatctgatatttttgctgaaaatcataaattaaactagtgattgccaatagagactatgaaactttgacctaattcattggatgtaatcatccccaaggatattaaaatgcctcaaaataattaatgtgggaaattcagattagaaagaaatgtttcaccaactcaaatgttcaaaactcttaggtacagatgggagtctcgtaaagtgacactattcttagtttaatatttttattgagaggctcacatcagatgaagttaattaaacaaaactgatttgggactgcaaaatttccattagttaactcctatgtgaatcagctggggtttctttagaaacagaagggtaatacctgggccactagagagccaaatgtgaaatctagtaaccctgagttttgaataacactgtcgtttatggatctggcattaagccatatgagtcacaaaacctagcagatgaatctgacagttatgccctatacagtttcctaggaaaggtacaatatatacattaatcaataactttaaacatgagggcaacagctgcaaaaatagtttcttttattgttcacatcctgtgttaatcatacatttaagccaaatgatagcacatgggtccatccacacaaagcgtaagataatttatatctagtagctgtattttaacttctgctaaatacaagtggtaaagatgcagaagagagactactgtagtatgttagttttggacagaaagcctagatttacattttgctgtggttctctgaaaaaaaggagatggaaagaaaaccaactgttttcctacacatattctttttttatttttggaatcatttcctggagaaaaactaaatagtaccttaggacccttgcttagacaatggcttgtgaaaattacatttctttgcaggaagtaattatttttacactgattctttttcataccacagtgtacagcaaccttaggattctatgtttaaaaaatctgattttatgtcattatgagattgatttgtcaatcaaaataccatcattaaaggagagatattatttaacaatgaagttaaacatgaaaatcagctggctcttttatttaataaataatgaaatagcaatctatcaaaaatacctccataaataaaatatacatttagttatttctttatgtacatagtaagctcatttcaatgtttagtttcttttatctatcaatagtatatactaatgcaagtgctcacgtaaataaaaacaaaacccaaatacctttaaacatttgaatatttttaaaaagtatacagaatattcaatttaatatgtattttatcctactacagtaaattagagaagagatgaaatctattttgcttatttgaaaaaaaaaaacctcacagagctgttgccttctttgtgatagaagagattgtttaatctttaaaacattttgaactgactcagttgctttactaatccctttactttgttaaaaattatctttaaagtttacctttgagagaaatcagagataaaggaactaatggagatgagagttttgagattttgaatctttcttggtcagtgggcgtggataaaatagaagcagacttcaaaatcagaaacttcaaagatcttgatttctcaccaactatattgaaaaccagtacagagttttatttccagggggaatttttcccaatgatggcagtaaagtcatgcagcaagtgagcaatggaactaggaagttatcctacgtcgtaactactccaaagacattgcagatcagagaaccattgcaagctctcctcatttttctcactgatctttctcacttaatctcactgattcagttgtttttctttaatttattgttgctttaattttacttccatctttaaatgagggcgaaacttgcagaaagacatgcaattattgaaactgtttatgaagaaagttgttttactttaatttgtggaatgccccatttctgccaatgtctgctatggaaatgaaattctataactggaacaatttttccattaactcctctaaaacagtctactttggagtgaggattaatggaaataaagggtactctttctgcaggcaaaatcttgtgacctggggcaaatagggagaagaaaggttaagcagcaataccttaaagggcatgaagccataggaacagatggtagccatcttttgtggggggtttgctatgaccagtgcactggggactagccagattgaaaagcttagagaagactgtgccccatacctgttgcttactgtttgtcatagatgattttacaaaaactaaggagtctgtggtaggggcaggagactggtttctggatgtagccccagcaatgctgggaaatagaactgttcccgtgtgctttttctttatgccaagggtgcatgaggggatggcaactggagaccatcaggtcccctttagtatttataagcaagggaatgagctcactaacgcaaagattttagtaaattcaaaccttccaataagaaatttatgctgcaatttaagctcaaaacttcccaagagtctcagtagagaaaatgacagaggaatatgatttactaatggtgttattagagtacaagagtcaggtggcattgtttaccttattgccaaaagtcagttctgtcttcttcaatcagaatacaatccaagcaattactattgaatgccctcacgtgggtgatggtgcactaagtacaatgcagaattaatcaagggacagtgtgacctcagatctcaagtagtttaagccaaaagcgtctctctctctctctctccctctctctatatatacatatatattgatatatacatatatatagatatatacatatattgatatatacatatatattgatatatacatatattgatatgtatatagaggataactttcttattacttaaaagctattattgttttattttcatggtaatttttgccaagcagcaaattgcagttgggatttcataaattcattttatttgcattcagtgaaagagtatatttttcttaaaattctaaattgatgtatttacttgatggcagatctgcagttattccattaagctttgtatctctgccctatgctttcccaacccccatcacacttgcctgactgtaaaactcacatatctttcttttgtgttctttctgtgatagagttttcccctctttcttatacaaatccatgtgtgcagcacacatgcacacacacgcaccccccatacacacagttactttacaatgagctgttctaaacctagtccttctctttacttttattcctctatcttcctttagtctccctataacttgtattttaagcaaccaactcctatttattgcacccccactgaatgtaaaacactatgctacacactggggtctccccgtcatttccccactgcagatccttgcctctacagttaacagtatttccttctgatggggacaagttaggtaaaataaaggagatagtgggcagaaggaaaggatgttgttggttatagagcgaagaaagtaaagatagaaaccaggagaaagggaactgaaacagagcaccgagattgtgttgggattttggaatcgtgttagggcaataggaggaggtaaagaagcagcagcagcaaaatgtttttgagtgttttatcaggcattttatggtgaataaaatagattactatatttacacattgaaccttctgcattaaattactagtttatccttttcagctagctagaatccaagtttaaacacccccaaaccttacttacatttctttgatatcactgtagctattccagtatcctgcccatcctctggcccccatttctccctctctcttgcttaacttttaaaatgaagtccctattcagaaaaaacttgtgcttcctaaatgaaacctaaagaggaagttgttcttatgccaaaaatcagcgtatatctgacttgattgttatctagagttatctcctaacatgttagctccatgaagattttctgattaggttgaactgttgttgaaagactggtggtgcagaaacaataagttggcatttgtccaaacttagtactaagtgttgaaagttggaagagtaactgatttttctagtcactgtagttttcattataacaatctcctttataaatttggtttgcagcctatatatttttgtatcatagcagattttgcactggttatctagtttaaagtttcagtatttgagattttttcatcttttcaataatgtcaaagaaatgttgggtttagcggtttttaaacttgggatctggaaaaaagaaaaagatcattcttgttgaaaggtttcagtgagtcatccagaaatttatacttatgcctcctgacagccagtaattattggattgcagttatttttcagaagtgtttactccgagttgaggttttatgttattgatgatctgaatcatgagtttaactctcatgttaatccaatagtttaagtcatctgccagcctgtgtaaaattactattttaccactggacacacattttaattctttgccacaaaagcagcattgggctcagagaattaaggcattctctgcctcaaggaacttacattataggaggagagagaagatgagaacacaggactgtgatgccacactggtacaaatgcccctatttcttttctccccttagtagcaaaactgctcaagtacagtctgggcatgttgtttccatttctttttctcttggtaactcttgaacccacttttgagaaccctcctctccttcaaagccactcacatcaggatcacgggtggcttcaggtcaagagagtggtcagtgctctgtcctccgctgacttgacttttcagcatcatttgggacacgtagtttttctgtactccaaaaagtgccacattcatctggttttccttcaccctaactcactgttctttccagtctcatttgctcatgatcttcctgactctaaaagttggagtatcctaaagttcagtcctactttcttctctattaaaactcactctcttcatgatcttattctcttattaagtctcatggctttaaattccatccatatgctgacagtttttaaattcatattgctgatttgaacctctctcatgagctctagacaatatatttctgcttggggtatctaataagcatcctacaaataatatgtcccaaactcctggtcatttccctctaccaaacttgctcttctatttcctatctcagttatcccagaaatcatcaatattaacatgttggtatgtatttgtccaggctcctatggggatgcatgtttatttctcactctcactcatgagatcatattgtgtatgctgttttcttcctctttttccctcatttactgtgaacatgttttatatactcttaaatattatttgaaacctagctgttagtagttacttagttgtaccacaatttattaactaatcccttgtagttgaacattaggttgctacccttgacttactattataattaaaatttaaaaagaaatacttcatcactctagttttgtactatctcaatatggtagccacttgctacatgtggctgttaagtaattaaatatggctagtcccaattaaaatatgctcaaaatgtgaatgcacaccagatttcaaagatgtaatttgaaaaaaagatggtacaatatttcattaataatttttatattaattacttagtgaaataatattttggttatattaggttaaatgtgatatatttttaaagtgatttcatttttgcctttttgcttctgaaaaaagcaaaattactatcagaaaattaaaaattaaatgtatggttcacattatatttttattggatggcactatcattaattcttgcttagatttgtgtaacagcattttaacttgtctcctgactcctgcggtctaatgtcaatagagtggccacagtaattcttccaaaacatgttatcagatcatgtctctcctctcctcaaaacactccagaggcttctcatcttattttttagtaaaccaagtcctcagaagccatgtcttagaaagctggtccctgtctaccttttgactttatttctccctatcacaagccaaacatatttccatgttgggcctttttaattgctcctcccccttcctggagtgctgttcctccaggtgtctgcagggcctgtgcagtcacctctttcaggtcttttctttgtaaaacctttaccgaaaacctacttaaactttttttttctcaaaaaaaaaaaaaaaaaaaaaaagacctatttaaaattatgaccttaccctgcccaactgctcccaataacccctaactctttttcttgctttttaaaacaaaatcttagcacttgtcaaatttaacataacatattgttttcttattaattacatttatttttctgcttttccccaccagaacataagttgcagaagggcaggaggctttgctttattcactttattcaatgtagcaacataacaaagagtataatggattatgttctactccaaatttagtaagttagcgtagtaaataacctgttacatagagaacacacagttcctttcaaaaacaattgtgagatgtggcctctagtcttataaaaattaacagttgaaaaaaaaaaaggaaaatgtagcataccagttatgtaactgtcaaatggttaaacctattctgccctttacagaccttgtcccagtgacgtcttggtggcatatgacactgtagatcaccattcccaagaaataagtaggcatgaggaagcattatgaactgtcatgtgtctttgctcaggatgtcctttgtccagtatgcccttccctctgcctcatttgttccagagaaagcctacttatccctctgaaagtctccccaagtcccagcaagatgagttcttccctcctttgtgccaccagtcatgcaaggtcttgttatatgtgtggcctttttttatgttcagttatttgctagactcagatccttcagagcaggtgtcatctttatttacttttatgttccaaatctcaatatgtaataagcacttgataaatgcttcttgaatgaatcaatttcttttgttatgaatgcacatttagagtttggaaatcttttcatcatatttgtgcacacacacctcttctcaaacttaaaaacataacgaactgttgagattgatatgaatctccgaatttactctttaattcttgatgccaaaatatttgatggtagtgagagggcgaaagagaataactgagctgggaggatacaaaacagaaagacagacgagagctgtttctctttaatctctcctatattctttgctgcttgcttgcactttgcagtcaaacagatcctgaaaccctccaaagtggaagtgcaaaccttacattataattgtacttgcacattttctgttcaagtgatgaaatatgtgtgaaatatggtgagttccagaatacattcatttatgaaaataatagcaaacagaaaaacaaaatagaacaacaacaatgaaacaacctaccatcgttttggtgaaaatgagcagggtgtcacttgctagaaaagttttgaaagtgctggtgtgataatatgaatatattcacaaatatacatataatagtataaatttgtatttatatatttatatatgtttataaatttgtaaattttctcaccttattgaattttagtagggtgactcttagatatccaaaatatttgtgtataatattttattttttcaggtattgcctcttcactttaattctttcacagacattagcattgccttaaaagaaacaatgtaaaccattgcactgcaataaaatagaaatatttttgagaggagagtcattctaccacagattttgttcttaatcaacagtgctcatatttttgttttttggccagtactatatatagggatttctcctttcatttacgaaagaaagtacatggtatgtctcgtactctgaaaatgtgcagttctggcagttaccctggatggttatgctatcataattaaaacacagatggagctcatttctttcccaagtgtttgattggcagacactctgtgatcaacactcctctctgctgaacacatcagcgccatctgccttcagtctgcctagagagggtggtcgcagtagaatttccccatcatcgcatgatactttaagtagagtatgttcctttagctgaaggcatcaaataatttatgcaaaaaatacatatatttttatcactgttggtttgcaatttaatgaaatatttattaataattgtgtttttaaaaaattcatgactccttttctccaattaaaatatttagaacatagcataaaatcaccacatcttggaaaagttaaagtttctaaataaattgagctgatggggcattttgtttttagtgagattgttagagatgatttcaaatcagggtcctgtgtgttgttagagatgatttcaaatcagggtcctgtgtgttgaaccattcatgcaagagctactcacaaatggaactacttcaatatattctctcttaagcctaacattaaaatagtttcaaaagaatatgctcattttaaaatttttataactgttagattatgataaatggtacttcttggatatcatggtaagaaatggaaagaaatttatgctcacccaattttaatgcagataagtgaatgtgggttgataattatgtagaaaaagatacatttaagatattggaagcataggaaaaatggtatttttaagaagaaaaaaagataactatttcattgtcctagaaacattttgcaatatatggtacttacacaaacgtataatctagattagtgaggaatacacatgtattatgcataacaacataaattctgtatataatgaaataataatgaaaaattggttggaattctaccttccctgtccacatggataagtaattataattgacaagatgaaaacatgctatgtagtacttatgggaaaaacggaatgaattaaagtttattctacagaatgttagaacaaagaataaaggaattaaatttaaaaacattctgaagaaccctggaatacactcattgctttggttcctgtggaaacccacttacaagaaagggcaagagtgacttggattttggcaagaatttgaggattagattggtaaagctaatcacttcacagttggagtgagaagatgagttttggaggtgaaccaacagaaaagaaggaacatagtatgaatatatagaaatttttcatcttctgtacctttaaagataaactctgaattagattttcattttgtttgactatatcatcacctctattcaagcttggaatttttcaaggtaaggattggagatgggaagggagaaagaagagttttaaccttctttaagagaagttttagcttatgtaaaaaccatttatcctgaggagcttacatgctcatgagggaaagaatgaggataattttgatatgaaggattggaataagtgttataaagaaagtggaagttcagagaaaggagaacgttccccacttcagaggtatgtctaagaacacctgaacacagactcactcactcaagtcctcttcctctaactggcgctgtcttccttcccaaactatttctttctgggccagttttattttgtgttgacattttctatatagtttacatttacaaatacccacttgtacaaataccccttattatgattatacatataatatggatctccagagaactttattaaatgtcgtttggttaataaccaacatttattgagtacctactgtgtgtcagacacttttctaagcaccttttcattttactctcacagcaaacctatgaagaaagtactgttataattaccttattttgcaaatgaagaaactgcctaaaatgacccagttaatccagtagagagattgggattacttggacagactggctccagattaccgcacagtagatccccataggttcttggaaaaactgtgactttaagtgaaataatatataatgaaagcaattttaccataagcaaatttaagtttctgctgcatatttctggtcacaaaaacaatatcaaacttctaaataaaaacctaaattgcttctcacattaaacattgaaataagtgtgagttatacatacatttaagaaagactaataaaagcaagtaagataattatttacccaatttgggggattcaatcagtgatggtagttgtagtggtgatgggttaaatccagagataaaggtcttcaaagagaaaattgtcaggcacagctcctaccaacatgcagataaaaaccaaataataacgattatggccggccccctgagcactttcattttgcatcatttattgttgtacatttgtatgattatcatctactttacacatttttatttgacaataatttgtattcatttgctcattcatctatttattttccaacctgcctattctaatttagagtcacaggtggccaaagcctatcctggcagctcagggtgcaaggcaggaacccaccctggacagaatgccatcccaccgacgagcacatacacgcattcactcatgctaattccaagcgggaccatttagccaaaccagtttacctaacatgcacagctttggaatgtgagaggaaaccagagtacccaagaaaactcacatagacatgaggagtgccctagacacagacagtgccctagccaggaatcgattttttttttctcctcatcaaccttataatgaaatgaagttgaaggaaacattatttgaggacctgctatactctggtgttattaaaacagacccagttcccagaactgccctaagtgtgaagagttaatgcctccccaggattaaacccaaggaaggggcagcagggaagactgagaagatacccttagaaagagcaattaaaccaaatgcaggaaagagcagtgagaagggaaattaccattggagatcctgggtgaggaagccaactttgtagagcagagtcacctgccctggcacacactcaccttgacccatacacagactcctgctacacatgtgcccacctggattcctccccactcatcccagtccatggccctcccccaccctctatggccagtctaaaggactgatgtgcaaccaagaaacaaagtaaggacaagcactcctttagtggaaaataagttttatttcgtttttttcccccagttgaaaaagatttctgagaagctgagctaggtattgagtgggatgtggaaaagtgaatctctgaccttcaaccatgatagcagaaagtgcattggactgagggagcctgaatccccttgtcttagtctcaggctttagctaacacttcagaattaggttcctgatgtttgtatattttgtcaccaaagctgagagtttgaatactgtcaaaagttgttacagaatagagtaaaatcacaatgtttacttagcaacactgagttgaaatagagtcataagttgctataaaaatcttgctaaatttcagggaagaacttttaaaaaaataagtaaaaattaatggtaaacccctactttaaaaaaaaaatcaaagcctaaaagttttttctccttaaagtatttcaaatatgtgaccatcacatataactttggtgtgggaaataattagacatgaaagactgaataactgggtgattcagactttcctacatctgtgacttgattcctgaaaggagcgctggaacagatgtcaaactataatcagagtgagcaattaaaaccaagtaatcttagaacctacttaactaagaatgagagttatggaccttcttttattccatgggcattttcttctaagagtgagcattaagaaagaaactgaaatatgacccagaattaagctctaaagtccagtagtcctgagtttatgtactgtaaacacttgtaatctatgctcataagtgaacttttaatagtcctgttctcatgttcacttcatagagcagagtctgaacttgttatatgcaggtcacagaaagggaactaactgtatctcaaatagaccctgaccatgaaaaagatactagttctgcccccttcttcgtttaggagaaaaatactcaaagtttcattatgtaatcttttctttgtatgtttattaaacattaattcagcttatttattgttgttttaaagagcaccagaaatggaaacatgtaagatgacatttggtttattgaagccctacaaaactagcggatggtttagggaagcagcattaaagatgctattgatccttaattcaagaccatacttaatgctgcatctggaagaagagctattgcaagaaaaaggctgttgagttcgagactatgttattcataaatatttaagaaaatatgaggcaagtgttcatgagcatagtatacggaaccaaattccgtggcgaggagggttctgcgaacatttctaaatctgtagtatttattcatatcacatttcaataaacctatgaagaatacaattttatgaaatcagccaaaactttatagctacattgttttatcttagtcattctatgtacaaatggaaggtgtaatatgtgatagtcactgggatagtcattttgtatttaaacttccttataccaaatacagaatctccaagtttttgtctttaaatattttcccaacacttacactatatttgatagtgattaaaaagctgagtataattaattggtaccatgtataactgtgatagctgcatctggttacttttcctgttactcacattactctgttttgctataaccactctatttgtgaaagtttttatgctgcctgctcaatacatgctaaatgttgcttttagtgagaaaaatgagatttcaaagcaatatcaaatacaggtgacagtgtttcctaattagttttatggacgtagaaacaaatcacttaaaaaattcacaagctctggaaatgcaaattttctaaaataaggactcactctaaataaaattttatatattataaaccacatagttagcatattattgccagatctaaaaacctatatgtagttcctaaattaggctttagagaccctgcaagattttgaaatggtcaggaagtgggaaataacccaccactgacacagacattgatgacagacttgtgctggcttcctaagatccaagaaactgaatagctaatgcgaaagcacctttcttacctgagcactaatgttatggtacctttgtaggctcctgacctgtaacatttcagcctcttttgtaacttaacagaaaaagaaacaatctaatttaagtcattttcaaatatacaaattaaatggctaatatttttattttaaaaatcaaacattttctttcagagcttcaaagaaaacttggataatggatctctctagatccatccaggtggttttagattctgtaatacctttacttcaacatcgctggctttcaatctaaaactaaaaaatttatctttgggtgagaaattaaatattgtccaaatcaaatatattcttaatagcccaggagaataaactcagaaaagaatcaaagataatcttagagggaacccggttgcttactgtgtgcgtatgtataagatcaaatatcaaatgccagattttaatgtcaacatgcgatgctgggaagaacatttaatatagagtcatgagaaacgggcctggagttcaagctccaggagtatgggttgtgtgaacttggccaagtcatggaacctctttgatcctcagtttcaatacagagaataagagtaatgaaaatactacttcaatcctgtacaacatagtgagattctatccgtacaaaaatgaaaaacagccaggtttggtggcatgtgcctctagtctagctacttgggaggctgagacagaaggattgcttgagcccggaagttaaaggctacaagtgagctatgattgtaccactgcactccagcctgggcaacagatcaataccccatctctaaaaaagaaaaagaaaataatactgctttctagagttagagtattatgagaaataaatgagattgttcatgaaactgacttgtgctgtgtaaaacctgggttttatttctaactctacaatttcccggctttggataaattacttaacaaaataaagccttgtttttcacaactttaaaatgaggataataagaatacagtgtttgcaaactgattgttaacaaagtatgagctcaaatcttagttactattacttgctatttttactaaatctctaaaaatgtacttaatgtcatctagagatttaaaatgttataataaaattttatttttttaacttacttaaaaacttacttccgtatttatttttacttgaaaatttgttactccatatactttcttacaaataacttttaatctatgtatttatgtggaatgagacattttctccctaaacagatagtttctgctctgtatgtaatttttgagctttatgattcaagggacttgagtagaaatggatatccagggtcctttcattgtttataatttgctatcgctaataacaatttaaatataatttgttttgttggtggatttggtataaaacaaccgaggagcttgtatgactttgtagacatacggtagatttttttaaattttgagaggaaaaaacattcgagggcactaagagctgctggtgccctatctagaggacgtatttgagatgcaccagagatcccctacctcttaaaatccatttagagagtcagctgcaaacctttccttgggtaatgggattagcactctgttgtaactgcaatccttaaggatacaaatttgtttctgaatgttgtagctagtaatcttatgctccttgacaggtcttacagtgtaactgccactcttggaatggaaaatgcagacctcagacctctctctgtctgctaggttaggaagttcaaagactttaacaggaagtattcagtcttgaggaagtaaaaattagctgctccccacctttatttttcaatgatattattgaaggaatgtgatgagtcacctaaatttagcatacatatagatgcttttataagagaatttttccttgtagtacccttaatttttagtacttttaaagaaaagaatgctaagaaatattttctgtctaagtatatttgttgatatttaaaaaccttctgaaccagttagtttgtttggaattcagtattaaaggaataaaagtcaagaactgtttgtggttcttctctttgctatcctctttctatgagacagctcttatttccctggatggacaatatgcattgagcattcttaatccagaaatctgaaatcttccaaaatgttaaactttttgagtactgacagctcaaaggaggagcatttctgatttcagattttcagattagtgatggccaactaaatataatggaacatattccaaaatccaaaaaaaaatccaaaacctgaaacccttctggtcccaaacattttcttgataaaggatattcaacccatgtaggtatgctgagccactatgatcctaggaaaataaaataacattttagtattttttttatacaccttcctgatacattctaatattttcttctgtttttaattttatcctcataatacaaatgattattgaatattgttaaaatattcttactttaagaaaatgtctataaatttgaaatattccaagtctgttttcatgaggcgtgattttttatagctaggattccagtggaatgtaaaataaaaattacaatatcttttgaagctcactatgattttttttttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccactacgcccggctaattttttgtatttttagtagagacggggtttcaccttgttagccaggatggtgaagctcactatgattttagcattaaaaaccactcttggacttcattgagtaatttacataaaaacaaatattaatgtagtataaagctgatatttattttaatttttccttttgaaactattctcaattctttcttaaatgttctattcatggccatgcacggtggctgatacctataatctcagcactttaggaggccgaggccagcagattgcttcagctctggagttcaagacgagcctgggcaacatggcgagaccctctgtctactacaaatacaaaagaaaaaaaaatagccaagcgtggtggtgtgcatctgtggtcccagcttctcaggaggctgaggtgggaggattgattgagcctagaaggcggaggttgcaatgagcccaagatcttgccactgcactccagcctaggtgacagagcaagactctgtctcaaaaaaaaaaaaagttatattcatatcctattcttcttggatatactatattgactatacatttacttcatcttgatggcttctggtcctatgaatactggctgtgtctgtgctatagggaccatgtggtgtgctctagggaacactagctgctgcatcagagcccttaactgctatctgtgctctgattggcctagtgtaggttacttaccctctcttgcttctctaatctataaaatggggctaataatacacatctagggcagtagcgagggttacatgaagttgcattgcatctaacagtctctggcatatagaaggtgcccaataaagtttagtttcatggttcatggcagatagaaatgtaaatgtcagtgtgggagatttaggattagagctaatgtagctgtggccttggtaagagttggttgttggcttgtttactttttattttacaaaacaaatgaaactatgtaatctccaaagtagtagaatacagctctcagcctaggctgaaaatatatatgacttaatcaattgcatttgcatataagaaattcctacctcagggtttttttttttttttttttgagacagagtcttgctatattgcctaggctggtctcaaattcttgcactccagcaatcctcatctcagcttcccgagaagctgggactgcaatcatagggttattttaaagacttaaagatatataacaattcaaagagtttagcacttgctaaacactcagtaaatggtcattaatataaagatgcagccctctcagtaaatgattattaacataaagatgcaactgttgggatacaggttgtgtactctaaattttgaccgaaagtcatacgtacaaaatgtattctcggtacaccaacgttaaatggttataattaacaaagttgctaaattttgaaaatatgttcatataaacagctacctttttttggatatttagtatatagtcgttaaataagaaagctgaaagtgagcaactgggaggttttttttttttttttttttttttttgagatggagtcttgctctgtcacccaggcaggagtgcagtgtcgcgatctcggttcactgcaagctccgcctccccggctcacaccattctcctgcctcagcctcccgagtagctgggactacaggtgcccaccaccacacccggataattttgttttgtatttttagtagagacgaggtttcaccatgttagccaggatggtctcgatctcctgacctcatgatccgctggcctcggcctcccaaaatgctgggattacaggcgtgagccactgcgcctggccgcaaatgggagttttttgtggttagaaaattgtatttgtgagaaataattctgaaaatgccttttatctactttatacaaattgtctctgtatattatctttaaaaatctcagaatctagaaagaatggtttatctttctgggccctagaatcataccagatagatgggtcaatattatacagatcttagagtctgagaattctgcagatatcttttatcaaatttatacaaactgtctctgtatatgacctttaaaaaatttcagaatctagaaagaatacataatttattttctgggccctagagtcataccaggtagaagggtcaatattacacagacctagcaacacgtatagatgttttgggggtctacctgctctaggtaaatatttctgcctgtactggggcttatgtgcagctgccatgcactggtgtgacaactggttgcatggctggcattcattctgattaatcaccaatgtaataccagttgttaaatattttgaatattacctagaaatatttatatctgtacctgcattgcgtccccattttctcatttaagagtagcataattgttttttttctttgtctttcacagcaggacgattgaagtcattaaggtggatggtttctacctgttggttagacttttctacaaaactacggtatctgctaggttgtggcttatttcaccactgtactgaatctcactactttatacaggtcagggcatctcaccactgaaatgtattgttgagtaccttcatcattgtttattgagcttttcatagggtttttcatatagaacttgtaactgcttgttcattcttctccatgactctcctcttactacaccctcagctcagttcctttaatgagaagacattctaggaagttctgggtattaagctggagtggtggaggtctttgaaggaggtttgatattagaaatcagattcactttcacaaggagcatttaaatcattttagccaattaacaccctaacatgtgatttaacaccatcaagtccccaagttgccaagaatgtggcccatgcctatttcccctggtatgctgtctagattgctgaataatgtttgtcttctattaattaagaattctgtacttggcaaattaagcatgtttgcctaaacaagtctcacaaatgtgataggaacattagacttctgactctgtattttggatgttttgttttgttttgttttgttttgtttttggttatctgagagtctgagttacaaggtaactcagaaaccagctctctcaattaataggtcagaatatgaagtttgtagtagttactaacccaaagacagataagttttaatctctatttcagctttgttcagtgggaattttggtcacttggaggccataaatttgacatccttcaataaaatcaaagtcacgtagctagtttgtggcacagcctggactagaacctggttcttttgatttctagtctcactttcattttttcctagtcactttattataatgttcatggaaaccgttacttgaatacatttttataaccttgtaatccattatgtaggcatgaaaaattaagacttttgacatttttattatatgcaaagaaagtaaaaattatcttgttaaaaatatcatccttattattcaactttgaaaacatagaaaagatgtgtgaaagagaaatgtagcttcatatgcatatcttttaagtatgacccttcattatcgagctctttttttttcctttttttttttacaaagtatgccatgagcttttttaaggacacattttaacatagattaaatctttgaggaattagcttgaattatttataggtaactgccaaaacatgctaatatccatgtgtgtgaaatataaatatgtttatcaatagctgagagtaattgtttgtatcatgatgttaggaatgatatagctatatttcatgcagtttttaaagcccagttgatgtagtttgtgtatttccctggctaacattgttggcacacagtaaatttctaacaatgatgattactctgcctccgtacagtattcactttaactagaaaaaaatttactactatgctaatgtggtacaatttttgaagtatgttaagatgctaagaaaatgttatggcattctgttacagtattatcattttttataggaactagtcttctctctctctctctctctctcccccgcccgcccctgtctcatacatgtactacaccagtcattcatctttcctatgccacactcatgttttcaccttactgactaaataaccagtggtatcaaagttttatcttccattgaaatccagccttcaaggatggtctcagagccgttcccttcattatactgtgcagtggttcttcagaatctgaaaattcagaaatgtccaaattatgattacaagtgtccaaactttgaagtgtgtcatggcatttgagtcctactttgtatctagcagtgtcaattatttggggacgcacagtgattcctgttttaacaaaaataaagctataatattattggagctagcatccttttaaggcagatttgacattgatcgtacccatagctaggacaaagccaagctggtcattgtagtttcagggggcatgcatgtccacttcctcccagttaatatccccattttctttgattcctatgtacagcagttcccccttatccacagaagataccttccaagacaccccactagattcctggaaccataatagtactgaatcctatatatattatgtttttccctacaaatacatatctatgataaagcttaatttataaattgggactgtataagattaacaacaataacaataaaatagaacaattataacaatatactgtaataaaagttatgtgaatatggcacctctccataagtatcttattgtgctgtactatgagtaattgaaactgcagaaagtgaaacctcagaaaagcagggactgctgtactgccctttattttgtaataatatatatatatataactttcctgaaagaactagttggaggaataagtcccaggaaacatattcacatgaaatgtgataaaccacacaacctgtgcacagaaccaatactggacaaaatggagagcagaacagctaagtgactaggagcacaggttttgaggcagacagtcctggtttgaaatcttttcttagagactttctgtcaccttgaaacaattaaaatcaagactgtttgacttcacttagaccagtgttttcttatctgtaagatggagataatactgtttcatgagctgtattattagaaagattaaaagaaaaataggtttaaaaattgagtaatttgcctgacatttagtcaatacctgaaaatgtcaattaatataacaacaaaatagaaatacataggacaactgaaaagagagaaaaagtgaataaatgagaagctgaggaccctaagggcaaattttgtgcacatcatatctttgccagtagttcttcctgtttaccttctattggttggggaaatttagaggccatggctgataatattgtgtcagtgcctgagctctgctttgtgttatttataaatatttttgcttatttttcttggatgatgctataaacagtgattcatcctccttaaatggagtctttgttaattgaagatatctgccttcaaggggcttttttgtagaaacaataaggatatacaggaaacagttaaaatataaaacttattacatgaaggtcatcagggctacagaataatgtggaagggaaagaacacgttgtggggatcagattccatgtaaaggacagctccacttttctatttcaatgtggacattgagataaaatagcataaaagtatgtttgacaccagggctcaataagcataatcctgaaacagctactgtaaaaataatctttttagcagatcttgtttgtaagtttttaatttcttagaaaaaatcagcattttttaaaagtatttggtccatcctcacaaatacttgaaagacagctagagacttagtttcttcatgttccaatacatggattccagaattactaaagaggacaatgttggattccttacccctgtccccaggaagccacattttctgagaagagatcctacattgggctatttttgactttccaataagctgttatagtgtaatggccaatacacaaacattatgtgtttgtggaagcaaaatggagagataatagaatcttattctcctctatattgatttcatatggaggagaatcaaaggcatatataattgatttaattttttggattttaaaatttcaatcaaagatgggttcaaaatgtgttctttatcctccattgatatttggtcacataaaaggttttatgaatatgttggaacttgcctgaatttaatgccaatttactgatatactaggcatattttagtttattttgttttgtgatgattttttaaaaaaagaaaaattctacttttgttcctcattatgagtgtaatctttcccccttctttttagaaaatttaacttgaacttgagtacagaactcaacagagtttataatattatagtttacaggtagcttgtccatgtcaaagttgtatatcaattaatttaacaaatttttgtttatgatcttctatatttcaggcactgtgctaggtactggtggtacagagaagtcaacaaaacatatacaaatccgttctctcatagagtgttcagtcagaaattaaagtgataagaaaaacaagtcatattgtaatgggactcaatactttagagcaatagagggggagttgggatgccaggagcctggggaagggttacacttttaaataatgaggtcaaggaagattcactgagaaagtgacagttgagcaaagatctgaagggcagtgagagaggaaaccacatggatacattgggtgagcatattcttggcagaggaaacagcaagtgcaaagatgctgaagtaggagcctgcctgtgaaaagaaaaggaggccattgtgctgggagaactaccaggaagggaagggtggagggaagagatccctgggatgggataggggtggaaaggtaggttctgtagggccttttgactgctgtgtattgagaacagattgtaaggtaccaacggcaaatcagggggatgagtcaggaggcagttacagtaacctggacacaaagatagtgtctatctacctactgtgcatttaatgctgcaagtattgtatgtagagaccaagtacaaagaggtcctttctgttgatttttcggtctgaattcttttccccttgtggttcaaatcttacatggaagggaaggaaaagtcaattacatgtttcacaatttttagtcattactggtaataataataataatatgaatcttgcatgtatatagcattttgtagttttcagggctttcttatatatattttcatgcctagccctcaaaatagcctacattgaatgagtaacagctctgaggtttataagacgtacccagagtcatgtagtgatcccttctcttttcaggatattgactttggtgaatatatacaaactaaataataatcaataaccttgtatttgtggagaagaggttttgggtacacttaaagaatacttagccaaagactcattaagagtatatctgacattggtggtggctgtgttgtaagctgagaaaatttaattgttattgattctttaaaaacgaaaacacttaaaaacaggaacattttctccttttaaattcaccttttctttttgtaggattcacatacctaaaaatgaaatagaaaaaagtatacaaaaactggaagaaccccacaagtgtgagggaaattataataccaaaaatacttaatttttgctgagcagtaatactagatacagggttgccttatacatgtcaaaatatttcaggcaaaaaagatttcactatgaaatttaaataatgaggctcatgacattttacttttaacctacaagatagcattgaatacaatgaaaatattcaagttatgtcaaagaaaatagcataaataacatttatgtatgattttatttaaatttaaagtatatttcatatgtttcagggaaaggagggagagattgcagaaattgctatatattatagtagttgagaaagcaggatgtggtattttgtattcagaaatatatcatgtaacagctgttgcaaaatttgacttaaaaaaacctgaatgggcaaatatacctttctagtcaaagggaataatatatcacttgaattgcgttctcgaattgccatttgtctgggagattgaatttttgaacatagtagcagtaaaatgcaaaaaaggcagattaatgtagagatgtttgtgaaaaaatttaagtgctcaagataggaatttgaacttatggttcacacaatagcaatccattctctcttacaaatatgactgttgaaatgattaatattttatgttgaaaaatctacttatttgaatgtttcaattataatattccctgttaaagatatattttttcacttttctgttgaaatgacagtatgtgtaatatgcaactgatgttctggctatcagtctgacgaactcttgcaatatgtagaatatgtggtaggcatagtccttttgaaacattcctttttgttttttagttttgtttgtagagatggggtataactatgttgcccaggctaatcttgaactcctggcctcaagcagtgctcctaccttggcctcccaaaatgctgagattacagatgtgaaccactgagtccagatgaaacattgttttgaactttttggtagggaatggttctgaggtagctgagggattgatgccatgggtgacatctgagacaggagtttatggttctctgttcctctcctttttttaggtgaactactgtttacatccttcttattccctccctcctttaaattatccattcaacagtattatctagtgccacctatatgccatggcattattctaggggctagaaatacagctctctgctcccttgaacttgctatcttgtagtgaatgtggacaataaacaatttaaacaaatgaaaatgttaattatggatggaccaagaaagaaaccgagagagagagagagagagagagagagagagagagagaggtgcaaaattgtgtgtattcacagggtgagggaaagctgctcacctcacaggaaggctgaagcctgaaatgataagagctagctgtttctcttctcctgctctttttctttacagtagcccacagattcctagtagcttggctgcatttaccactttccatctgcccagagttgaagccaatggcatgcttttacctcttctccctcccttagggatatgccaaagatagtgagattgacattgcctaatatgcctcccttttcttacttcccattaagaatacagtaattataatgtatttcagaggctttcctgagccttacaccagcctcctgcttcatcatcttcgtaccacacaacatgttttatttgcttcagttataggccttctcacattgccttgcaatatttgtcttctgtccccttccaaaatgccacagcccacctgccctcaataaaagccaggtaggaataaataatttctattcacctttgttttaccagaggctaacacagtgtctgaagccaattagtttcaataactgtgttgtattttttaaccaaatcaataagttgtttaaacttacacttcttgcttttatgataacttcaacccacaaatatttcctctcctttctgatacctaaatgatgaaatggaaaaataaaatctgatataaggattaatttaagtaacttaatgcattcttgtcaattaagtaaaatttaaaaggtacattaatcactagtttcccctctttcactatttatatttttctcaacctaagagagcaggatgctgaaccatacttagaattaatcaggagaaacatgggaaacatgcagaaaacaacataattatatgtgcacttttaagctacaaagtgaaattaggtaagtcatttgaagatctgtatgattcattataatgcaatcaattatgtggctcaccttaaattataacataactctgagaaaaataccacagccttaaaaattattttatgtggatgatggcatcatgcatatgcagaaaccagtatagatatttataatttttcacagcaaaagttttaaacatcattttaacgtaacatttaaaaagtaatttacatttcgaatatttagttgcacatggttttatttgtttgctcatctctaatatggaaagaaattgattatagttcattcttttagtttcagaactgtttgccattttctctttgttaatttttaaaaatgtaaataagtatcatcaatttgtggattagcagtcattgcctccaaatatcatggcattttttttctctgatttttggcagagtcttttaagtctgcatgtgatttcatcatttttaataataccaatcttaaagaatggccatcatgttctttggacattgattactccagaaggggaagaatataaaaaacaccaatgcccaagtttgtttgttgtgaaaatagccacacttgaagtctacttttatattgttcttgtaaaacatcaattattatacagtaaaagataaattcagctgaatatgtggggagaagggaaggaaagatttgaagattatttaataatgttttaacttttatgttcttcatgtatggcataaaaacttatttaaactcctgaggttttagttgagtgtatgttttaaataaatattattatttaagtaaaacatagtatcactgtaattgtactctcaatgtagatgcctgtttttgttttactgtgagttcagagggaatagttgtttcataatgagtttctgttcatgagcagtaaataaaaataagaaggaaacagtgaggagaaggcagagttagtttctcttcatattctaatccattaatgacacatatatcatgaatgtctaattctgcattaaaatcttgattaagatggaagagtttctggtttttcacctttaaatattctttaatatggagagttgacagtgatggattaactaatatgtaataaatacagaatcagagatctggaaataatccttgagacatcatttccaattccctgaatcttgggagaagtacacctaagtgttggagttcctagaaatctttaaagaaaatttcattacttttttattgggagatatatcatacacacagatgcgtatataaagcttagacagcttaaacaatagctgtaaactcctgtacagaaccaccacccaggtcaagaaatagaacattactaatatcccagaagccctctctatgtaaaatttcatttactctctatcaaaacaagctccaggtattttcaaagtttatattcaaggattccatgtagaatcattatttctttttcccaaaatgtcagaaatttgttactgaaaagagttaaactctatagagatcttctttaagctagaggtatttctattcctggtacttttgaaatgcatttagaggctgaaagtgaatgtgtatcatttagataattgtgccagttggccaggcgtggtggtatgtgcctgtaatcccagctactcgggaggctgagacacaagaatcacttgagcccgggaggtggaggttgcagtgagccaagatctcttcactgtactccagcctgggcgacagagcaaggctcagtctcaaaaaaaaaaaaaaaaaaaaattgtgccagttacatttgaataaggtgtgtagagcatccttctttctgtctttaaatcacagaggcttcaaatgaaatgttatagaggcttgggtgaaaactaaatcgagctatgtatttaaaacatgtatcatagccaaagaaattttatccagtgagttagagtagcctaatatcagaaaatctattaaggtaatttcctacattaatagattaaaagagaaaaaattattttttaatggttttaccaaaaatacttaataaaattcagtgtcctgtcattataaaaactcttaagaaactaggaatagaaagaactttcttaactgggtacaggttatctgccaagacccacaacaaacatcatatatgatgctgaaacattagacacatccttttgaaattagaaataagatgtgcttactcccactgcttctattaatcattatactagaggttctaaccagagcaataaaacaagaaaaatgaaagttcaaatattatctacatacctaattaaaattaatatgcttatgtattacatgtaattttatatgtaaaattaatgtacaattaaattaatacattgtattttcttagaaacaaatttagaaacatagaaacacctatgcaaactaaattttcaatgatgatgcttaaaaggcaagaaaggtagattatcttcatttgttgtttatgatcgtataatctttgtttccattcaaaagtgtttatattgatgaacaatcatgggcaaaatgaagtctagagaataatcattatgattattttgtcttgtaagctttgtgacaaaaattcatcaattaaaatgtattgacttgtacatagtgcattcttacagcaatgataatttgaagaggaatttccatacaaatgtggttataataaattgggtttcacaaattttgcttttactggtatatagattatgtaatagtagtagtagtaaaatatataatttgggattgagtttagctgcatagaacaaaactagtgaaaatattttcaataaaatagaagttaatcaatatcatgaatgaaagaattctgaagataaggtgatatattttccatatatttacgggacctagccttcttgcagctcatcactcgtccatcttcatgatgcagcccccattctcatggtccaatacagctgttaagcctccaatcatcacatgctccttttagccagcagggtagaggaaggggcaaagaagagcacacaaaactttaaaactttgacacatggcttcgtatatctgcagttgaggctgggcatgtccttttttaattgagcagtaatatgaccagccaaaaattagagttcttgtgatgaaggtgaaaggggaaaaggatattgcaaggcaagtgtctgttatagatgggtatttttatttaataactaatctgatttaattgttggaagattagaagaaacatactctttatgtgattttactttgtctcttggtataggaatagtgtgtcactgagctggattgtttaagaaaattttgtcattaagaagagtaaacaaactagtatagaaacaagaaatagcatacatagtaagtttcattaaaattcagctatttagaatggaattgcctaattctttcaggcaactcatgctaataagttgtacttagcataattgctgggttactactatcttttctccagattaagtatttttgatttacatttatatgacagttgtcctctgcacttagagtaatagcatcctgtttatatattctgggacccagaattaagtcttgtttttctagcttctccacctgttcattctcaaacacctacaaatacacacacacacacacacacacacacacacacacacacaaagtagttatcagaacatgtgcagtctgcattttttctgtcctttgaatatcctagcagatttgttgtatattcataaagacttaaagacatttaaaggtttgaaagagaggcattaattttaatgcttcaagaaaatttctggagcattcccaaccatttatgaatctgcagttataactttacagatgaacataaatgaagagttgcaaaaatatagagcacccctgaaagtatttataaattttgtcataatcaaaatctcactaagactttttcttgaactcgaaaatatagattcattaatttattttgaaatagaagctggagataatagtaagcaacaaaatacagacacataagacaaggggaacttgaattttcagatgtcaagaagtacttattacaaagttaaaacctgacaacaaaatggatagttagatcaatgaaaatgcataaacatctgaaaaatatgcctaaatttataggtaagtagcatgtggcaagtctatctggatagaatttaatacggctatacacaaaaattgagtaactgaaaaatgaaagtttcttcctattgcatatcatacacaaaaatatatttcagatgggtccaaacattatcgacaaaaatgaattagaaccataattctgattctgtaagtcctaaactccagatgagagaaggacttacaaaaggaaaacgcatagaacacaaagaaaaaatatcaataatttaactttacaaaaatacaacctaaatatatatatatatatatatatctccacatatgtgtaaatgcatagaaaagagactgaagaatattaatatggtttggctatgtccccacccaaatttcatcttaaattcccatgtgttgtgggagggacctggtgggaagtaattgaattgtggaagcaggtccttcccatgttgttctcatgatagcgaataagtctcatgagatctgatggtttcataaagggaagtttccctgcacaagctctctctttgcctgtcaccatctatgtaagacgtgacttgctcttccttgctttccaccatcattgtgaggcctccccacccatgtggaactttaagtccgttaaacctctttcttttgtaaattgcccagtcttgggtatgtctttaacaccagcgtgagaatagactaacacaaatatgtacaaaattattaagagaagttacctttatttgaggaatgggtgttgtgtgagttagtctttgacagtttactcaagtactgctgtttagtttgaagcctgaaacaacaacagtgtaatgagttaatgtatcatttattgaaccaaaacaattaggaatgggagaaaaagcaaagaattaatgcacagtctgcattgaataatttttatgagccatactttgagagaaacataacttctccatttgatatatacaacaatgttaggatttggtaaattcgccataatctagagacattcttatcccaccatcaggaactattccaagggaagaggaagaggagaaaaatgtggttttaagaagcaaggtcctaacatggctctaagaagcaagtcagcccactaggtgaaaagaaagttctacagcttgatcagtggtactgttgtacagtatcctaacctaaagcctaattatgttttaaataaaccaccagagcctaaggacttgacccatgagtaaatgcaccactaaatgtgacatacatgataaaacactttaatgttactggaattgtggtttctcacattgagtatgtatatttagtgtaatgaatctctttttattcctcccttcaaagttactattaaattgagactacgtcttaaaactgatggtccaagaaaatagaaaaaacaaatgacaaagaacttcaacccagcctcagcttatacaaaaacgaacacaaaatagatcacagagttaaatgtaaaaaataaaactataaggaaaaaataggagaaaattctttaggacctatggctggataaaaagttcttagacgtgacactaaattccataaaaagaaaaactagtaacttggagttcatcaaagctaaaaacatcttctctgtaagatcccttgtgaagaggatgtaaagacaagctacagagtgggagaaaatatttgcaaaccagaaatctgagaaagaccttatgcctatagtatgcaacaagctctcagaattcaacagtaaaaacaaatcaatccaaatagaaaatgggcaaaggacatgaatagacatttccctgagaaagatctatagatgacacataagccttctatagatgctcaacatcattagccattagggaaatgcaaattaaaagctcaatgaggtatcactaaacacctatcacacaggttaaaattttaaaatagtaacatcaaatactgacaaagatacagagaaatggttcactcatacattgctagtgggaatctaaaatggtacaacaatgttggaaaaaagaacaattgcattcttgaacatttatcccagagaaatggaaatttatgttcatgcaaaaacctgtatatacatgttcatagcagctttatttgtagaagctaaaaactggaaacaaccaaaatgtccttcaaaaggtgaacagttaacctagtacatctgtactatgtaaggaggctcagcagtaaaaaggaatgaactattgatacatgcaacaacttggatggatctcaagggatgatgcagagtgcaaaaagccaatctcagattacgcactatatgattctgtttataaaacattcttgaaacaataagctttttgagatggagaacagatttcctaattgtgctattgtactatggtcatacaagatgttaccataggggaaaatgaatgaagggcatgtgggatctctctgtactatttcttccaactgcatgtgagtctacaatgatctaaaacatgcctgtaattccagccatttgagaggccgaggcaggaggattgcttgaggccacaagagattgagaccagcctgggtaacatagcgagacccccatctctacaaaaaattaaaaaatcagctgggcatagtggctcatgcctgtagtcccagctactggggagtctatggtcagaggatccttgagcccaggagttcgaagctgcagtgagctatgatcacaccactgcactccagcctgggcaatagagcaagactctgtctctcttaaaatataataataatataaataaaaacaaaaaaaagaatgggctcttaaacacaagggaaaagtaacacaaaactcaacagtgtggttaagtaacttgtccagggttccacagcttatgagtagcagagcttagatataaactaaggacctttaaaatttgtctgtttcacaacccatgccaccttcctcggaatgcccttctcttgaagtgaacaggagtagtttttacatacaggacttgggagccatttctccagactagcagatataattgagatcagattgtaagttgtagtcaaattcctctcaacctgtgttatccaaaatatctggcagtgcttctcaaacatcacaagatcacctgggaatcttgataaaatacagttcctcgttcagtcttgagtaggccttagccactgcatttccaataagctcccaggtaatactaaagctgcagtccgtgggccacacattgagcagctgtttgtaactaaggtgacttttaaaatggtttataacaaacagcgtttcagatgtggttaggatgctgcacatgagatgagaggaggggcacatgaaatgagagacaaagaaagcgttgtcaggctatagtgttaagtatggggatctagccataagggaaaacaggatatgctttatttatatacacagataagtggagacaattgacaggcattttgagtgtggaaagagaaaacaagagtcaaagcataatgttaaagtgatgccgtgtggtcagttgctagaatatcagctgtttgctataaatgtaatgttcacttcctacattcatgtgtaaggaaaattactgataaggtaggaagtttattttttctacagcctagactgtcataaaatccgatggctccattttcattcatttaaatatttggggattcgatttgtcctgttatctaaactaattaaggtcagaacatccaatacttccatttattcaggggtacaaatgttttctttttgtgttactgaatagcatgaaaacatcgtgctgaagagttttagatgccctacgttcaaagtctttatttaattattagtgcttttatcaggctttatgcaaggtgccaggttttctgaagtaactaaaacttgatatggctttatgttatgatgggaaattaataaatgaggatgagaactggggaaatgaagtgtgaaattatgtggtatttcaaaatgtaagcttcctttgtgatctatgttttatcatatactagctcacatttggtggtgcatttgctcatgggtcaacaggcccttaggctgtagtagtttctttaaaacatcaggcctgaagtatatactaactataccactaaccaggcttgtgtttcatggggtgttgaattgtgctgaattatttcttagaagcaagttgatgctttttttccttttcttcctcccttaaactactccctgatggtgaaaaataacaatgaaatatacagctacccttgagaagttcacattctcactggtcacctgcctccagtttgcccccaacttccatttcagcctccaggtcactgccagaatgagcttgtaaaacacacatgggatcttctcacctataggataaagataaatccctaggcatggatcacgaggtcctttgtgcattggctcctgcccttttctctggtcttatttcccatccctctgtgtgttctggttgtacttaactacttgtaattttaaaaactcaacttgctgtctcctgcctcaaggttgatctataagcggtttcctctcttttggatgctttttctccactgccacctggtaaacacctggtggttagctcagatacagcttcctcctggaagctgcctgtctcagtcaggctgttaggtttcaaggagtagaaacccacaaataaaaagtgtttatacaagtgaaagagcaggccacttcatggacatcccagaataaggcaggttatatagcaaggactttgggtatggaagaggacagtcaagaactaaggttggtcacgtgctgtcttatggcactgcttgatctctatctcttttctttctgtgcctgctcccttcttctcttgatttacaaagtgatgttctggcttctcagttcttctgtcactttagcttgctcgtagctttgctttggcttactctaatgtcaagttggccctgattctacatgaattttcaagtcaactaacatctccttttcttcttttcaaattagcagggagagatttttggatggacccagttaagtcaagtggacaattagctatggctgaagagggtcatcatatcttacatgggtcatacctttcaaggctgggagagtgtggttagtgctgctgctttgattctaccacttagaagtagaccatctttttctttctcccgagtcccattttactaagctcctaagcactcatttttccttatccttcactcaaagggtctaaggtactcagatttcaggacgcagcatcttgccctgtattaagaaacccttctgctggaatcacctgaggtcaggagttcaagaccagcctggccaacatggtgaaagcctgtctctactaaaaatacaaaaactagccaggcatggtgacatgtgcctataatcccagctactcgggaggctgaggcagaagaatctcttgaacccggtgggtggaggttgcagtgagctgagatcatgccactgcactccagcctgggtgacaagagcaaaactccatctcaaaagttttttttgccaagtaagaagacaacttcagttatttgagtgggcatggtttcactgggatcattataaaatatttgctttggttgatgcagtgaatgcaactctttatttgggaaaaaaaaatttagtaaaatataaaagaaaattcgatatttaaaattccttgtgctgtgaaaatttatctacttgagtcagctaaagatagtaaaattacatttaggttaatatcattccgctctctaaactacttcctaagactattccggtgagagtacttcagatgataaggggcaaaatttcctaggaaaacttatttaggtggaaatatcctaaagaaactcaattaaaactgaaatcggtcagagaactaaaaagttttatctttaaatacacactacatcctacaatttcttccattgtgccctattttgagaatttatcttacaaaacattatttctattatagcaagaataagagcatggtgaaaatattattgattattgccaatgaaaaacactggtttttgaggattctgttccaagtagccttcatgatcttcctgaaaaacctgttcttcatgctgggatttgcagaatatatagaatgatcttctgtgggtgtcagaaggaggaaatgcctaaggaaaagaattctgtaaaatttatttggattaccagatgtgttctctttctctctcttcatgtccttctctttcttcctcttttttttttctctaagcagaagtcatagaacttgactgttctttacttttcccagttataagaagaggatgttgataccggttttgctttctcctgattattttggggaatcttgtgaatataccttataaactgttgcattttagaaatatgagatactgttggtgcctactgtacacggcaaaggcaacaaagatgactaacacatggcccttacatgaaagggttaacccttcagcagatggatggattcttccctggataactgaaaagcctcactgtggaaaggggaaccctatatatactgacttatgagcgtcccacaaagaaaagaccaacttgatgctcaggcctcctccagagcagcaccagacagctttttagtgtctcactgtgaaatgcaaatacacagtcacaaatcatcagactttttagggaggtgtctggagaaagggagaattttgaaaaagagagaaaagaactcagctgaaacaatgtagggaggaacagataatagaactgaaactagaaaatggagagagttgataggtaaagttgaggaaatccctcacaaagaaggataaaaacaaagagacagtggaaaagaaatgccaggaaatttgggggatcattccagcaggtccaacatctaaatataggagttttaaagaagatgatagagataaatgtggaacagaaattgtcaaagaatatgtaagaatatttatcagaatcagtatcttaagtcttcagattagaatggcctagcaagatgaatgagaaaagacccatatgagggcacatcaataaaagttcagaacaagaagtcaaggagaaaactttaaaagcctccagagaatggagagagaaagagattgagatatcacaaataaactataaaaaatcagaatggcacctgaattctaaacaataggactataagaagacagagggacaatatccttaaaattcttgggggaaaggattgtcattatataaacccctatccacccaaacacaatcatggatatagctaaaataaagatattctcaacacggatctggaaccgcgctccagttccagaactctagtaaaaagaaaaaggtggccggacgcggtgcctcacgcctgtaatcccagcactttttgggaggccaaggcaggcggatcacgaggtcaggagatcgagaccatcctggctaacacagtgaaaccctgtctctactaaaaatacaaaaaattagctgggcatggtggcatgcacctgtagtcccagctacttgggaggctgagacaggagaatcgcttgaacccgggaggcggagattgcagtgagccgagatcgcgccactgcactccagcctgggtgacagagcaagactgtctcaaaaaaaaaaaaaaaaaaggaaaaagaaaaaggtgcataagtaaaggtaacaatcatgggacactacttggttcagtggagagcattagttatatagtttagcaacttaaatattaatttaaccaaaaattgtgatatgaatctattggaatgctggtgggatgtgataggagacttaaatcctcatcttccaaagtaagaagtcaatagataattaatggaactgtgaaattgataaattagaatatcaacatattcgggaaaatgaatgtcagtaccagaacaccctgctaaaagagtggaaaataattgcatctcaggagcaggatttggagtagctgggcaagggaatgctgttttcattgtaggtttttagtactatttgacttttaactatgtgtatatattactctcattttaaaaatcatttaaacatttattttctatttcaaaacttgatatatatccaaatttggtatgcgccattttccttaaactttactatgagatcctgaagaactgtgtcatgtatttctttatgttattccttgttcccattcattcacttaacatttactaagtatgtcaatgtgtttttgtgtgctaagtttggggatataacagtggaatgtgcaggatgaagcttgatgcttgctgggttgaaaaaaaacaaatgagctttcttctgaactgaggatgttttttagcccttagcaaacatagtgcattgagtagaagtaagcatggatgaaggtattgaaattcatattctgtcttctctgtaactgatataaacttcttcataaacccccatcctgctgagtagttggaacataattaaatttgctccttagagttatctggcttgtctgctttaacattcttttttcatgtaaatatttgagtaatttctaaatttaagtccctattagagggctgttccataacttgccctccatctttttgtgtgagtaggcagttagaagagcctccctgtgagcatcactgctcactggcagagggaaaaagagtgtggtgaatcacacacaggcttttaaaacttcagagtggacacaattcacttctgttcctccttattggctaaaggagatcacatggccacttggtggacagtacttgacttccccaccaagcgcgggtagtcgagggggcggctggcggggtggtggtacttcaagctgcacagctgtggggaacggagccatgtcttctttacagctcatacaacgccctgcaaaaaaccagatatctgggaaattctgatatgaagaatctagaagaaagaaatctagaggtagaaaaaagagcaggagtaactactgactaccatttggtctcaaattcaaattaattaattggtgggacaaatgtggggcgacaggaaactcatattggtaggttctattttgggaagacaaaaagcagattagtttattgactgaatctgctggaacaggaggaaagagggattgggaaaacctaaaactgactgtgaggagaactctgctcagtaatcggatgcacgattcatttagaaaatattattttatgtgcataaaagtgggattgctttcccttagaatttttctataattttattactattgactttctccttaggagaaaaatttaaatacaaaagattcaggagtgtgagtgaatacttaggttgtgtgtatatgtattttgattatatattggaacacgttgcataattaaacttaaatattttaatggtatctcatttggtatatccttggaggataattggaactcaataaagaatattccctctagtgtgttttgtttttacataacaaaggcagccttaatgagcctttatctcattacaatgtaatactaatagtgatttaaatataaaaatgaaagggaaaatttatcataaattttattctcttttaggcaaataatactgcttaactcattcatttttctgattttaaagtcagcatttgattaagataaagcttactgataaaagatgttgacctttttgatagcaagcacatttttggcattttgtgaaaagatgagacaattgcaaagttttaggaacaaggaaaataggccattttaacatattaatttggctaaatcagaatgaaacaattaatagtattgttttaatatcttaaaataactctgtagccttgagttcaagagaaatacggcatgttagtgctatgttattatttatggagaaaggactttcacctttgtgtttttttcttaaccttgttttaattgatcaaataatttaaagtgtgttttctcattatatttgaatgcattaatatttaataatatcattctttcatctctgtcattcaacttatcttttctatttaaccgtagatgaaggtattgtggaacaaaatgcaaattctactatgccaaaaaagcagtaatctgtacaacatattcttattttcctagatatatacccagcataaccaatgtggaagctgctttccccattggtatctatccctgaatcaatgatgcagtcatctgcaccagccattatgatggtggaaatgactggccagtcaagcattggccattaattttgaatacatccttgaaaatcatgttgaaaaataaaatggtcagcttcttttaagtatctgatatacctctggactgattatggggactactgattattttaaagctttattttgtcaatggaattttacaggttttgacaatgaccttaatatatttttaaataagaataaatatgaaaaaagaataaatatgatctctatcaaatgtgtaaattttgtatctttatgaatagtttatttaaaagagtaatgctctgtttttttctatttggtttctatttttttcaatctttaaaaacataacctttcaaaagggtaacggtttctggttgggattattagaagtatgttgtttgctttatccagagttttacataatgttatgagttagtcgcaccaggatcaaagaagtttttttaatttgtatgatttcttcagtgttttaaagagggatgtaattttatgacaatagaaattaatgtggattataatgggaagcaaatttaaaatataaaataaaatttatgcatatatgctgacttttaaaactccacttcaaaggaactacctcccagcaagataatttacataagccctttatttaggaatgaatactaaattcaatagaatcaagtaaaaaatagtaaacttgattacacatacagcatttagtattcctatagcacttagtagtcatacaatacatttgatcttttaaaatgctttagcaacaataaggtacatttcttgtccgtatttctctaaggaaataagcaagtattactaagaatctatttgtgtaattcaaatactaagcacctagttaagcacaccattttatatttcatttgttccagaaacatccagccacttttggaatataaatgtacataattgaccctcactgctgatttcttttggcagttggttctgccagactgcttctgtatagttttcttaagtcatgcaacacaaacttgaggctaagacatatagtacctgtcagtgccagtacctaataaatgtttcctaataatcctgacataacattgattattcccttggaatacaaattgttattcctgattagtgaagcatatttcagattatttaggttgaggttttagttatatttttgctaagtgagagagttaccatttttgtttttatttttagtgttaggaagagtattttaatttgggtttttagctctgttttttccctgactcttcaaagataattgtaaagtgcctgacgtctgaagatgttctagtactctgaaataataaagatgaaatatatataggttcagaatgaacagtgtaaatttagaaaaataaaagaaagattttatattttatccattgataacgctaaacctgaaacactaataacaacttgtgatctctctggtgctttactctttttagaatttgctcagattatttttgtttctcacagtagccatttggtagagcatttatcaataccatctatttagacagggggaaccaaagttaagaaatgtgaagggaatccctttaggacttagaactatcacttctgacttcaagtctgcgccctcattttacaccagtggttttcattcattggctcagaatccacaggggaggcagatttagggtgaagcccagagtcactgccaggaaatgagcattgtgcgatgtgaaacaataacacttctcacacttacgtgtactattggtttgaattatatgtgacatgaagtaaaaatttatttaaaagcattactgattcagtaatgattcagcttagcctttatgtattttgctaataaataccagaagtacagcctctatcaagttggtagatcctgccttgaaggcagccaaagttgcggttcagtccctgccccactactgctggcaacatgatgtgcaacacgttccttgacttctgtgcctctatttgctcatctgtaaaatgtagatagtacttagacctagcttataggatgtcatgagcattaaatgaaattatacatggaaagtatttaaaatgctgcctggcatattgcaaatactcaaaaactattaatattattttaattattaatagcgtcattataatatatagttccatgaaatgtcctcattttaaaaagggatttttatatttcaaaaatgggaatgacttctctatactatactgcctgcgggcctccttattttggtttaaattggcaaatgctgggtatttcacatttttctgcgacttaaaaactcaacttttagttatgatataactcaagcttagggcatgtagcctcaacaatggagagagaaagctaataagatcaactgggtgtgcttgggcttcacttccttgatactcctggaagtccacctcggatgtgtcttaggcctggaggatcatggacctcatcttttttaagctctcattttccattccagggtgcatattgctagtcactgtgggaaaccttgtaaaaattattaaaaactgggaaagaacaagccactctgtgagcaccttgttaaaataaaccacttcttcctaagctcaagacagcaagaaacagtttaatagcaatgaaataaactcaccacctgtttgtgcatcagcatcaaagaattctaacaaacataagaatgctttgatcattttcagccagaagaaaattatgaagctcttcattgatagttcatggggaatttggggacactgatcaaagaaaactgttagtgctatagactagaaattaagatatctgcatataagctacttcagtacattgtactttcagtggtgaattgcatatttaaaaattcaaatggttgtcttacgattaagctaaattttattttagcctctctgccctaaaataaaagacattaaaatgtttttttaagcaactttgttcttttgttaatgacttccagattatctagttgagatgaattgagagggcagtgtgtagtttacactttgcagaatccctctaagggattctaaacccaattgagcagaattattcaaatgagagaatgttttgacattctttgatgatctttaagaaaaatttccatatgtttttcaattctataatagggttatatgattatagatttcacttttaagtactgtaataatacagctgagtggcttgaagaaaaggatagcaaaacttttataataggaaagagtgtgtttatgcattttgttgtacaaatttgaacatttgaaatggaaaacataagaatcatttgaaaatacaactatgctatgagagaaaacacttctgtatggatagcaccagaaacagaagacaaaggtcactgttgtttttaagtgaaaatctagacatttcctatagacttttaaagaaagagaatacttattttgtaactgcatggtctgggtctgagctggtttttgcatgtagttaatacctcctgcctctgaagtcgttggaaagcatttaacaaaatatatattaaaatgcttcaggaataactagtatgcctaaggatgtggaatcaaacaggaaaaaaagtcacaaacatctcattaaaaatgtgttgattgattgcaagaaaaacagaaggaaaggcagatccccaccttcagaccacatccactgaagcccggtacactaaatatttgcacttacatgcggttaccctccctccattctataccaacttcctcctaaaaataaaagaaactagtaacacaaagacccacaaaagaagcagtacaaagcattaatgcaaaagatctttcaatacctaaatcagtgggtcaatctatgattcacactttttttgaaaaaaacatccaagatttgaaatgtagtgaggtctttgacattactcgcaaactagttcctgaaaaattttactgaagaggaacaaagtccattaatttctgaaatggcatattacggacatagtctctaagtctaggttctgctgactgacttgcttcatgagttaaggcagagttcacagaaggttgtccaccaaatagctctgcaaaaccagcccaaaagtctgttcccctgactcaacaatgtttcaaggagaaagtaggtgatagctgaagaggtgttttgtgctcttgtgaaactaaattttatgtaatgtcctgagcttataaataaataaggtacctggtaggcaaattaggatacaaagaagtggtccacttctctggcatcatctgtagtggttaatgctttccgctgcagttcacccatctcttgagaacttgacagttcagtctttagagtaaaaagatgtgtgctatttggaagacagggatctgttttattttacagtaaaatatgccagcattgaatttgatacatgtgttaggaagcaacatttgtattagtcaaagctgaggaatttaattaagaattatatgtcttgttattttccccgtggaagtatttacagggctgagcgatttgatgactaatggacatatttaaagggcgtctgttactgatcatggaaacaaaaaataaaataaaataaaattttttacttttggcaagttcttattgcagtagaatcatatgctgaatggtacccctgagattttttttcagcatatatgttctaataggtacccagccaattttgacttgcaagggaaagatacttcaaattggctgcatgttagaagacatgaatcccaaacaaatctgtgtgcagaaaataccattcaatttgctaggtcttgctaatgaagagagccttaaaaaacaaaccaacaacaacaacaacaaaaaacagcaacttggtacacctaagtgtggtaaaccctgtgttccacctagggtgaagtttatcttcctagagcaagggtgtccctcagtgatcacaacacagatgattttaaagtttcagctagtaatgttaatgagaaaagctggccagttataaaaaaaatagaaagggcaaaaaacaaatgaacaaacaactgcacttgagagctgagcagcagttttaacagctactcctagcctcagagactgagagcagatagggagcagtggggacagtggcagtctgcggattgctggccacgtcaaaaagggagtcactacttggctcagctaattgttgctgtgtggaaatgtgagtccagtgatgccagatttttatggctcttcaagagagtggaaatctgggttttatatgaaatctttcattttgaaatgtttattcagagctcaaatatgggggaggagttgggaaaaaacccatgcaggccaaaccaaatcttcttttggatcaatttgaaccataggcataggacttcgatttgttacctactgaattagctaaatgagtaatgtttataaagttgaagagggaatgtttcctagtatatgaatggaaaaaagactaggtgcgtagttaagagcttcaaccatggcgtcagattgcctgtgtttatgtcctggctgggtaccatgggcatgttaccaattcgctttgtgtccagttgccacttcagtaaaataggaatgataatggtacaaatttcatagagttgctgtgaggattcagaagagctaatttatataaactgcttagtacaatgcctggcatatagtaattgctcaataaacatgagctattattattttgcaagaaaatggtattcaaaggatttacctatttgttatacctgaagaaaatatccccaataaatatggagggtctgttttgtgttgaagagtatggattaagagcatggattctggagtcagcaggctaggatttgaattcttgctctatcactgtgtaaccagaacaagttaatttttctgagctttagattcctcatctataaaacagaattaataacccatatctcaaagtcataagaattcagcaagattatacacgcaaaatcagtgctggcatatgagtcagtaagtgttaactgttgttatgattattctttaggatattttcccccattatttggaagttccatttttgcaaacacttttttaagttatttatttcttattatatgtacttaaagaaaatggaattgcatttgatttacaagttaagcttcatcttaatgagccacattacaacagtggttctcaaccaggtgattttacccttcagaagacatttggcaatgtctggagacatttttgattgccataactgaggggaatgctactggcatctagtgggtggaggccaagggtgccgctgaacaccctgtaatacacaggacagcccctacaacaaagaatggttcagcccaaaatgttgatagtgctgaacttaagaagctctgcattacagctatatagccaccataacatttagtttgtaatgttcttgctaagcagaggaagaatttttcttttatcaaaacattacctaactttcagatagcagttaacatgtaaattgaaatctgtcgaaccatatttaataaaatattttaaaatgcatatattcctgttttcttctagttacaaaagtaatacaagccagtgaaaattaaaagactacaaaagcatataaataagacaatgaactccaccttttccccaaccatctccatagaaaatctctggaaatgcaacagtttaagttatattacttcagacttttaaatacagtcacatgcctcataatgatgctttactcagtgtcacgacacatatgtgatggtggtcccataagattataatagagctgaacaattcctatcacctagtaacatcgtagtcatcataatgtcaatgcattactcatgtgtttgtggtgatgctgatgttaacaaacctactgccctaccagtcacataaaagtctggcacatatgattgtgtatagtacgtaatacttgataaagataataaacgactgtgttattggtttatgcatttacaatactattttgtctttattttagagtgcactccttctacttacaaaaaaaatgttaactgtaaaacagcctcaggcaggtttttcaggaggcatttcaaaaggcattgctatcataggagatgactgttccatgtgttattgcccagaagaccttctggtgggacaagatgtggaggtgaaaaactgatattgatcatgctgatcttgtataggcccaggctagtgtgtgtgtgtgtgtgtgtgtgtgtgtgtgtgtgtcttcacttttaacaaaaaagcttaaaaagtttaataaggtttttttttaaaaaaagcttatagaataaagatatacagaaagaaaatattttatatacttgtacaatgcatttgttttttaagctaaatgttattgcaaaggagttaaaaagttaaacaatttttaaaagtttatgaagtaaaaagctacactgcactaagattaatttattattgaagaatatttttaaaataaatttagtatagcttacaggaaactgcataaaatctcctgtacagtgttataaagtctatagtagtgtacagtaatgtcctaggcctctcactcaccactcactcactcaaccagagctacttccagtcctgaagctccatttataagtgccgtatacaaatgtaccatttcttatcttatatacagtatttttactgtaccttttctatgtttagatacacagatacttagcattatgtttgagttgtttccagtattcactatagtaacatgctgtacaggtttgtagcctaggagcagtagaccgtatagagccttggtgtgtcataggctataccatctaggtttatgtaagtacagccaatgatgttcacacaaggatgaaatggcctaacataacaatgcatttttcaggacataaccccatttttaagtgacacacgactctctatatgtatgctgttctataatttgctgttcaaaaattgatgtcttttttcttcctgaccggttcagtcctaaagcaactatctagggcaaagcagggtagaaattgaggaagggtggcctggcatggggcattggagcccatattaggtaaggaggcatccgtgtgatggggttggtgacctggcatggagcatcagagcccagacaaggtgaggagggcatccatgtgtgtgcagcctggtataaggtgttcacaaagggcaagtgagataaagtacacaaagaggaaggtcttgtgcagggctttgagcccaggtgggagaaggggcagaaagcaaggaaatgttcaaaggatgataggaatatgtcaaaggctagcactttggaagggcgaggtgggggaatagcttgtgtccaggagtttgagaccagcctgggaaacgtggtgaaactctgtctctacaaaaaatacaaaacaaattagccaggtgtagtggtgcatacctgtggtcccagctatttgggaggctgaggtaggatgatcacctgagcccaggaggtaggggttgcagtgagctaagatcatgccactgtactccagcctgggcaacagagcgtgagaccctgtctcaaaaaaaaaaataataaaataaccgcttcaccaaaacatattaattataaaggggaaaaaaatagtaacagtatggtggaaacagctggaagacatcaatttaatcaaatggtcaaagttaatattgtcagtaatgagacaagtcacaatcatagccacttaataaaatgctatggtagccagcttccaagcagatggtcctccccacctagctattcatgccctgggtggtcttctccttcagtgggtggggctgacctgtatagccagcaggatgttagagaaatgatggtatgtggcttctgatgctacataataaaagactgctcactctgggggaagccagctgccatgttgtgaagacactcaagtagcccgagagagaagccacatattgaggacatgtttttttgccaacaaccagcactaacttcccagccatgtgagcaagctgtcttgcaagcaaatcttccagctccagtcaagccttcagatgactgcagttctggttcacatctaaactacaacctcataagagaacctcgcagctaagcttttcctgatacacagaaactttgcaagataatgcttattgttttcacctactatgttttgggataattagatatgcagcaatggacaattaacacagatatagtgagaagaacacaccatcatttctgtcatactcctgccaaagatacataacctgaatctggtcctaatgaaacataaaacaaacactgattgagaggcattctgcaaaatagctagcctgtaatcttccatagagtcaaggtcatagaagctgaagacagactgagaaactgtctggagtgaagcagactggagatatgacagctctctttggaacacctgattctgaactggattattttactaataaaagacattattgggacagtgggcaaagtttggaacctgaggattagatgttagtaatgtatccatgtgaattttgttattttgatgattttattgaggttatgtagtagaacatatttgtttttaggaagttatactaaagtgtttagggatgatggagcatcaggtcagtaactctaaaatgattacggaaaaaagttatttgtactatacttgcagcatttctataagtttcaggttctttaaaaattttttaagttatgccaaaaatatgttataaaatatgcctttggaggccaggcatgatggctcatgcctgtaatctcagcacttcaggaggctgagacaggcagatcacttgagctcaggagttcgagaccagcctgggaaacttggcaaaaacttgtctctacaaaaaatacaaatattagcaggacatggtggtgtatgtctgtagtcccggctactcgggaggctgagacaggaggactgcttgagtctgggaggcagaggttggagtgagccaaaattgcgccactgcactccagcctgggtgacaaagtaagaccctgtctcaaaaaaaaaaaaaaaaaaaattgcctgtggctttaaaaatagacacatattgtcttttttttttttaaaggggtgcatagcattctggtttttgtaactataagtttttttttccacaaatctcctattgaaggacgtttaaattgctttcagttctttgccattataaacatccgggtctttgttattacgaacaatactagtaaacatttttataaacatagttgtgccttgttcagtttttgcctaagaattaatcctcagaagtcaaattgctatgtgaatggatatgtgccctttcatcagtttaatcgtaagtcattcaaggaaactgcataaaatccccttacaagaaaatgaaatttacagtttggtagtcatttttatttgtttctctcccccagaaagtaatttctataagagtgggaacgttatctgtcttgattatcaccgtccccagcattcagagtctcaggcattcaatatatatttgttgcaacaacaataatagggaatatttattatgtgtctagcactgttctaagggtattaatttagtttttgctggcaacagccctacgaggtaggtaatatgattacatccattttgcagatgaagaaactgaagctagagaggttaggtacttgtctagtttcacacagctaataaatagtggacccaggaatcaggcagttttccttcagtttacaggtatccactatgctgtacagggtctcttataaatgaatacacgactgaatggtcaaattggttaatatatttatttggctctttgaccagtaacaaatgccagctatcttttttttttttaaaaaaaaatgaaaattagagggaatggactgcctactttgtaagagccaaattagttttatggtcttctggactaggctgtacttaactacctactaatactcctcctggaattaatatccatacaggtataggttataaatcattcttacctgaagattttatggatatgtaaacagaacatttgctttgtattacaaataaaatagtaaatctgggcctgcagcttgagtctaggaggcagaaattttattactttatgaacatactctgttccccacctgggctcctttgctcctgccatttccctgtacctgtaatgctgattgtccacctcccacagtggaaactctaactgtcctccaaggcttgctcagtagccaccccttccactgaatactgcttttactcttcttttttcttgccctccttttgaggattctttccttcttcaaaattctgagtctctttttatagtactcatatagaatactacattctaaatataccttatgttactgtgtagagttctcatctcccttaatagactatattcttttttagttttattcattttataaaactccagtatgtattataatcttttgtataaagtattgaaactaagggtttttttttttttggatgagtgaaggaattatctcaatgaaatatctgaaatatatttaaaatttttaaatcttaaataagaatactaataaaatttgattattatatgttctacattatccagaattataaaaaaaataaaataggtggacatgttttttttttgatctgatgatttgtattttgtctttagcttacaagtcatccagaaacaagaagcataattagctttcatttttataagaccttttgttctattcatggctacaaataccaactttgcttctacccacaactttaattcccttttctttaagtgggtggtttagggacatcaaaggtaataaaatcaaagagataagtggaatatttttttcaaaggctagtacttaagggtgtgttcctgttagagaattttaatacttaatttgttttcaagtgtttgtgtaataccaaatctccttgccaactggaagagggactgtccttgaatcctgttctgaataaaatattaaaatataatcccttcttcatatatatatatatatatatattttttttttttttaaagaacttcagggaatgtgaagtattgtcatttgataggattatactttgttgctagcaaaggcaatagcatagccttcctgccaattgtttctcttcctccagaaggagttctttcctttacccacaggataaggataaagctgaaggtttttgtttctgaaagcccaaacagcaagccaaagagaaagttcaaacaaatattgtcagtcttttaaaaatgtcattgcttatgtaaattagctgacccttgactgctggtgagcctcaagcatccttgatttggttggatgttaagtcaggttttatttatatttggtatatggtatctagaaagcacttatcatgaagaatctcacttcatttaaggttagtgcttttttatttgttttggttctaggtttttgttttgttttgttttagattagcttcactatcttgtgatttccagaggctgatgtattactgtgaaacattccgatatgatttttccttattttttctttttactgttacacatcttcccatcaaattcatttgagattcttggaacgatgtttatagttactgactaaaataaaactttaatctctttctttggaagtacagtatttttatattgtgaattatacagttttaatttatgccttcagactaaaatttgcaggtttgataacatagttttaaatatattcagtcaaaatatgaatattttcaagtttaacctagttgagtcctcttataaaacgttgagctgtaacattagttcttcatggcctctcatttgtattaatgtgacgttcttgatcataacctttgaagataaaattcatttggggggcagctaagattctccctactctttctaattatgttgtaaaactccaaacttaggaaaggatatcttttggaaggcatgccttatgagtacaaaattattattttgcttatgagatgcaggatttttaaatgggcatttacatcttgtgtatcatgttagctgtagagtttttgtttgttttaaaataattctgagaacttgggcaattctgtgatgatccttgggagctcttggtaggagatatcattcctcttggatctgtagctctgtgatgcatgtatataagcatgcctttgttctcaaaagtctttttctatctgattactgtggtatccagtgctttgtctttgcctctcttcgttttttgttttgtttttttccttgcgccttagccggtcatttgtgtgatgtttacattcagcagagaggtatttagagcatttttggtgagagaaaggagtgatagaggaagtaaagagaaattcagactggggtggctgtgagggataaaggggggaagaagtaggaaaagaaaacaggagtgggtccaagggaggaagagcaagcaaagacagaacaccggctctacaggggctgcgccgtgggggttcctgaaatcttgggggctggctgtgggggagggagctcaacagaccagcattttccccaggcttgggcgcaaccttgtgaaactactaatgtattaaagaacctcagctgggatttgctgaggacaaatgctgtaacgtgttagtcatccattatctgcttctatttttgcaggttctgaatgatgactgacgcgggtttgggtgatacccctcacagcccctgtcattccggagtcataaggcacccgcgcgtctagccccagcgccagggcacgcgagcggcgctggagggaggaaagcttccgcctgcgggccggacaaaagtcccgcctgcccacggctttttgcccgccgctcgtgaccgagacgcctcgccgcggccagctcgctgctctcgctggcggatggtgtgtggccgccgcaggacgcccgccgtgcccgggccatgaagtagcggctgctggcggcgccgctgcccaaccgccagccccagccccgcgctgcgctgcccggtcctctcccggcggggtcgtatcggcgtggacatggctggccgcgtccctagcctgctagttctccttgtttttccaagcagctgtttggctttccgaagcccactttctgtctttaagaggtgggtgttcgttgttcgggtgctttctgtgcatgctgttgagaaatgtaatcacttttatgaacctgagtgttggcaaaatagacggggttgatgttctttgctggaatgacttggaattttaccacagtaacttcttgtgaagtcccccgtgcagaaaaagcccactgcattgtagccaagcagttctggctttcaaaactccaattagaagttgtgatttccaaaactaatcactccctctgggggaggtatttcaggaactacaatatattcgcttagttttgaatgcctgcttgtttataacagctcgaagaataaaatataaggatacatcagtgtcgaggagaagcagatcatagactgtaatagctcacaaggaaacactgagctgtatacaaacgcctcataattactttattaaatatttatgtacttgtacatttgtaattcacatcgcagtcttttatttcttcctcctaacagctctgcctcctagcaagattatggttggctttcttgtttctagctagtaattctggacactgaaaatagttacagaaatttttactgggtcatggttaatatttctgccattagaaaattggcatgcctgtgataatttgtaatgtattaatactatatcttcattaacttgaaacagatatatgttttgacatatttttatatgacataattttttataaattttcaataaaaacaagtttttattgaatggagttttaaatgtagcctggttgattgcattggttatattttatttacaaattaggtatatattgttattggactataaaatgaaaatctgagtatgtttacgaacattgtgtagtcatcacatctttagagttttcattgggtttaaatcaatcatctttaaggtcatagaattcctttctttccccttctcatgttgagtttagattccattatgttcaagaatattgaaattgccctcttttttaaggtttaaagaaactaccagaccattttccaatgaatgtcttggtaccaccagacccgtagttcctattgattcatcagattttgcattggatattcgcatgcctggggttacacctaaacaggtgagaggaattttgtctttcattattcacttgttctggatacaatctataattaaagtaaggaaactgcatttacagctgtaggaacttctttaaacgtaggcatttgctttcaagactccagctaaggctagaataattgaatattttaaagagggttaagtctttcaaggtgaatctttcacttaaattttgtttttaaaattttacttatattatcatttgtggtttgaaatggaatgtcgaaaatttacattttgagattctctgtggagtaatagcctctgtaatgcagcatgcaagtacgcattaaaatatgaaaaattattctaataaaggaaaatgatattgagcagctgcatttaagctagtttgtttaaatatccttttattgcaaccacaagtcaagaaataaaaacgtgtttactgctaagaatttgaaaaacaaaacattccactcttttaaaagttaagaaaactgttcatacaggtggctgattgtgagttttctttaacctgacttgctcgttgtaagagatgtattttgaaataatggcaaagctcatataaatgtgacttatagagcattttgtgtagaactaggttgctgctagggctttccctcttttaggtacacgcaagaagctcaaacccactgctgtcatgtgtgcaaggtgtttcattaagcataaaaaggccagaattaattatgctttgcagccaggcagtgcagggatttatgtgtgtcattaaaagatagtcctctccttttgaagggctgcagagacagggaaagacctggatattgtagagctgcagtggctgatgactcattgttgcagataacattctatttttcttttcttttttattttattttcagtactaggaaaataaagtattcgtattctacttattaggcagaattccctttgcaattgacatccagaagctttagagaatacacatgggcctttttttgggactaagaattggcattcatttatttgaagacctgtgtatgattgtctataactaactaccactgtaaaaatgactttcacttcctcctcatccccaaatgaccatgcagatgactttccatgcattcagttgttactgtgctagcttttaatttcataagctttttatttagtatttaaccgcaaaaagtgtaatgagattgagactaggagagaagaacaacagttgctcacttatgaagtgtgcctcttttctcacttttaaaactgggtttcccccctgtatttgcttgaactgaatgtattttttttaaaatatccactaattgggttttcaagcactctttccccacaagaatatcattattttatcaaatagtcttttgtttggttcattattattgttattctttcttctcattatttaagagtaataacatttaaattacttaacaataataatgggcaactgtgatggggtcagtaatctcagaaagagatcttagaggaattgattataaaaagtcatggaggagctccattttcataaagtaaaatgtgttcatttttataatcctataattatcaaaataactccatggggaaagaacatacattgtttaaataattgctttttattttgcactatctgtattcaccttggcctcatgcagtgcatatttgctggttgcctttccagcaaatagctggttgcctccttgctccttctctgagactatgtgattcccaagagcttcctacccagactccagagatggaacacatggaccgtgattgataattgactgtatcccgcctccctttccgcaatgattggttcaaaagaaagtgtgtgatttagaccattcaaatcttaggacttttgctgagaatgtatttttctgttgcatgtgagcagtaggcttgtcttgctagggtctgctgaattcatgagggagccatgcctataataaaactaacaccatagagggcaatgcagagagattgaaagaatgtagtgcttggtgacgtcactacttatgcagtgttcagttatgttagcctttctggtttgaataaagttgagttgggttttgtcttacttgcaactgaaactactgggtaaatgattcagttgctctgcctgacagctcagaactgcttgttgaatatttcttccatttttttcccatcactctctgttgaccatgtgccatgagtatgtaacttggttcagctgacatacagatcttatactttgtaaacttttatgagaaatggtagactatccattgaatatgcccaggaagaggtggatacagaaccttcagaacctctttccttctgaatttggtgttctagtgaggaagaccaagagctctgatgccgtaagtacttttgaagaaagtattattttcttaaaatgaagataaaaccaaagttttacacaagtccttaagaggaaaggaggtgaaaaaaagcaagacagaataatgaaaacgtattagagggaagaaacaaaaggtagaagggaaataagaagagttgaccgaaaaacaaaatgaaaaaaaggtccaagaaaatggaatgatcaagaacaaaaataaaaggaaaaaaatcaggaataactagactatgaagaaagaacatctaaaaatcataaaagaatagaggttgaaggaaaatgtaaaaacaaggaaagacattgagttaaatggcagaggatttttttttttttgatcgcagacaatcaagaagagcaacaaaatttaaagaaggaacagagaagaacttgagttgggaattgagagacatcatgttgattaaagaaatgtattcattccacaagatttttttaaaataaagtacatcttaagttttggcaataatgaaagctatatcaatacatcttatgtgtatcctttctttggaaaacttgagattgttaggtaggcttagatagagaaacaagcagatgtagaacagaggtggaaagaaccttagacataatacagatagtgcaactaactaattttacagatggaatacaagcctagattagtgtcttatcaaggatatccagtcatgtcaggcctctgagttgccattctgccataccacaggactttaaagtggcaattaaaaatttctcccattaaactagatccagtgagtctgggaaaagtggtttattatctgttgcaatatcaattttataatcaaagtaagcttattctgtctcttctctgacttaaaaaatttgaaaatagtttccatccttttttagaaatggataatcagtgtttaatctctgttaataggtgtttttccagcctttgggaagattagagagaagagtaggcaggttttaaatagcctatcatagagataaagtcaggatctggtgttccatggcactggcttcaaatccagcagagccatgaagtggtgatatcttgagactcctcttttagcactgtttctttcttatttgattccctttctcacccaggacccactggacttttgctgtcaccaactctcatatcaaaaaacaaaagaatttgataaactgccagttcatggtcatagtatggtgatatcaatttgacatgttaactatccctttggtgttggatttcaaaataaataaaggtataattacaatggttttccataatgtttattgcctaaatctaactcaaatccaggggttaaacagatgcattggggctgggctgacagcatctggcctcagctcttgcagtctcaactcaaatttgtttcttaactggctagtcctgttccttcttctgtagaaaggataataatagtttattatcccacactaccaaggttgttctgaagactgagtgacataatgttcagttgccttgcacatgataagaactcagaaaatgtatactaatattattattacttgtgttcagggaaatgtgaatgcaccttgacactagaaagaaattgctaacccttaggctttcagcaatggcttcatggagaagctaagacattgcaataattgtgaaggagatgaaagtgaaccaaatgaagaaaatagaaagtacaaacctaggcaagagaaacctggataaagtactcaaagaagtaaatctttcagtgtccttaagtattcataagtagttgttttcattaaaaatggacctatcataagagaataaaaggaacactgagaatagatatgcttttctcagaaattcttatacatctttatattgcttggaggagaagttattaaaagaactctcatcggtttgaaaccttttattttatatatatataaaatatatatattatatataatacatttatatatattatatatatatatgtatatttgaaataagccttgattttttttcagtgtctactttcctaaggactttatacattgaccttatttaaaaaacacttttatctaatgtaagtactttcaaatcctaggtttatgtagcattctatttatttgctatttgctcaacttaggtcctctgtgttcttagcttaagaacttacaagtgcaaacaaatttgcaaaaactaaatgattttaccaaattaaatatcttccttgagcctaatttcttaaagccttatattaattgaatttctttcaatgaagatgttttaggctgtcattagtgtaatcattttcctcccttattttggcagtgatgatttgagaactgtgaagaaatacatcttaccctttctgaacctcttgcaaattcttgtctcattcagcatttgtcttttaaaggactcttcagatcatgcattgaaatcagaaagcagcctatccctgtgtatctaagcacatatatctattgccaggaatcagaacaattctgagtttaagaatcacagcagataccccagagcaacaggttgaaaaacctgaaattagaatcttaagttattacttattttaaaatattgatgaaagaatgttgtcgttgaaatgaaaccagaatgaacaaaatactcctacaaaatgttctcaaaatcttcccactgtgtttcactttgctgttttctcaaattaacagtcattagaaaacgttaagtaacgtactttaacttcttcattttctaacatgaggaagagattcccttgcctccacaatacatgtataatctgtaaaaagaacccagctttcatgggcttttctttctgcactcctgtaaggaatcagttttaaaatatcaaaccataatcataacatcatttataagtggcagttgctcagaatatctgttttatcagaggtaatatacaagttaaatgcagaattgtttttattaaattcagaatgccaattaaattagactttgtatgtatgttacttagttgttcagaagcttggcttttgtctagttttcaggctacaataacgttaggtctatatattttttaattccatcattgtgtaaaaaagatgtacgtatcctcagtcagtgctaaaaactcagagtaaaattagcaacggggcctacttgagggtggagggtggacggagggaaaggatttaaaaactacctacagcctactatgcttttacctgggtgagggaataatctgtacaccaaacccccatgacatacaatttacctgtatagcaaacctacatatgtactcctgaacctaaaataaaagttacaaaaaaaaaattagcaaggactccagaaaaaaatgatactttactggaataagtttttagtactttaggggttgtgatttccttatcttttctctagttgttagtatataatatttgtattcttttgaaattaaaatttcagtctttctcttggacataagaataaaaggaagggagacaccccacaccaccatttttctgtttcccctcataggctagcttgactttgagtttaaacctcactgcagaaggggagaaaaccaacagccttttgggcaccagctggtgggatatctattatactctttttgagaaaatggatccaagctcttcgcgaagcagctgtgcgattgctgggaagtgcctaaagaagatccccatccaactccaggagccccatggatttccttatcacctctgtgtggtcagcagccatggtccagcctaccttccctagtgctgtgatctgtccaccactacaggcccgaccctcgtctaattgaatctgtacagcagaatagacatagcaaatgagggttacttcttgagtcaaatacatttgattgggaagagctgcctggaaagtgttaagaattatgagaccacattgggacttgatgggaaacggtgcagcgacccataaacaacatctgccacgaatgtgaaagataaaagtcgctccagtggccagcctctagaaagaagaatcctgggtgaagattgattgcattgtcattgtcttaaaatgaatatgagtcgtggcttttagtgtttcgttttcttctattttttttctcctttcagagaaaataaaactagcatggtgatcttcctattgaaggaggcatattgagaaacatcctaattctagactagcatttactttttatttagaaagacttatgcaatgtgtataaaattacaagatttgtgaagagagcaacaaaataaaatgctgtatctcctccctccccaaattgagaaactaatattatcttcattttaccaatgggaaagctaatagcaaagaaaatagcatcgttattagaaaggatggccaccaagccctttttttgtttatttagctgtgacacattcattcttttttccctttctattttgagagctcaggattgatgtcatttaaaacaatacatgtcaaaatctcagattagatctatttgtatatttactctgctttgtcggcaagtgtcaagtatatgaattaagtagattacaaaaatgttaaatggcttttgtaaacgacaaattaaagtcacttgtcatccactgtcaattgtttaagtttaaattatgatacttcctctttatttttactgaaacttatttaacgttctcttagggaagatacgattgaactattaacaatgtttttttttaataatagaaacatgctacatatctgggttcagaactgcaagtatgagtatacattgaccattttttcctttctttataaaaaatgagaaacagattttttatttcttataaaaaataagaaattgaaaattattttcaatcaattttgagtatgtttgaattaacatgatgcttgagaatattttaaaattagctacagtgtaaaagactccttatgatcacctattttctcaataaggttcagagtccttttgctttttattttttttcctagtaaatattttaaaggagaaaacatacttagtgagtattcattatgtaacactactatattgggcactttacgtacattgtctcattaattcccataaaaagtctgtgttcaaggcattattatccccactttttatattaaaagttgaaactaaaagagattaataacgtgttcatagcaaatagccggtaaataggagaacaaggatttaaatacagatttacttgaatctgaaacccatggttcattttgtaattctgtgctgccaatctgttaatgatctgtctcccacagaattttagtatatgtgtttttatgtgtgcaggtgtgtgtctatacacacacacatatatttttattctacatatattgtagaatataagctctcttttattaaacaaaatatatgttactggcttcatcctaaattattatcattattattattattattatttgaggtaggatctcactgtgtcacccaggctgaatgcagtggtacagtcaaagctcactgctacctcaacctcctgggctcaaaggatcctcccatctcagcctcctgagtagctggaactacaggcacacaccaccatacccggcttaatttttttatttcttttagagatgaggttttgctgtgtttcccaggctggtatcaaactcctgagctcaagtgatcatcctgcctcggtctcccaaagtgctgggattacaggtgtgggccactgtgcccagcccatcctaaatccttgaataactttttcttatatcttctaatgcatatgtagaaagacatgctactaatctgaattctggcaagatattcttggtcacttggctgttaaaagatgctttgcaatgaagaattttttttgttgttattcttgtctaaatctaaactagaggtcagcaaattctttcttaaagaagtgtcatataataaatatttttgacttgtgagccatataggttctgttttgactgttgtagttagaaagcagctatagatactatgtaaatgaatggcttggctttgtctcaatggaaaactgtgtttactagaagaggcagccagcccacaggctgaagtttcccagtcgctgatagaaacaattgaatatgccatttaggctaataaatggatttaacctttggcatctcatgaacaatgtcttctgacttacagaacagaaagaataaaaataccaatgcaaggttaacagtgctttgatctttgttccttagttacctattcagttttcatgagtaaatgattataaacaagagttctcttatttggaatatcgtatttcagagctctccacctcactagatggcaattcccgtggtataatttctctcggccaaatacactagagtctttatttatggttcttttctccctcagagcctgtaaacaatatgctagtaaattcttttcatcctgtcttccaaatatcttccaaattccagccttttctcacaacagccatcttttcaactctggcccaagcaccatcctctctttcctggattattataatatccctcctaactgacctaccttgtacccgtgtacccctgcaatctgtgctccactcagcagccacaaagattctattaaaacagaagtcagagcacattgctcttctactaataccattgaagagtttcctgcaccactcacatttaaagcccgagactatatagctccttccaaagccctgcatctttcctggcctcctttcccacttttgtgtctctcatccctcatttctgtgttataaatagtgtcatagataaacaaagctggacactcctaaagtggtagggacagattttaatcaacaatggattttacagaagtaactgggcattttaaagggagaattagggagtaggaaaaagtagtatgtgggggctcagtagagtcagggaagtaaaacattacaaaaggttagttggcgtaaacccgatggggccagctgtgtttgctagctggaaattactgaagctatgattccatcccgtcacagagactggaaggcaaaggctctattctcaggtattggctagagcaaacagtagatttttttggcagccttgagtcttgtcttctcaagcaagcactttaagcggagctagagtcatcttagggatatggcattgagctgttagaaactgttagtgtttgttcaagtctttgtaagccaaggtgaaggcctagtcaagaagagggcttggaggagcctggctatggtttagtcaaggagataatatttatcagtcattatagatacaaaacaaatcagaactctgtcccaccacttgctggctgcaagaccttaggcaagatacttaaactataactttagttttctcatctgtaaaattgggataataatagttcctatctgataggattgcagttaagtaaattaatatgtgtaaaacacagtaaatgctcagtaaatttagttattaacatttctgccctgaactgcattacaatggattagttaagaaatgttagcaagtagctaatgcaaggccctatatgataaatacattagaatacttgaaataaagaattacagaggatcaacctgggaataaagagagtaattgcaacaatattttagtcaggactgcaatcataattttctagagcacattatggaaacaggttagaatctacatttctctcttgctttatttagaaaatatttatggaggcagcaggatttgaagaatgtagttcaagaggtagggagagagacttggaaacaaaagtttagaattcctgtaaagctaccattctagaaatacggctgtaaacagatgaagtattcagaacctcaacttttataattttgtctttaaaagaaactagtaattattaaaggtacaatttgctaagagagaaaaatttatacactatagtcataagataccatcactgtcaaacatttaaaataaaaattcaaattgggctgcatgcagtggctcacacctgtaatcaacactttgggagactgaggcaggaggattgcatgaggccaggagtttgagaccagcctgggcaacatggagagatccccatctctacaaaaatttaaaacaattagctgggcgtggtggtgtgtgtctgtagtcctagctactcaggaggctgtgacaggaggctcttgagcccagggagttgaagctgcagtgaactatgattgtcacactgcattccagcctatatgacagagtgagaccctttctcaaaaaaaaagaaaaaaaattcagtgaagttggttaaaatctctatatataattataaaggaataatccctctataattattaatacataaatatccctctgtaagatatttggtgtatcaaatagatctcaaaaggcaaatatataatatttgaatatttcagtcaatagaataattttatatatacagtcatgttcttcataatgatgtttcaatcaaagggactgaagattataatggagctgaaaaagtcctatcacctagtgatgtagctttcataacttcatcaggaacatttttgtggtgatgctgctgttaacaaacttgctgtactgccagttatgtaacagtatagcacatacaattctgtatagtacataatacttgataatgaacgactatgttactggcttatgtatttactatactatactttttatcattatttagagtgtactacttctacttcttaaaaaaaaaataaaggtttattttaaaagagcctccagcaggtccttcaggaggtatttgagaagaaggcattgttgtaggaggtgacagctccatgcatgttattgcccctgaacaccttccaggaggacaggatgtggaggtggaagatagtgctattaaataatcttgacctgtgcaggcctaggctaaagtgtgtgtttgtgtcttagtttttaacaaaaatgtttaaagtaaaaaaaaaaattaatagaaaaatgcttatagaataaagacataaagaaaatatctttatacactatgtaatgtttgtttttaagctaaattttattatatgagtcaaaaagtttaaaaattaataagtttataaagtaaaaagttatagtaagctaaggttgatttattattgaagaaagaaaaattctttttttttttgttttttgtttttgagacggagtctcgctctgtcgcccaggctggagtgcagtggcaagatctacgttcactgcaagctcctcctcccaggttcacgccattctcctgcctcagcctcccgagtagctgggactacaggcgcctgccaccacacccagctaattttttgtatttttttagtagagacggggtttcaccatgttagccaggatggtctcgatctcctgacctcgtgatctgcccgcttcggcctcccagagtgctgggagattacaggcgtgagccaccacacccaaccagaaaaatgcttaaataaatgtgttgtggcctaatgtacagtgtttataaagtctacagtagtgtacagtaatgtcctaggccttcacattcactcacctacacacccagagaaacttccagtccttcaagctgcattcatagtaagtacctgaaatggtttggatttgtgtccctgcctaagtctcatgtcaaattgtaatccccaatgttggaggaggggcctggtgggaggtgattggatatggggtcatgggggcagatttcccccttgttgttccagtgacagtaagtgggttctcatgaaatttagttgtttaaaagtgtgtagtacctccccctttgctgtattctccttctctggccatgtaagacgtgcctactccccttttgccatctgccatgattgtttcctgaggtctccccagccatgcttcctgtgcagcctgtagaactgtaagccaattaaacctcttttctttataaattacctagtctcaggtagttctttattagcaatgcgagaatggtgtaatacagtatcctatatatacaaataccattgtgttacaattgcttccgatatttagtgtagtatcatgctgtacaggcttacagcctagaagtaatagtccataccatataacctaggtgtgtagtagattatatcatctaggtttgtgtaagtacactctgatgtttgcacaatgacagtactgcctgacacatttctcagaacatatccccattgttaagtggcctatgactggctgggtgccgtggctcacgtctgtagtcccagcacctttggaagccaaggaaggtggatcacttgagcccatgagtttgagactagcctgggcaacgtaacgaaatttcatctctacaaaaaataaaaaaattagctgggcatggtggtgtatgcctgctttcccagctacttgggaggctcaggtgggaggatcccttaagcctgggagatggaggttgcagtgagctaagagtgtgctgctgcactccagcctgggcaactgagtgagaatctgtctcaaggaaaaaaaaaaagtgacatatgactgcatttaacacatagtaaatataatctaacatataaatgtagataaaatttatatttggggaagagaatataaattctttcccaatacatagagaatatttataaaaattacatagcaggatattaacaaattttagttgactataataattagaatttttaaactcatgtccactcataattcaataaaactagaaatagaccaagaaatgatgtcatggaagacttagctacttagaaattaaggaccattttttctgcacaatccctggaacaaggagaagatcaaacctgaagttttaaatggtctagagagtaatgactctttagtagtatccagtaaggaaaatcctggataataaaacccatgagaccctaatgaagtactcagagaaaaattaatagccttaaaatgaaaaatagaatgaaaatacaaatacaaagtcaacttaagaaatgaagataaatattaaaatcaataaaaagaaatgaagtgatacaagctaaaaataataaataggtttaaaaatggaaaacatcaacaaaataaattatttctttgaaatgtcctttaaaataaactcatggcaagccaagcatttcttaaatgccaaaaattatgcattattaaaagttagaaaagataaaaggaatttttagacactgttatgtgcaactgtgtgtcagtatattttataatcttgaggaaatggatggttttctagaaaaataactgaaatttatataagaagatatttaaaaacttaacagaccactaactgtagaagagactggaaaattaaaaaataatttttatacatacacacacacacacacacacacacacagagacttctaaagatgagaattatttaaccaaaaacactgagaaaaacacgcatatggcagaaaaagagttaaaatactatgtatataaagagttcctatagattttgaagaagacaagcagcccaaaagaaaagtaaattaggaatattaatgtaacagaatgacaaaaattcgttcatgttaataatcagataaattaagggaaaaaagttactatttttttttacccattaattttgcaaaaattcaaaagagctatgatatacagagcttttaaggatgggaatacatgggacagtttcatacattgctggtgggagggtgcactgctacaagctttttaggaaagtagagttatcttctaaagtaaaactactcatatccttaaaattttgggagatcattctatggaattttatgcaataaatgaaagtctgagttagaactacatcttttgccctagaaatattgccattatatattaagtgagaaaaacaaaccacagagtcatgtgcaaaagtgtgatcctatctttttttttttttcaataggttttgggggaacatgtggtgtttctttggttacgtgaataagttttttagtggtgatttctgagacttacctgcatctatcacctgaccagtgtacactgtacccagtgtgtagtcttttatccctcatctccttcccaccttttctcccaaagtccattgtatcattcttatgcctttgcatcctcatagcttaactcccaacttatgagtgagaacatatgatgtttggttttccattccttagttacttcacttggaataaaggtctccagttccatccaggttgctgtgaatgccattatttcattcctttttgtggctgagtagtattccatcgtggaatatatatatatatatatatatatatatatatatatatatatatatatatatatatatacaccacattttctttatccactcattgttggatgggcatttgggctggttccatatttttgcaattgcgaagtgttcaagtatctttttttgtataatgacttctttttctctgggtagctacccagtagtgggattgctggatcaaatggtagttctacttttagttctttaaggaatctacacactgttttccatagtggttgtactagtttacattcctaccaagcagtgtaaaagttttcccttttttaccacatccacaccaacatctattattttatagattttttttattgtggccattcttgcaggagtaaggtggtatcacattgtgatattgatttgcatttccatgattattagggatgttgagcattttttcatgtttcttgtccatttgtatatattcttttgagaattgtctattcatgtccttagccactttttgatgggactttttgtttctttctgatttgtttgagttccttgtagattctggaaattagtcctttgtcaaatgtatagattgtgaagattttctcccaccctgtgggttgtctgtttactatgctgattacttcttttgctgtgcagaagccttttagtttaattaagtcccacctatttatctttgtttttgttgcagttgcttttgggttcttagtcataaagtctttgcctaagccagtgtctagaagggttttttcaatgttatcttctagaatttttatggtttcaggtcttagatataagtctttgatccatcttgagttgatttttgtatagggtgagagatgaggatccagttttgatcttctacatgtagcttgctaattatcccagcaccatttgttaaatagggtcctttccccactttatgtttttttttgctttgtcgaagatcagttgactataagtatttgggtttatttctgggttctgtattttgttccattggtctatgtgcttgtgtttatagtggtaccatgctgttttggtgagtacggcctcatagtatagtttgaagtcaggtaatgtaatgtctccagatttgttctttttgcatggtcttgttttggctatgtgggttcttttttggttccatatgagttttaggattgtttttttctagatctgtgagcaatgatagtggtattttgatgggaattgcattgaatttgtaaattggcagtatggtcattttcacaatgttgattctacccatccatgagcatgggctgtgtttccatttgtttgtgtcacctatgatttctttcagcagtgttttgtagttttacttgtagaggtctttaacctccttggttaaatatattcctaagtattttatttttttacagctattgtaaaaggggttgagtccttgatttgattctcagcttgatcactgttgatgtatagcagagctactgatttgtgtacattaattttgtatcctgaaactttgctgaattcatttaccaggtctaggaactttttggatgaatctttagggttttctaagtatacgatcatttcatcagcaaacagtgtcagtttgacttcctgattaacgatgtgaatgcccttgatttctttattttgtctaattgctctgattaggacttccagcactatgttgaacagaagtggtgaaagtggccatccttgttttgttccagttctcaagggtaatgtgttcaacttttccccattcagtataatgttggctgttggtttgtcataaatggcttttattaatttaagatatgtcccttctatgccaattatgctgagggttttaaatataaagggatgttggattttgtcagatgcttttttgtgtctcttgagatgatcatgtgttaatcttgcctcctatctgccattttccttttttctctaagtgtgatcctatcttaataaaaataaataataacaaaaatcccaatatacatgtgtctgtttggttatatagttttaaactagcaaggagtaagttataaagagtcacatcagcctaaaaacactggttcccttggcgaggtagcaatggaggaatataacagaaaatttggggaatatatgttattttatcattgagaagatcatctattattttatagttgttaaaaattaataaagaaaaaacaatatcaccaacaaaaaggatacagctagatatcatgtgttttgatataactccctacttttaaaaatctctagagggattttccatacagagcctctaattgataaatgtttcattcctattcccctgctttgcaccggtgctattaaaagagcctgattaattaaagaatttaagaaatttggtacacatttggaaacaaatagatccagatttgtagaaggtcattcttctattatagtccgtctgaagatatttgtggaaggcaaccatgcatatcttttccacattagcaacaaaagtgattctctttgcacttattagccaccagaaaaattctctttgtttcacttattttcagatttatgtagtctgaattaatatttcaataaccctcttcaagaaaagcatttggaactattccacatgaatgttgcattctttaagcaaaagtgcagaacatactttttcaaggcacagattgcttttcatagataatgtcttctccttaatcatgtataaagggacgaatctgatgtacacattagagaaatggctctgtcttagcaggcaaaagtcacctcattcaacaaagctcacagcacttttaaagaggagggtatataaaaatagcaagtacatttctttgtacaatgtgtcatactcccaccctcagcgaatccagtattaaatgaaaacatttgccatggcaacatcgatttacaaagggcaaatgatgtttctgagagattggagtatttcctttcatagatttcagaagcacacacagttaacactttagcaaccttgtttaataactatatatatatataactataaaagctttacttgattatttttaagtattggagataaaatccaaaacaaaacaacaaactcctaacaaaaactgccatcaaagtagattcaagcaggaaaaaaatatcactagaacattttagccttcactatttatgggaataacaattatttcatgtggtaagctgtgctaaattaaatctgtgaatgatcattttgctatgaaaatgaaaattctgtttatcttaccatttctacagttgacgttatcagttataatatttagcctcctcattttggacatctttaaaatattttatctatttttcataaatgctaaggcagaattcacagattgcagttgtagtttcatctatttgactcagactatgaaggcagacacagtagatgtaagaaagaagatagattggtagcctgagtaaatgcaagtattgaagaggtgaccttagtggggtcaaacaagtttagaagttaacaaatagtctctatattttttctcagcttgtcataaccactccatgatacaaaatggagaaaattgtggccagaggtgaggaaattaagtacctgccctaaatagtttatagtcaagagcaaaaaatttgtcttactcatttctttaactctgccagaggtgaatactgttctactatctaacctttatttaatgggcacagtaagctgggatctagaagcttatggcttctgagtgtaagggaacttctagtccttcagtcaattatggcaggagtcagttgaaatgaataaggtgtttcatacagttaccgcccacagcattcaccagtgaagcaaacaaaagccaaatctagcactgttttaatgttttcaagtctactgttgtttgaagactgcaggttctttggaagaccttgtatcatttattttctcacttgcctctttcttgaacatgcattccccacgattcaaaaatatcaattgtcaaaaagtttataaatgtataaatctgagatagtttccttgcatttgcaaagcaaatcctccagaagatatttatcatggttaagaatttatagagaatagagattagcaaacctgtgatttgctgtcctgtttacatttattatgaaggataacattaattaaattaagaatgatctcttcattgtggaagtcagttccagaaattattgagaatgaggtttttttgcgagataaattcaaaccttctagcaaatcccaaagatattataatgtacatatgagtattaatagagttaattcaggcatatataatatttttatagtaattttgcggagtattgaaatgttaacaagactgaaatgattttccaccccttcttttttttaaataccagtctgccacaacatttttcctcttaggcttttatgttgccattgttctttacattcatttttcagtatttaaatatctgtcactgtaatgttacagaatacgtattctttctctgtaaacctacctgaccctctcacagtgatctgatctgagcaccctgttgtatcactcttatagaaccattatattgtcactaattatagtgattattttttatgttttaaatatcttgcactaaaggatctctgaaaccaatgactgcatcttactcatctttgtgcatatttttggttagtgtatactcaaacttagcaaacatcacagtctgtatttacaagaagccagcttctgtctgtcctgtgggaaagatattgtttgcacagtattctgtattgtgccttgcacatagaaggtactcagtgagtatctgttgattaactgatctcccttgaatctacacctagttatttcttctgttcttcaatacaggtaggaaagtaagttggatgatgacccatatagtatcaaaaagattgtctatcttgttaggactatattctcagtgccttgcagagtgccaggtacttagtagacattaagaaatatttgttagggattgatatttaatgcttattgctatggcttggatgtggtttgtccccaccagaactcatgttgaaagttgattcccaatgtggcactgttgggagatggggatgtttgggccgtggaggcagatctctcatgaatagattaatgccctcacatgggggtgagtgagaatggattagttttcaggagaatgcgttgttcgaaattgtgcctccctttgtttctctctcttgcctcctctcttaccatgtgattttgcacaagctttttctccattctgcttttattcatgagttgaagcagcctgaggcccttaccagatgcagctaccgaatcttgatccttccagccactagaatcatgagccaaccttttttcttggtaaactactcagcctcaggtattctgttataggaacacaaaatggactaagacagttgtgttcttcagtcaaagcacagagcacattagcaagtaaagcttgattaggcagttagacttcaaagaaatttatagtgtagtaaatatttcatcttcttggttaacatggttggaaccacattagactatttacctctttagtggtctaaattctaggtgtatacaattactttaatttttttccttcaaaatgtctttcaaatttttcccttttcctctctgttccagctgcactggtttctttgatttccttgcacttactacatttcctctcaagtctgtgcccatgttgtcttcttgctaagtttactcttccctccctgtttaacctggtaaataccttctcatctttcagatctcagcctgggcatcactttctcaaagaagcttttcctgaccacctccaattccccctattcctcctgttccccgcatcctccaccttttagagtgctatggtagctctcctagcaccccatgcctctttttcagggtaaccttcacaaatgcagtttcacatttgttagcatcgttattcaattcatgcctatatttcttcaccagactgcagactatggagggcaggaagcacatcaggttttgctcatcattgtatctcatcagtctattccagtgtatggcagtagccgactcaatatgtatttcagggataaacagacatacggggcatatgggtggatgaatggacgaatttccactgctactctccaattatagacttaatccagacagcaacacttcctggtctgttccagctccattgcttccccctgcccattgtatcctccttgcacattctcagttccaccagtgtgtctcctaaaggactgcacctataatttcatgccccatacccctctcattcagcatgactaacatcacatttaaacagatctaaattctaatttaaatcaaattaatattctctaaattagacaaaattctcaaatcaaatctaaattctccttatctcccaaggccttttattatctggttttattcagtctactcaatttcctttctcagaactccctaaaatgtcacctctgtacctaatagtccagttaccagactgtccctgcctccaccacacttactcccatctcagggtttggttcaggctgtattttcaggtcccccaagtgtcttcctcttaactttgtttatctgaattcctcccttcctgtgtgaaaacttaatgtctcttttctgagcctctctgatgctgagagaagtcttggttacctccttttgtttccttttttttctttaaaataatgcttttatttaaaataccctttttacaaatattaaaattttattgaattaatatgctaaaatcacatgaacacttggcaccatttgaaatgtaatcctatccatggaatagaatgcaaacattaactaaatgtaaaagggggacagatttaggactttaagaacatgttttaaaataaaagtttttaataaatttcagtactccttttgttttttgaggtttccactttataatttttaaaatactaagaactgccaaagagaagtataaaaacagggatgtattttatgtgctggatattctccactggcctctccagatgtccttcccacccttcttcagcctgctccacgctccaggaggctgacctttatggactacattaatgggctcccttgctctctggctttcagtggctttagtttgtgggaggaactggcagaagactgggcagcaggaggataaggaggtcagagtatttatttccttggttccttttctggtaggcagcaggttggcagtaactgggtttctctaatgatgccatagctcctatcatctctcatggttataacagtttctggttttggtaactcttcctcttcttggctcttaggtttttgggtggtacagtttgctgctttataaatccctggggtgttttaacatccctgcatgcttcccttaacctagccgtctttgtccttgcttccttggttaaattcttctgaattgccccctttatttgtgtcttctattttttttaatggaacattgatatcatttaaatattaactatagcaaattaatgctttcattatagaaatgatacagtgtggttatggaaggaatatcatcttttttgattcctatcttgtgtctctgactctgcatgatcttgttaggggaaaaagtctggccaagtggccctcctccttagcccccttattgggcctgtctagaaccaagtcagcggtttccttggtccccttattgggcctgtctaggaccaagtcagcactttggtctctcccgtctcagaattcctactacttttttagtccttacaacaaggcttaacacttcaccatttcctaatggcagactttgtctcatccattagattctaaagtttctgagtgaaaagagtatttttatatctatttttatgcccctggagcaatacatacatagcaaaaaagatcttaaagatccttttctttccttttccttgtaatgtatttgtgaagaaatcagggtatttattcgatagagtatcatacattttaggttttgctgattgcatcactagagtatcatttaacatgtttctctgttctttttcttttttgtgctggtgcatctagaggctagatcagatttagattagagtttttggcaagaatgtttcatagatggtggtatgtattaccagcagaaggtaatctgattgtctctcttcttgtaatgttaatactacctattaatgaggaaatgtgaggttgataatccattataaagtcttttgtcagcttattatctattgcttttagttgccataaatgatcatcattgccgtggttaattagaagttacgtatgataagtattcttctcattccttctgaatttgtcagtggaaatacatctatacaaggaaactttccctcgtaagctatttgatcacctttaaatacactttatgttgcttacatcatttttgttctataattgctagatataaaacttttcttgtaacacctactcatggtcattggactacagaaatctaattatatattgatgataatttagaattgtttaatttaattgtacttaccatgatgtgtggatttgtgcatgtgtatttgtaagcctgagaaaacataagaaaataaagccgattttaaagcattgtaattttgttgttgaaattaggaattttccgaggaggtttagggaagaatacaatgtactaaaatgtagtatttatgtttctaatgtaaaattaacttatgacaggtaaaaacatatctggaaaatgggcatttgcagttcctacagctatttggttcatatactaataaccccattaactgtgtgacaagtatccactgggagtttagaagacaacctttgtagagtccttccttttcttgaattattaatattatctttgaatggaagttgcaaaattgcagtgggataaatttagtttgatagacttaaaaagcataaataaaatgcttaaaggaaaaaatgactcaatgctctagagctgtttttataggatcaaatcctttataaaaggtttttagtcatgaaacagaacaaaattcaacaaactaattcaactaacattcactgcatacccagttcctatgtcaggtagtctttgggaacacaaagaagaataaatcaaggcgtcaccccttaaaacacaatccaatagcaggactagcaaaaaaggagttttgttgtaattgcctaatactgaagtagaaatgtttacgacatataaaggaaaatccaagagcaggccaaagaatgtttttatatttgattttatagttcctcttaaaagttcaaagctaaggatgcaaatctgttgaaacgtttcttttatgagttagaagtttaagggaaatgaataggtcacagaatcactgtgagggaggtagggagaagcagaataactttgcccttgaccattatggttaaatatatgactccatcactaaacataagtaccccatgtctgtttcacctctcctttgaaaggaaaaaagtataatttttcagaaggcacagtttcttcatattaacttagaattgaattggctttccatctcttatttctgtcaacattatcaggcttgctaaactgggaatgggcattttatcattctgtcttcttatatcttagtagctagttaagagactcagtggaaactgcctagatgagtatatttaattgatgatagatgaaaagacaaggatttcaaaaattctgaacaggtcaatacattgaaatgggcctggttacctgaaaattatctactgatgaataaacttagaatgctgtcaggacctattgtttgcctacttttcagacatctcctgttctttcttgcctaagagaaattcccttttgttccagcattggccttccctttcctgattagactaagccaattctggtcattccttttctcttcctaatgattgctttagagatgggcatgtggtataattctggccatttagatgtgaggtgaagtcttttggagctgaagtgcttctgggaaagtgtcattcttgaaaaggaccttaaggaagagactttccctcccctagcctttggaaattgcattgggcattgtgacaacgacatactgaagctactgcaaccatcttgtgatcatgaagggaggcaaatccatgaaataaaggcaacatgctgaatatgacaaagctgaaagatggaaagaacctgattacttgatgacgttgtttagttgctggatgaaataatcattcttgcatttgttctacttctggacttctcattatgtgagagactacatctctgttggtttaagtcattttaagttggtcttctgcaatttgcagccaaatgcattcttagtgatagtaaacattttcttagacctcttacatgtgactgagatgccatgtgtttaatttagtattatctttgtgatatgtcccgatgactgtatgcacaataatcccaataaagaaaagagctatttctgataaacactttcatagccataacagtgcattgccattttgctttttaaaaatcattgtaccaattttaagtgtcaccagcaatgaaataaaaatttaagcatctttcaagttgaaaattctgctaatagttgccatgagtacatacatttatttgagttttacaagattatttgcatattttacatactgtctttaacaggaaccatttcaggcaatgttatatggtgctgataccagttatcaatgcgtaacaaatagtaaaagtgcaaataatacatgaatacattaattttcaaattgtcgtttgttatatatgtagcagagtctcacagtttatagactattcttcaagtaggcaaagaaaataaatattttactttaaaaaattgatctaatttagcttattacacctgtgacctctgggtatcaagggaagaaaaccttcaaaatatcagttaaaggtatctcactttcttctggttcaagacagtcacctcaactttttagtaagctatacctcctcttcccttttttatttgtcagtacagtatttggttgatggaaagggaggtcttacatgaatggccttgggcagtggaagaggtcttaaatgaatgggattcattgcctctgtttccttaattggtgtcaatttcaataactgtgattatgaaattaacctccatttggccagaggaatttcttttacttcttccttttatttagaaaggtattcccctatgtcatgctttctccctttcccagcttagctttagccctgccaacctccttggagccataacagaatgcttgctggggaaccaaatatgatttatgtgggagaggaatgtgaatacattcaaaatactagtattacaaatatgtaaaacctgaaaacccaaaaccttgcacagaactgtaacatttataaatatgctgaagtctgttgggttgtttctaaaagtcatctactttaacattgtagtttttattcttttcttactctttcatgtgaaaagtatctgcttttgtagtatatcacttcactagttcccagtgcatcataagaagttaaaatcactgtgtgctgaaagggtaaattaggtgtttaggttcctaagtttgtgttggtatcactagtctatggaacagaaatagtttccagggttggaagtcaacaagcatccattgaaattctctacttggtggcatattcttgctggagtctgtgtaatatcaacattgctttaaataattttccttaccttattttattttgactatttgagatttttaaattaacctattgactcatcctttttcttttgttgtctcaagctcttcggtttttgtcgctgtttttattgtttgtttttcccttgatgttttgtctttcctgtttctcaatctgccctagtccctgtgatcatcaccaaaggaactggtgggaaaactttgtggtgactgctatgtaccattgctgcaggcatttcttgaatggggtcagtgtagatgacagcactagagatcctgggggtaaataccatggacagcgagtgtggctagagctttacatagtcttgggaagagcttgaactacgagaagagtacccacagggtctcagtccttctagggggagccacagagaagaagaactgagttctttaaaatattaataagttagggatattaacacaaaaggtagatgtccagatattaatattgtattatagacatgcctataagaacacagcttacttatggattttgattatccacattgtcaactaccctctccttaaaacttctctttctttgtcttccaaggcatgtggctaccctgatttttctctgaactccttggccgctgttacttggccagccagttcacagctctgtcacttctctttcccttttttctgtctactctcaatacgctgcctcctctacacacattgcccaattactatccaatttttatgtttcctaaatttacatctttaggccaagcctcacctctgaactccagaccttgacccaactgcccctttgacatttacagatggattttcaaaagctgctcaaattcaacatgttcagtgccaaattcattatcttcttcaaacctggtcatccgtgttttatgtctcagtgaattatatcaccaatacattcagttatgcaagccagaaatccaggagttattctcaacactgcctccttaccttcctttcaaatccactccccagtcatgtctattttaccttttaaatgtctctagaatctgccctcttttctccttctctactgtcatcacctagctttaagctacaatttttctgaatagttacatggcatcttcactaacctcatctggttaatttccatgtcattttcctacaaaaaaaaaaaatgtctgtggctttctgtggctgtcatgaaaaacaaaacaaccaaaattcttaaatgaactacaggccctgcattgtgtgccacatctacatgcccagtccaatttaaaacatgttcctctgtctgtgtgtactggcttttgttttttctgtcacaccaagttctgtctaattacacggcctttgaaaatactatttcttacgctaaaacattgccaaccccccttgacctagagcatttcctctgaattattagcttttgtagcaatctatatttcttctttgtagcacttaaaacagtaaaaatttaacatttatgtgtaattatttctttgctaaactagtagactaagttttatgagggcagagactatgtatacttttgctcacagttttgtgaatgtagaacagtgtctggttcctgggaattactcatatatgtttgctaagtgaatgaatggatgggtagaagaatggctttctgtgcagccattgaaagagatttaaaggtaggcaagtattaatgagatgactatggcaagatatattagaattagaacaggcctggggggaaaaaaacacagaaattgagaagaccactttgttttctgatggttcattataaatgtcaagagaatagaatgcaactttggcagtaagatagtggacagacccattcaagtctagagcttctctcctatgaagctgtattgtctcagtatcaaatataagccacttagcacagaaatatggtgtttggggtagtcattgaggagcctttgctgttctgaagtgtccacaaacagatttgatacatacagttagtttctaatcatttgtattaaaggagaggaacatcagtgtgaataaatgttggcaccaggttcagaagattgactgattccgtattcaggggaacttgatgaaaagcatgaaccactagcttaaagttgggaaaggtgagtaatggagatcgtcagcactccctgttcagaatagcacagtttccttcatgtaactcccgagtccccatcacagggaagccaaggaggtttccaccgctatcgccaccctgttgtatgataggcaattaatgatagtagattattagtatgttcctttttgtttactcataagtgaaagtatgtgaaagctctaagacagctgttccctcaccaaaatatttttccctcatcgtttgctcatacagatttgtaattcccatagaagagcgcttgccaggagagtcacttccatttgaactacttggtgttgagattcttctcatcatcagccacagtgtgattatagtttaaaaatgcaaatgggattctgggatgaatcaactgaaggataaaattcatatgaaaaagtgatctgtataaaaccctaattaggcagcatctatgatacagcctttcttaaactgtgagtttattgccaccaaaagaagtagataagtgcaaaattcaacaactatttctagagctcccagtatgtgtcagatataattctaaatacctagaatgctagacagacactgttacaagattacattctaggttgggaaaaatgttgataggggatggaactagtatagtggtaaggacaaaagcgaagcattttggagaatcatttgggaacgttttaacataaaatcttcactatgactgtttcttccacagcctaagaaatatggtaacatctttaaaaaattaaatggtaagaaaaagaaaactgggaaagggaaacaaggatagactacatataatagtgatagtttaaggaattttatctgttattaagtgtcttaaattctggcttcagagagatggattatttaaacttgagtttttttgcttcagaaaatcttttatgctttggtataattttcttttgctctagcttccttttatactaggatgaggtggagagtacaaacaccacggagttagtgtgagcctcctatgcatgcattaaaaacactttgggagacagcgatttgattcttttacatagttggatcacataaaataaaactttgaaaaataattttccaattattttcttcctctcataatcaaaattctggccaaagaggcttgaccactttccatacgttttccttgttggatgggtagaactaccaacgctcttgaaatttccattagtttttcccaaaatgcagttattcaaaccctaaatgagtaatatgtggaaacgtaggactttagggttccttaccagtttgtctgggttggatttaaaatgtacacaatcaggggttggtatagagactattaccaactttctgattagctactctgaggtacaaagtcacaactgccaccacaagatgtttccactggttctgggttttgattactcctattgcatatatttatggtgtacatcatgctgttttaatattcatatacatggtgaaattattactatagttaagcaaattaatctctccatcatctttcacagttatttttatttttattgtttggtgttttggttatttaataagtgatgacttagaaaagttaccagagaccatactatacacaatataatatttctatgacttatggcctatttacagggaacaaccaatttacaaatagccaaagaaataagcaaaagggccataaccagataaaactgcatcatgttatctatttgtacacctctttgtgtcatcacattgaatagtctttaagaaaggtagtctgggaggattctgtacaataaaaggttattattcaatcaggatcaaatcatagtattcaacactagaataggaatgatatctttggtttccccaaacaaaaattactggttttatgtgaacagttttcatatgtaataatatacagagattttgtttgtctcataataatttaaataagcagttgattttattaacgtccttttccatagaaaccactacatctctattcgcaaacaactaaatcaaaataaagaatgctatgagagaactaactcttggttaaaaatggggagtaataggatattataggagtgttatagtaataaagcctttttatttctagcacactatcttcttttgtcagaaaaatgtacttttcttggatagttcccagtagcatcagtaaaaaggcatcagcaatatcatatccctctcgattcagattcggctgatgtgccaaaatagatagcactgggcaccatggctatgtagattcatattatttctccctttttgtatatctgagccttatgttagcagtttgaatctttagtattttacagacagtcccctggcaccaagctcagatacagtgttctttccacagagagaaaaagaggattcatgatgatgataaatggaaaattgtgaatggttgtgctggtagtttgggttgaattatagaagcatccttactaggacagtgtgttcataggaagactattataatgggcaataaggtgctgtctttatctcttcagaatgtgtttcagagaaacattgatctgagttatgtatatattttcaaataactttgcagaaacaaaatagtgacaaaattaaatggctgtggctctaatctagttcattgcagttagtcaccaagcttttatgaaatgttctcaggtgctattgaaaatgtagggtacttggactaaaacttcctgttaaattttatgttactttgattcccttatttctcccattaatcaactaaacaactaaaattgtgtctaagaactgacaacatttttttagagaggtttgaaaaataccttttaacagctatctttccatagtagaagagaagtgctttaataacctggtacaaatttcatttcaccaatttccagattgttttttaactgcaaacaaattacttaccatcttcagcttcatttttccatgcgtaaaatggtgtctgtaatacctaccgaatagtgttatcatggaaaataactatgatagaaacttctaattgtgtatgatacttgtctcctgcagagggtctccttcctcccttcctttccctcccctccacttccctcccctaccctccctttaccccacctctctctttcttcaactggctttaacaacttaggaaagaaatagtggaaatgggaatggattatcattattagacaagttgtaagccaaaaaatacaaattgctagaagaaagacattttcaaattattctcattttaaattgggtggctgatggtaaaaaataataattatagtatggatctgatgaattataagtataaatagcaggttcctttattctctgtattatatgtgaccatcattgacttaattttttaaatcaagaaccaacttgctgaatttgatatatctatgtatgcctataacttccctattccaaaaacaatgagataacttataataaaatcaaagatagagtaaaatcgaaacctgttattccaaattaaaaagaagttctgtttccttttcatcataaccttttgatcctttttcattataaatatatgcttagctgctttaaatttacttttgtttttatatttgcttttaagtcattatttgtcacattgctgggaatgatcttgaatatattagtataatgcacagagtgcatatattcagatcccagctcctgcactttttggtgtccaagataaataagccaacaccacttaaagtggtaaaatagattttattcagtagttactattgcagtagggaagtgggtccagtgtgaagtgaacctaactttgacaaaacaaaagggaggagaccttttagaagctggggtgtggtgagggaaaggcactgaaggatgtgaaagggagctggtccatgtggctgggccatctgggtttgttatttgggaggagaagcaaacttattgtatctttatgacaggaggcagtggtgtcgattagaacaaggtgcccactggactgagagctgtgcggttatctccctgaatgtaagaagacatttttgggtggtagaagatttacatctcaaaggagcagagaaaggatttacagttgcaagctttctgaagtaactgctctaagagagggtttatgcttgttaccaggttttggctagaacaaataataaaatctcctggaagcatctccttgaagggtgataggatcacatgaggggtgcagctgtgacctgttagaaactgtgctaatgtgtttcttcaggtctcttaatgtgtgtgtgtggggggggggcggggggaagagggtagacaaaatcagcacaaatccttattagcaaaataaagttgaatctattataaagacttctaagaaatgaaacaatgctgaaatgagaagaaaatggcatatataaaagtagtaactaagaatagatcacatctcagtaatttttcaaattttaagatatttgtttgatgtgtacttgaacccccttgttttttaacacacaagtagaaacataggtacaaaattcacaattttttggtgctaattgttaggtttagaaatgccaaatgatttctatccatgttagtggaatctgatcattccagctctgtgcagtaataatccaggaagcatgaattattaaaagagtgcagcctgtatttgtattgggcatattattaacaatagcacatactttattgtgtatggatttccattaaggaagtggagtacattgaatctcattctccttaaattgtaatttttatcactaaaatttcttgatgttaatatatttgatagtgaaaaaatgaccatttagatgagaccaataactagaaaagaaataatagcttgagttaatgttgatttcttcaatgtattacataaaaaaatttaaagtaagggagggcaaccaaaaataataaattttaagaccaacttttattcattgtacttctctaatatttgaggcatttgtaaagtgattcaggaaattaaatatttaattttgcaaatagcaaagatggtcaaaactaacttctaccattttaaaatcaaatgcattaaattgttctactctttttataaaagcatctaaaaatttgccttttaacttagagagtattagaaatatcactcatgatgattggctttataaataggatctaaagttgtttaggaaagagtcttagacaaacttttagggtatctaagttctggacttagcctttccattaacctgccactcagccctcagaaggaaaactaccctcactgactactttttacagtcatagaagccacgttttaatagttattatttcttccttactagcaacagtttaatttggattttttaatcttttttttaatagtccgatacatacttctgcatgtctatgcgaataccagtggatgaggaagccttcgtgagtaagtattaattggattgggggagtagcagtttaatggagggcagtgatttgaaatcagtgaaaggttctctttgagggttatgagcatattaatcttttactgtcagtttctaaaatgcatttatcatgcctaatgcagaaacaaactagagagagccactgagaggcaagattataaactgtatctggagagattcatgagtaatagtaattaaggagttgcatgcagatgttgatggccgccaatactgtgtggtcccatttgtatagtattggctttctgtctgtggcaggatgcttaattccactccactcaacagacagtttatttacctgctggttcatgctataaatcgactgcacttagaatcaacattggtgaatgtaagattttacctgtcagacaggtagatggatagaaaggaagggaaggagagagggaggaagggatgagaagggaaaggagagccagaaaagaaaagaaatggaagaaagaacatttatgttgttgtttgtattatagaataagagaacgcttaaatgacagattcttccccaactgagcctttaaatcagagaggaaaagtgacaaagcaccatctgtttccttctaggttgtttccatttaaacatcccttatgacagacatttaactgtttagggaagagctgtgattggcaaattattcatgtatttggcttttctctgcttcattttaaaacatttgagatgttgattttggagagaaagtgttggtagtagtactttggtcccttgaaactaatcttcaagtgggctgtctgaactggctattatgtgaattgtgaaatgtgtacagtagccttggggcagtctgaggatgaatttttatgaggtgtttcccacaggaatggacattatagacctgcaaagccagagcaatgtgcattttttattcacacacattggtggcaattacaacagcaaatacaacctttaataacactctcaacaaaatttgctgcatagttaattcctaagaatgaaagaccatacaaagttaaacattgatgatgttgttttgtataatatttggacattaccaagaaaaagttaggaagccaagttcttctatatcctgaactatctttaaagacaaaaataatttaagtttctaattgtagtgctttgagtaacactaaatattatttagaacatacattcataattaaaatcctagccataaagctttccttaatttcatattaacacacttggccacctaagagaaaataatatttactcgcaaaaggaatttcccatgaatttttttttcctaatttatattttctatgtccaagttcaggggttgttttgagtcctgttttcacaccagctatgaagagaaggccaccctacacacctgtgtaaatatggtagtcatgtgttacagcagtattacacatctcacattaataggtttgtttctggagattggtggtagtatatgattttagaaccagtgactgtaaggactataaatatatatcctgtgtgttattgctctcctactataaatgtgtttacgttcacataatttaaaatgaaaaaatacaagtgagtatattcagtcaagtaaaatattcacaggaaacacataaaggtctatattagaaccagagtgctaaatgttttcatactttcttaggcacttttcttctaagattaaactattccaagttataaggtccttaaaaggtcttgtaagattaataactattttcagtatttcttcctttgtttattacttggaggattgcatggatactgaaattttttgttccctattcacaatgggttgtttcatcttctgtgtgagtcctttaatgaactatgcccaggtggtttgtggttactgttgtttacataattcagcaaccaaagaagtttaagtatagacaaattagaactggaaaatggaaaactagagacaattagcaaataatcatttatataaaagaataagtaaaggaaattttgcatgcgttatctcgttaattcttaggacgatcctgtatagatagtctcatttcatagcttgagaaacagagacagaaacatctatatctgtgacttaatgaggagctaagacaatagtttgtatggaattctcatttatgtaacggctggaccgttaccatcatctctacctgccattgttcactaagagcctgccagacactgtaagatactgaaagctaaacataacctaagccaattttcagaagaggaaacagaaagtcagagaggttaaggaatctgcccaagctttttactagctatgtattaacctagtcgtacttcagattttggtgtggggatagtgatacaaagggagaaatgagcaaagttatcaagtgcataggtggagctgaaatatagcaagagcagcaccgttctttcttcctcacatcaaatacaattattctttcattcctttaccttcactccctactggatacactctggccagttttgccaaaggaaaaataaacctcaaaccatcttaacaaaacaaataacaaatacccatgaagatttaaagatttgtagaaggaaaggggcttggatagttatatgttgggagagtgaccatacatagcttttccagactcccaaagtgaaagttttgcctatagggtagcctatgctttttccattctaagggattctgatggcatagagaatgaagctatagcctttttgtggattgtcccaaattccagatctcaggatgccttatcctgagattagacatggttgcaaatgaagagctgtaaaaacccataatactttgttcgttcttttctgtttttaattatttttatttctcatagtcattctgtttgtttattctttccttaagacacttaatgattttataccttctgttttcattatctgtgcctctttaaatttttgtattccagcaggataggcaccgactcaataattgcttgctgaatgcgcgagtgaatactaaataaggattttggccgttttctgactcagcatttcaaacagtagataatttacctttctaccttgaattatattctaatctaaggaatcattgttttgcttgtgtttatgaaaagccattgtgcatgaattcagcaaacttaaaattctgctacatataagttattgggtaatagggatgtgaagtatgatgcctgtttaaggaagtcacaggctagcagaattctagacaagaataaaagtgttaaaacatataaaaaggactttctccttgaacttttcaaatttctgaagaaaattacaaaagacaatacaatttacattattaatactaggacagactctcttgatggcattaaaagtcaaaattcgatttgaataactcactattttggctttatgtttatatgctagttatataacccatcttaaacatacttctaaattttgagcaaataccatcacagtcattatggaactcatatgtgtatatgcctgttatatttacatatgagcatatagcatgtgtgatgtgtctatatatctgtatttaattattgaatgtgaattacagtaggtgtttgaagaactgcaatgatgaagataaaaatatgttttatattttgaacaaaattatagctttccctagggcattgtgtgttttttttgttgttttaataagaaaccatagaatttgaatgggtgaaagtataataatatctgcatttgaccactgaactgtggtgctgtctaaaaggtgttttacagacactcagcggaattggctctgacagcagcccactcagccaagaaatttgactgtcatcttcatccacttgctttccctcacatggatgacctgtaaataattgtgtcttttccttagtgaatgatgacaggtccctatctatcaaattgcactacataaatgagatagaagccattgaatttagaaacagatgaaattaatctaatgattcattgtttttcattttcttgggcttctctcttgaatgtagaacagtttcttttgcagaattgcacagttagatttgaatagttcaaaatatgacctttcttaaagcacatgatcaagtgatgtccagatactttgagaactgcatgaacaattcaattttgatcatgcttatgggtcactagatagtacgacataaagaccgaggtctgggcagggtacattgctcgtatatccatgttttatggctttggcagcagtaagtagaggagagtatctgtgtatgtatgcatatgtgtgtgtacatgtgtgtgagtcctcatccccatgcaatcattctgttacctttctgcttccaatgagttgtctaagtatcctttctcttctgtcttcaactaggacttctttcaaacataaataatgagtagtctctgtctcacagatgatgactgagtatttcccaccaatcaccctggaaaacacttagtttcttagtgaaagctacttggaaagagctatgatgaaaaacagaaataagacatatatagtagaggttttgatgagtggatacagcccatttttcttggtcataatcatgaaggagaagttgttgctatataccttgtctcagagtctcagagtttcttaaacgtcttctatcctttggtcacccaagtacgcatgtttccaaattgacaacgtccaacatctcctcagcttttctcaagtaataaaaaacagtgagagatgaataggagccatttctaatgtcttcaattaggtacatctaatgatcaccaaaaattaattgacatgttgatatagctattttaatggagaaatgttaaaatccttcattcccccaacctaccacctcctcccagctagctatttcagcaggaactactttagtagtcaactcttaaaagatcactatgagttggtctagtcagagaaaacttcatgataaaggtatgcaaaatttcatctggacctctgaagatgacctatttgaatatgcaaaggggtgaatattttagtggcccacagtatgagcccaaacacactgggcacaagtatgagagacagtatcatatagtggttaaaagagcaagctctgagccagaacactccacattcagatcccagcctcaccactttctagctatactactaggggacaaattacttcacttctctttcctgaaggctcatctatttgggaggacaaagaaccagactcatagggtcattgagaagtaaatgagtgcctggcacatggaaagccctcagtaaatgttagtagttgtgattattaagtgagggagttgcctaatgagaatgaggagtggatgtaaagattgccatattggaaatgtagtgagctagaggactggcacaatgttacgcatagccctaaaaggctaagggtatgggcttgattctgtaggaaattaatagtggactattataggaatgacattacaaaaacagggcttagtaaagcttatgctgttttatcttgcatagcttggctgatgaagtctattgattctttgatatatatcataattttaaaagagatatcatctagaaatttagtttttgtgttgtgtgttgaaatttctttattcagaggtgaggattgttttatttgaaattgatgttcaatatataggtttgctcaggtgtcttatttcttagttaatttggtggcagcagcttgaagtcctcataaaccaccataagcattctttaccaatggtacatcattgtccatactagcaggaattaatgacaatttcactattaagctttctttctgattaaaaatgttccaggaatgatgatttccaatttcatccatgtccctacaaaggacatgaactcatccttttttatggctgcatagtattccatggtgtatatgtgccacattttcttaatccagtctatcattgttggacatttgggttggttccaagtctttgctattgtgaatagtgccgcaataaacatacgtgtgcttgtgtctttatagcagcatgatttatagtcctttgggtatatacccagtaatgggatggctgggtcaaatggtatttctagttctagatccctgaggaattgccacactgacttccacaatggttgaactagtttacagtcccaccaacagtgtaaaagtgttcctatttctccacatcctctccagcacctgttgtttcctgactttttaatgattgccattctaactggtgtgagatagtatctcattgtggttttgatttgcatttctctgatggccagtgatgatgagcattttttcatgtgctttttggctgcataaatgtcttcttttgagaagtgtctgttcatgtcctttgcccattttttgatggggttgtttgtttttgtcttgtaaatttgttggagttcattgtagattctggatattagccctttgtcagatgagtaggttgcaaaaattttctcccattttgtaggttgcctgttcactctgatggtagtttcttttgctgtgcagaagctctttagtttaattagatcccatttgtcaattttgtcttttgttgccattgcttttggtgttttggacatgaagtccttgcccatgcctatgtcctgaatgatattgcctaggttttcttctagggtttttatggttttaggtctaacatgtaagtctttaatccatcttgaattgatttttgtataaggtgtaaggaagggatccattttcagctttctacatatggctagccagtttccccagcaccatttattaaatagggagtcctttccccattgcttgtttttctcaggtttgtcaaagatcagatagttgtagatatgcggcgttatttctgagggctctgttctgttccattgatctatatctctgttttggtaccagtaccatgctgttttggttgctgtagccttgtagtatagtttgaagtcaggtagtgtgatgcctccagctttgttcttttggcttaggattgacttggcgatgcaggctcttttttggttccatatgaaccaccgcatattctcattcataggtgggaattgaacaatgagatcacatggacacaggaaggggaacatcacactctcaggactgttgtggggtgtggggaggggggagggatagcattgggagatatacctaatgctaaatgacgagttagtgggtgcagcgcaccagcatggcacatgtatacatatgtaactaacctgcacaatctgcatatgtaccctaaaacttaaagtataataataaaagaaaaaaaaataataaataaataaatagtctttgccctggaaaaaaaaaatgttccaggaaaaggtctttgttttagtacagaattgcttcatggttatggggaaagcttgcaggagataatgtaatatgccattgtggtgggtttttagcatgctggaaaatagactatgatgctgtgagctttacatttctctgtacctttttggctcaactgcaagattatgaacattaaggttgattgatcctaaacttaaattgcaatttagagcattactatctttactttgagcagtttttgaagcataatcattatttttttggaaataaagaaatgttgatagtaagattttagggtttgtaattttttttattcatgacataccttttatattatattttcttgaacctcacaccttcccaattctctcaatattaaatatggcttgaaaatacaaacagtcttagaatactgactctttatcatagataggaacacaatcactagaggcttcctatgcctgcctcagatctcagcactaaaacgattttaggtgatacagctaaactcacatgatataatacagagttccttccagtggtctccttgaataaaataattctaaaatatcaactaatttttatctttagaaattctttatgaatttattttaaaagaaacctgcttttgctctttgtcctgtacatttaaaggagcattacaatcccaatttaactaagatgagttggttaaactcaaactatgctcacataatagagtatattcagtcactataaatggggactatagtcagaattactggtaattcgcccgtgaaacctttaaaagatatacttacctgggaataaccgctggagatttgaccaagatgttgatgggggaggcgagaagggactcatctagattgactctaggcacttgtatttttaccaagttccataggtaataatttaaagtccaggctaaaaatggctgcttaagaaaattgtttaataacatgtaaaaatacccatgatatgcaagctaagctatttacagtgtataacacgattacattgggaggaaaaaagaaagttaacaatagttatccctaatacatacaagcaacaattctagaatgccaaagttcttcagatccaaacttgcaagtcggtgcttttttattcaataggtcaattatctatgctctgtagtattcctctacagaatattttttggctaaaaataattgttcctgccatttccaatggtaatttagagctggttatatatacatgaatatctccaaaattgctggtttctctacttggttatgtgtgttcttcagaatctttctatgtcctaagtctggcagaagaatcaaaatttgacgtgcagacttggatatccacttagaagggaaaaatggagaactaaatgacattctcccccaggtcacgttcttagagaattttgtggccctgattatagtctgatgttagcttaaaaagcccataaatcccaaacaccccatgcaatgaggagaaattttgcttagaactccaggatttagacctagacatctctcttttcaacatgtcatccacacatatggtttcaggtcttttatttcagacgacattatcctttgagaaaccctccaacctctgtgctttcagtgtcatcagatttcctttaattactgtgtgtgagtcacttttttggagtcttagtccttcaaaggtatttcattcccaggacttactcacctataaaatgttcgctgatctcatacatcaggcaatctgaactgttagctcccattgagaccgaagtaccatttccacttaagcaactgtcatcttaatattgagttagaagagtcagtggcacttttaatcttaccggatataatattcctttgcattctcttgaggctgtgttttgcactgtttgtcaccatcccaaggctgtctttgtttattctgcctgtcagaatcgcacactgaaatgcagttgtttccattattatcctctagctctcttccccttggatcctttatttctttggtgtatgatgggtgaaaaagaaaagagacatttctttttaagatgttattctaaagtatttttccatattctgtattgtgttgtgttgacatctcctgcatagtcttatgtgtgtcttgtgcccagcacacctagaattcactaggggtggggtcttattttgcaaagccaggcataatcagcaggaatggagcaaacccctgaaatgaacctgtcagaccaatcttttcccagcctgccgctcctcactactggcagcagcccttcagtgaaattgtccaagtgctgctttattttaaggcatctactgtttgttttagatttacattttgatttgacattccttttgctggaggtagttttcatttcaacttgcaatgaattgtactttgagctataattatataaatatttagatattatactttttctttaggatatgaaaaaagatggttagttgcttgtttttgctgtgtacttctaatatacttagcatttaaattagatctggagtttctggagaaatatgtgagtcagtgagaatctgtttttgtgaaaggaaactctgaagaattttctttttctaccacttaaagacagttgtttctcattttagaagcaaaaattaaacacatacctagttagagttcaaagtagagcaaataaataagtggtacttaaaatgtatgtcaggaaaaaatgtatgtcagaaggagaaaaaatcagaaaatagttagagaatttatactttgattaattaagatttgcccagtttactttacaaaggacagttagaagagtctcttacataagcaagggcccaggcaaactattttctttctttcctaatgaaaagctacagagattatatgttgttgtctttatgatctattcccttaccaacagctgtcttccttgcccttacctgaatcttttgcttattaatatttcatttttaaaaattactaatagctccttctttttccagaaatgtctttgccttgtttaacagcagcatatacattgcattagtataaaaaagatactgttggtgtctcctaaacataccctgacagccctgggctttttccaaaactctgtcttgagccttctctatgattcctattaccctttctggtactttcatccatcctcgcagcttcagggttcaatttttgaatgtttcccaaatatgtaattctctgacctctttctaggacaagagtcacagaattctgactctctgctggatacttccacctgaatttttagcgggtgcttgaaacattgttttgcatccaaccatttaattcttggaataaactgcacttggccatgttggcatattaccaaaattccaagaatgattcagtcataggaaatttatccacccataataagatcttctgaggggaggaagtcatgtaatcatctacataggttctgaaaaagcagaggggtcagataacctctcatgcattggcagagggaatatttttttaaaaacgtgggagggggaggaggatgatacaattagacaacagttatagatgttcataaagtagtataaacagtttaataaaaatgaatataagattaaaaatcgtatcacataccaaaataaaatcaaggtgaataaaagaccagtactcctacctcaggactttttccattttctttctgccccaggaaagatccctggtaggattctggaagggaggaaggaaatcctgcactcaacctggcagtggtctatagatatagaatccttcttctttcttctgtttctcttgctaacaaacttcggcttcatgatgataaggactttctatgaattgtgaacggctgtaactcccaagtgattctttccttccaaagcatcttcttccatcccttgtgcttactatattctttggtaatagaaaaccaagcctcaagttatagcaagtccattttctggccattctctcttcattaatattttaaatgatgacatgaaaacttcaagatttgatttttaggcttcaagttcttactttcattgcagtaaaagaaaggtttgtctcttctgaaagttataagccaagatggcacacagtaggtttggcacatagtgctatgtttttggtcagacacactgtgagtcatggtgctatagtttggtgtagaacatttttttgttttataagtactcatgtctcacatacacattttagcaataagtgatgttttcttaattttatcaaacagaccaaaatagctgaaagatgcatttttgcacacacctgagatttaagatcattttggggctatttagcattttatgtgcaaaggtgactcgtaaacagctacttcatactggacagcattttgatgagaacgcaaaaggatgagccaaacccacactaggaaagggagttcatagataataatatatttttaattttttctcttttaattatgcacttgtttattttaatgtctttcaacaactattattaggagaaaacgagaaatgtcattccataacttctaatatcttttaacaagtataccatgcttattgaggacagtaattttatgtctttcgtatttttgtaaagatacattttccacttttatttttctttcctggtaaattgcttcttcatatacatcccagtgactatcgtactgttgttattctaagatggtcataaatttgtgttatgaatttttgtgttcatattttgaccactcactgtggcttctttttcactacaatgttgagcagtgttttatgatactcagcactgtactgatgtctaaaaggaaatatactgtgaatacatagcctgcagatttcatttaatacccatataatgccctcaccactttaaaagaggtcttccattttaaaaatgtgtgtgtgtgtatgtgggtgtgatattcagccttatttttcctttttactcttaatcaaattatcaagtcatgcttatccttaacaagataatttatacagacagggcatttgatcacaagaacatcaaaacatctttgttatacaggtatttgaactgttcaaagatgtattttatgactttggtgcacagaagtgtaacttgtattcacatacatgtattattttctcgtaacagttgacttcaagcctcgagccagcatggatactgtccatcacatgttactttttggatgcaatatgccttcatccactggaagttactggtaaggataatgggtttacagtatagaagggtgtagaaaatgtgttttacaagtgcaaagtgtatctgtgcaagtattttacaactagttaataaataggcagaacattttaagaaaaagaacattgttcattgtcatcacgtggttatcatggtttatcacagttatttagtctgctatagagcatatctatcagcctttgtcactgacttaataaatatatgtctcatggacataaagatggaaacagtagaaaccaggaccccaaaaggggctgggagagaagggagcaagagttgaaaaactaccagttggatactatgttaactatttgagtgatgggttcaatagatgcccaaactccagcatcacacaatataccatgtaacatgttcccctggaatctaaaataaaacagattcaatatatgtatattgttatacagtatatgtccaggtgcagaaggtttgtaaagaaagtctgaaaatatagattattgatactctgatattaattttttaaggttcattattctacccgaagagcatcatggttctgtttattgagcactctttctccagacactgtgactggtgatgtaggcttgccatttcattttatcctaatgtctctgcaaagcaaatattgttatttccactttacagacaagaagcctgaagctcaaagtgattcagtaagttgtttacggtagtaacaaaactggtgcaagataaagattgaaccctagcttgtctgattccaaacccacagttattttcattttaccacactgccttctatttattcaagtaattattaattcaattagatattattagaaagtatttgaatcactatggtgagtcttaatatcatgccataaacaatcagtaaacctctattaaatgcctgtcatatgccagagctgtagcagatgcttgggaggttctaggaaaaataagatgttttctacccccataagtttacagcataattatggtttgagattgtccctctcattttgttctttggcattcttgaagatcactgaactctgaaaatagccacactttttaagcttcttattttcacgtagacccagaatcactgtcacacatttaatagtccgaaatgactggtgtgctttgctttgcactgaggaatctgttttgaggtcctgtccttacataatcatgtagactgatggacctttctctgtgcatcctaacattcattagcctgatgtgagtcaagcagcaactgctctcttgtcgtttttgtaataaacaatataatgtgtatttggaactgttaaaaacacagggcaattagtggaaatctccatggaccaagtaccgtcaaagcatttgttaataggcttaagttatttgatgaaaggaacatatcacataggaacccaacctatgtgactgggtttatgtaaaaacagagtcagcaaatcacagtaaatacccttcaatatcaacattcccgtttatactcttcagtaaatttttgtaaataaaattctgggattaaaagattattctgtgacagcttttcctgaatcttattcagtaaatcacatcctttggtttttatgctttaaaacaatttcttctgaaattaccaatatttacctttgaattggactcattgaaaatagctagaaggaatgtaagcttttaaagtctgcttttgctgcaccttggtttaagggaatgagtgagaaaataacacaacacttaaatgctattccagttctaattgttaggaaaaattatctaaaatgagccaagctcattgttctcatgttaagggaataaaacaaaaacctcattttggcccctttaaaatatttattagtattcttaaataaactattctgaaattaaatctataagatatattgaccaaaaatcttccacattggggaataagaagtttcaaagaaaaatataaatgaaagtgaaaacagaaattttgagtagagtaattgctaagtatattattttgctaaaattattacttgaaagtcaacatagtagaaggaaagagcagtgaactaacttgctggattccctgggtaggttatttagcccatctgagatggagttcttgtcttcatttttgcaaaagacttatactaggccatttttaaagcctctctatgctctaaaattccataattctatgaatataaattgcatccaaatgctgagtctgattggaaaagcattatttctaggagctggaagtgtgtgtactgcttgactcacctcaagcaagcagctcactgtgttttgccagtcagttgcatcattgagtaattacaattcttaataacactatacccatatcattttaaatggattttaaaatatttgccttgtatcccatagccccacttaatttgtagacttgttatgattgaatttataatcataaaacaaggacaattggtgctgttattcatcatcttttaaccaagcccaacacgtttaagtctaacatttaaaagtaggatcttttcaatatgtgaactagaagacatacattaagtaaaactgttctaatgattctgacttccacaatcaggcctttttatatatatatatatatattcctttatatatatataaagattataatacatatttatatgtatatttgtatataatatatgatatatattatatatcatatatttattttatattcttttttttttgactgagtctcactcagtcacccaggttctagtgcagtggtgcgatctcagctcactgcaacctccacctcctgggttcaagcaattctcctgcctcagcctcctcagtagttgggactacaggcgcgtgccaccatgcccaactaatttttgtatttttagtagagatggggttttgccatgttggccaggctggtctcgagccccctgacctcaagtgattcacccaccttggcctcccaaagtgctgggattataggtatgagccaccacacccagccacaggccttatattcttatttaaatatggtatacattatttatcttccaatatttggcaaaatctatactttaaagaattagagctcacaggatatttcacagccagaactttcagttgcttcacagaaacatctttcactccccacccccagtgcctcacaggctcagccctgaagatagtcagtggatattttccagctgtttaacatcttatcctgtcatctgaattatagtactcacaacaaaaatctatcagtgtcaaacgtcttgcattatttttctaaaattttttgagtcatggaattgatcacactcattttatagttgcaaatctattcttcaattattctaagacatagacagcacttaaatgaagactcctaaactttcacatatattttggggatgatacctataacagttttgatgcttaaaaataaccagaagtcattcacactctagggaaacttataaggaaatacaaagctgttttaaggaaagaagaaaaagctattttaacatcaaaatgtcaaacttggatttcctcttttctgtttgttagctaggatttcctcctgtttacacttcagtgttccattttcattgcgagcaggttggcaaataggtgtctttaatatagaaaacatgtttcccctgaaattatgaagttataattcatcttctatcttcaggaagcatttttaatattaacgcaaatagctattctgatgatgtttcactgttgtgctgccctcctttgctctttgtaattgcctctttctactgttcattaaaatatatttacagttatattaagtttatataaaaatagtagacacagcatgaagcagttttcattatatagtgattttaattttaaagtttttttcctctgcacacattctagccttttgtgactcattccaaattagcagctcacattggcaatgtgtctagttaattatatgcatgtgcatttaaattgcatacgttgatttgaaccttttaatatactgtagggtggtccctttatagttagagtgggcctagtgctcaattccaaattaacatacctctagaggttgcaaataaggaccagctgatggaaaagaagcagctctgctgacccatgtaaagaaagtgacagtacctgtcagatgtaaccccaatgccttcttcccaggcgtttggaggaggaaaacaattaaccctatctagggaccaaaagaaaataatagcaccaagattagagcaagcatatcaatggcatgatttgttgcactctatttgtgctctatagacttaattcaaagcatgacaattctaagttccctagatttattagctgaatatgagcctaaactaagctctaagtgagcagatgctcttttgaagttgttagagtcagtaatgaaatgaaatgaaggtgcttaaatttactatttaagtaaatttttatatttaaattacccagtttaatttaaagtaagtaaatttaaatttacttaaatagtaaattttgaggatatcttggaaatttaaatattgtattcatctattctatgaattacttcattctgtttttactcttaatcaattttttaaatgataagtgattagctacttagagtttcaggctttgaaaatcataatattttgtttatacaaattgtgttggcatttggggtaattctggagtgctctcttttttaaatatgagattgtaggcttgtgcattttttattctgctgagcacaggacatagggtttaaagcaatttaggattgcaaaccccaagattttgtgtttaaaatattggatgattaaaacgagtgggcttcttatgtatccagtgttatactttggtgtgatcttctatacatagctaaaattatttttagttcttcctattaatatttgattttaaagctatttctaatgacacttaggaccaactaatcttaacaaaccaaagatggcttctacaggttgtttgatgttttttgatgaaaaaaaatccaagctggttaaatgaggctatttccagctgttctaactgggaatcattctcaagctaaagcagtagtgctttaccatcttatgaagctttagcttaaatccctttcaactgcttctatttattaaccacctgctgtgtctttttaaatgccactatctccacagggttacagctgctgatgagaagaaaaaggagataaaacattatatatatatatatgcctgtatgagagatactctgcttgggtacttatttaaatgactgttttttaaaggtgatgttgttttccaaataagcccacagctttgttgcctccctcccagtgataatgattctttggttgagaacagtatttgcatatgctgtctttatgctcctgttccacatcctggcccctgtcatccatacactatatacagcaggattcagtgtgtcttctgcaatcctctctttgttttttctgccgtaggaaacttctaaagttaaatatatgtaacatccttgtcagtataaataaaaataacagaatctcccaaatctacactgtctcttgttttaagcactgtaaaatgtgtcattgagtgcagtagcaatgtttagacataaattactgataggctaaaattaatagcatccattccctttttccactttaatattgtaatagattcctatcatatcgcatattgggatagtataacggatcaatttttaaaacacagttggtctctgattctaacttccagtcaccaatttggtgagtatgttccttggctaataatattaaggtacttggattaaaggtgttaataggagttccttagaaattgcccaattctttgtagactagtgtcaactttaataaaatagaatgttacagttggaacccttttgactgtttcaacagaaacaaatgcatttttcctcacaagactagtactttatgttaaatacagtagcaatattataatgcagcgttgtatttagcacagatccagaactgtgaaatcggaacatcttggtttcaaatctcagctctgctacttggtagtggtaataaacattggttaaatgatgtaacctgtattggtctgttttctcatctgtaaaattgggctactaatcttggcagcttgattgggccatcatgaagggtagatgaggtaatataagtaatgtgtttggtgtagtgtctggcatgtagaagggatagctattatttttattcatttattgataaagtatatattaatcattcactatgtgccaagcactttgttgggcatggagaatttggtatgaataaaacagacacacactctgcttttatggacttactgcctgtctaaccttattggagcaaaggaacagtgggtagtttctgtgatgctatttatcaggctgatatttcttaatcaccattctaatttgctttttcattatgtatcattctaattactatattaatgtctgtccattgcattgaagttcacataggattgtctgaatttgggaaaatattctatgggtttatagaacaggtaatagtatttgaatatctgactcatactgaatgcattttgaaaggtaaggaccatcccctcatgctattgattttgtgttgtgtttctttaaaaaactttctaactttagatcagttttcctggttgtggttctgttagatatgtaatgcattaaaattggaatttaaggctatacagacttaacttgagggcatgacaattttttttttttttagccaaaagaagaaacgagttatcagttctgatattccctgagtaaccttggattttaaatagcctttaacagatacaaccagagagtactttaacagtcagtcatgctgtatttggataattcgaaatgacaagctaccattttcagtgcttggcacagtcagaaaatattcatgccatctgaatggtttccccgtggattagacgtgaaaaaggttctataggaaaggtccaagaatccagactagttttattttcaaatgttaattctcatcatttttactatgaatactaagaaaccacaagggagctatgtgaacccttccacaatttaatcgacttagtctggaggagccttataggagaagctgctagaatgataagaaaaagaaacctggttgatgaggcctgaaattacaacagccattgatcaagagttacattgcttcccagccttaaggctctctttactagtaagaatagtaaaaatcccctctacttccataggtccttttttttgggaagccaaaatatactataccatctttctctttttggtcattttacatggagaaaatatgatgccattttcatttaaaatgggaaatggaaatatttaccactctgatatgttatcagttatagaactcagttctctcgcccttttgtttttcctcttagtcctcccattgagttttaggattagttccaatgccccagtgtcctccagtgagtcattctttactcagtcttgagtttaatatattttttattgtaaaacagggttttaaaaattaaaccaatgtttgcttggaagctcttatttaccagacctgataagagaataaaatataaaatcattgtctctttgtgaatatgtcacaaacaacttgttttatctcaaatttgattttagaattgcatgcacaaattgcaacttagttcaaggatgacagtaataatcaaagcttatctccacataatatcattctctgcccataaatcagtgtcaagaattgagatagaagggactgtgacagccagagctttaagtcatggtttagctgtttgacctttggaagttacttaaactctctgagcttattcaactttaaattacaacttgctggcagtgttcttatatgagctgatttgttcaaaaaactaggcaaacaataattcaaatttattggtgtttatattttaaatttttaatctaatttttttcaataaaatattataacatgaagttgagagtgcaatacaatttaagctaattcagctctttaagtctctgtacatggaaagttaaaaactcaccgagaggtaagtttcaccaaacatttgtttcatgccgggacttcagcatgaagatattatcctacatacttgtactcgaagtcctcacagtctgggtggagagagagaagtaagctgacacttaggatgaggagtgctatagttaaggaatggaaggtggatgggggtcggagaacactttcctgaggaggaaggcttgaactgaatcttgaaggagaaagtgaataaaagtttttcaggcagacagctgggatgggatatttcaggcaaagagagcaatggaaataaggaagattggaaactggaagcaacttggcaggattaaaaaagggggtgttgtctggagacaatgtctagatcatgaaaggtcttacgtgttatgctacaaggtttggattttattttgattttatttttgggaagcatttgaacgattttgagccaacaaatgacataatcaaatgtataacttagaaaaagttactaagccagttttctctgttatatttcaatctggttctttctagtcatccattgaaaatcaacttgcatatcagaggaaacagttatcttgtttaacctaagactgtcatcacattggttataggcatttgtaatgtttatgatctttgttgaaagctatgaaaattgccacccaaatctttaaattttagtagctaacagcagtgatatacaaagttcaacacatttgacaatatcatttctttaactattatagctgaggccaggaaggaaaattttgcttttgggcatcatccaacatcctgagccttttagcacacttggcacaaggatgtcacagacatttcttccaacgtacaattctcacatggtaatgatcagtcatcataagtatattgtatttgacagtgaacaggaagaaaccactagttgatgtcttttatattacacattacacaatctctttctacagcctgatttatagaagcaagatcactttgctaagtataaccttatcaagacttcctggttctgggtccctcaccccttaattcagacagataatacagttgtctgcactcattgcctatcctccaacctcatttctggctagaagcagaaaatacggtaagagtccctgcctctgagtctgaagcaacttcttaccagtggttttcatatgtgcaacgtgggtgttttctgtgtttctggcttcagtttctaacctatttaggaatctatcacagtctgcctttgcttcccatccaggtcaggggcagtgtacatttttttctgtgtgagccaacctccgtcccaagaagctgtatttgtccttgtcctttatagtcttcaagcttttcagatctgcctacacacctgactcaccttttttggtcccagttttcaaaacacaaatacacaaatcaacataaaatgtagcctaacaatgtttggattaaatccaattcaataatagaaaaagctgagatatattgtaatgggaaaaaaatggtggcttggagtcagacatactaccatctattaatgtggatctaccaaatatctgagttaccgcactgagtgccttatgcacatcaccacaacagccctatcacagaggtttccatataggaactgggcctttgagggcttataaacacgcccaagatacagagctgctaaggggtggttctaaaattgaactccagatctgtctttctgcctgggtgctcttttcaccctgcaacactctctgtcaacagtgaatcttcagataaagtgaatgttttgttaaataatgcattgccctggaatagtactttgaagtttataaagtctcatttgatttacagaataactctgtgatgtaagtgtacttatccctgttttccgtgagagaaaactaaggcttggtaagattcagtaacttaaaaaaaattaagtaacttgcataatatgatacaacttattaatgcattccagtattcataaactcaaaatgtcatgcatgtataagatcaagaactcttaagagaggctgggcgcagtagctcacacctgtaatcccagcactttgggaggctgaggcaggtggatcatctgagatcaggagttcaagactagcctggccaacatggtgaaatcccttctctactaaaaatacaaaaaattagccgggcatggtggtgggcacctgtaatcccagctactcaggaggctgaggcaggagaatcgcttgaacccaggaggcggaggttgcagtgagtcaagatcgcgccattgcactccagcctgggcaacaagagtgaaactccgtctcaaaaaaaaaaaaaaaaaacaaaaaaactcttaaaagggacacacttgtattgctcaccccactgatggtaggcactgtaggcactgtttgttgctttggccagatttgttgacaacagtgatcgccaaaggggaaatgtgtatgacactttttttagtccagatttctgctgcattagctttggtttatacagaccgtctatgtaatgcttgcttttctacctgattacatagagtacattccatgtatgaacatatcaaagtaaaaattatatatctccctcacaggattgtttcatatcaggcaaaaaaaaaaaaagtttcctcttttatgtgctttttttcacacagtaatagttctttgctccagtctttattcggatcttaaagctaatatcatgcaatgatgatatattgatgtactttggtttcaaataccttcccccatcacctcccaccatggggagcaatttatgcatttcactatttaaatcttcatttatactactttttattttcttcaggttttgtgatgaaggaacctgtacagataaagccaatattctgtatgcctgggcgagaaatgctccccctacccggctccccaaaggtatgtcagagcctcttgggtggtcttatgttcagctgcttaatttctgtttccaaagtacttttcattatagtcctttctaaccagtgttgacagtgttctgtattgctgcttcacagtgaaagtacttgcattacctcttttgtattgaaaaggtttcatttaggtagttactctttttctgcctctctttggtaagtagtttgcccacacaacagtttagataaaattagaaaataaccaaggatacctcaagccacctttgacctaaggcacattggttcttgacagcagacacatttcatgagccaagagagctaggaattaaataaactgctgtttcagcaaagaattttttacagtcctggaacctaggtatctaatgtgatgccaagacctcagctggctttctgactgcacctctaaattgtacatagctttcaatgtgtgagtgtactaccagactctcatttattacctggatatttcttaaagggtgtgtgtgggtctgttacagaataggtctgtcgtggttcatggatgatctcgtgatacacatgcacctctctttcctcccttactcattgccagcatcattaaatgatgtctgatttcttgcacttcaaatgagcctcagaattctctccatatgaggcagctgcaaccaaacaagtttgaaactaacagggaggtctgtcatagatttgttgacatacattggtagaggagatttgtttaaaaaaaaaaaaaagtatacttctgcctgtaaatattttctctctagattttttaaagctcactagcaagctttattaacagtaagactaataagaatattcagattccaaaaaatcactgagataatggacttcagtaatctagttggtaactggtttcctcaatgacatttttgtagatacctcttttcacagcagaagaaaagtaatgccacttaaatgctcctaagaggtctatttcctatattcaatcacaaaataaaataaatatgaatatatacaaaacaaaatgggagaatgggtttatgtatgtcttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaatgtatgtcttttaaataatcaatagagacagaattttgttttgctctgtttctttcaaaatgagtgaattgtcctcttaaagtgtaagtgattactctggttctgaagtgggaactatgagtagaatttcatcatagttttgaggagattataatgacagattatattagaaattatcagtcaatggtatatttctgttttcatataatataattttatatgttatatgttatttccctttggagttcatagaacagcaatttgagattaactccattttagatgctcatttctaatatattaacttttttgtaaatctttaggtgttggattcagagttggaggagagactggaagtaaatactttgtactacaggtacactatggggatattagtgcttttagaggtaagttttgaagtgttggaactaagcaaaacttctagtactatattgtttaaaatacatgcacaaactattatctacatcttaaaaagaattgcccacaccctctgcccactaggggataacagcttttgtttcctttaatttggaactgttgaaggaatgacttttattttagaagtcatttctgttatgcacctgtgcatcctactgtgttttcttttatgctgactttatagagctctcttgccttctagtgtattgttttatcagcctgctcttgctcttattaggagtgcggatcattccaagcaacactgttggaaagcataggaaggtactggttgtttatatttatgttgctctgagcaagccaccgagagtctataggttctgcaataccaaaggggttctcaaacactcaggctcatgtcgattccttatctatccatacgtggcacttcatgaactcatccattgtccactgctgtaaggcacagaccccagccaccctttagataatgctgaacactcccctagacacctgttgctctaccagtgatcgctatgcactttatttaaatgcccctttccttactatagatcgttagcatgaggaaggggccctgttcccaaggcaaccaagatcaatgcttgttactcctgctgctgcatttagtcaaactccaactgcattcgggttcacactcttgtgttcacaggtgtaaatattaagatttctccttgtcttgtttgcttttctactatgtcttgctgacttatatatattctcctgaattctctaatttgacagtatatttctaagtaacctgatatgtttccctttccaaatacattagctatctctccagcaactaagtttggaagtagatgtccatctctgcctatgaaataccctttaggacctttgctaagagagccccatggggtagaaaggaccatagattgccagcattcagaacgaggacagtaaatgcagtctccctctggaaaagggtgttgaaagaatgattttatgtcattgaaaatgtactataatcaaatatattatcaattaatatatttattaatacactaataaatatatataaattaatatatatataaatggaccagcctatgaacctaacttagaaataaaatttatttttagattaaaaatatgctttgagttatacacaaataacttttcattttttggaatagaacataatcttaaactgttaactctctatagtgctgagagaaggttttgctgaaaacaaagaaataaataatatttgtgtttggggaacaaagacagagattatctgctctaaaaattgaccatgctggtttcagtagaacagacagattgtgagactgctgacttccaaagtattgacaaagctttaatttcctcaaaaaaggcaagcagacctttccagatcaccacaactaaagtagctcatcatactggcgcaggttcccgcaaaccctaatctctaccctctataaaaccctgtacttcacttttcaatctaattcccctcagcgttgtaaggacccctaacagatactgcattgatactccagagaaaacacatgatatatgcttgtttttaaaaatatgttactgtaataatttcttataaggagttaattttgttttataatttatgtttaatctagggatagtaaaagtactgatattttaatatgtaaacatataattattctttgctgtaagagacagataagaaattttaacttttcaatagtagttttttattttctcttaaaaacaagtttttctaaaagatatatggggtagaaagattactagtgctataattcatataacttattgtaatattattaaaatgtaagcaaaaatttcactcatgtaattcattcagtagatactatcaggtccctaaagctttatttagagtagtaagtaaaaacatgggaaaatatcaaatctcactaaaacaatgagatatcgttttatatttattaattgggaagtggtggatattaaattgtccagcatttggatgaatctgatgtgctttaggaggctttataaatttagtatgatgttttggaaagcatttttaccatttcatgtatgtttaatatatagtattaaagtcttgttctaggcttttgtcctaaagaaagattttttttcttaaaaatgctactctatctacccagttattcatgcacatgaaaaactggaaagttctcaaatggccctcactaggacattggttaaataaatggtataacaacaaaaatagccaacaataagatcaaatacagactatataaaattcatgtatgcttaccaggattgtcaagcccaagaaaaaaaggaaatggttgatgaataagaaaggtaggattgggtgatttttttttcctttaaaatgttataacattgcctttataattacatgtttaaattccacaaatagaagcattttgttaactccttcaataccttccagttagtgtactgcactcccactcacacctcatgccaaaaaaagaatatgaatctctatatgcctgatttactataggaatgtattctgctttcagcagcttctgtattgtgatctcatacttatctccagatgcacctagaagtggaaaataattgtatcattttatcttctaattataaaaaatgcattaaatatttatgttatgtacatattatatatataaacaaacacacaattatacacatacatatataatcacagcactgcttttggtgccattgtcagggaagattttatttcgtggttttaaaactattggtgatattttaaagtatataaattgtaaatctgaagcagagtaacactactaggaaattattatattctactgaaaagtggggaaatgtttggcttaagggtatgagcatttttccacacagggaatgttttagacaattgagaaacttaggatctttctttaataaagcaccagaaatgaaggcaaaacatcttctaaaagttgtgggaatgtggtagagtatctgagagagtataacctgaagccatacctgggcatgttttagatcaagcttgtccaagctgcaggccacaggacagctttgaatgcggcccaacacaaattcataaactttcttaaaacattatgagatgttttttgcgattcttttttttttttcttttagctcatcagctgttattagtgttagtgtattttatgtgtggcccaagacaattcttcttccaatgtggcccaggaaagccaaaagattggaccatccctgttttagactgtgatcttccttagtatgaaaagattggctgtgattttagagtgagttctatgggattacataaaatgtttgctttactttgtttttttgtttgtttgtttggtgttttggaaattacacagaatgtgaagctgtaaaataatccttcaaaaacaatcaattgtattaaatgccatatcaaccatagtgtcaagcctatactagtgctgggtatactagtcttcctgcctgtaggagtttattgtattctagtaggtgagacaagcacaaaaggagtgtgtttataggcaataataataatgcatactggatctgaagtctgcagagagacaggagcgtacaagtatacctgaaagtggagaggtatgaagtctgggaaaggctttccagaagttggacccagagcagggtatggaagggtgatcaggagctcccaggccagagcaggagggaagacaggttccagacaaaggtaaaagtagatgcagagacacgggagtgaaacagcatcttagacacaaagaactttgggtcatctgacgttgctggaatgtgaaatgcatagggaaaagtggcaagaaattagaagagaggtcaaaggtggggagcaagccataaagatccttgctaggacttgattcctaaagcactcagaatgctcttcagtcaagctgtaacctgactggattttcatttcctaatgccgctcagtcttgggcttgagtacatggaaaagctactagccttatgaagaaagtatggggctgtaggtggccagagtgagctaggattgcagcttaggaaggccagaatgactttttaaaaaatgtatagacttttaaattttctaaaacttaatattccataggaaataggatgtactctaattagaaatgaatgtcccacgtaggtgatagtatgtatggtaccaggtttggtgaccaaactctaagtccaggcagactggtaatggcacatcctagttttgttaccctcgctgagtttctaaacctctctttgctctcctcatctgtaaaatggtatcatagtggtatcataaaggtaccatacctttatataaataaaggtacctggttaagtagtcaataaatgttagctattatcattatagtcctcatgaaaggataaatttccctaaatacaatattttgtctagttacacataatatgaaaaggacgtggttacttttcaaagatgttgtagtttctcattatttttagacacagaactgttttgagtgtgtcacgttgccagtagaagtttcctagttaagctgtgtttcgtgttctccacagcagtttttgttattcatagttcagctgtacaaagataaactgcaagaccaacttcctgcccttaaggaaattagaatagtgagaattggggattcctccaggtttccctctccccctttttttgaccagttttttcagcgaaatcttgttccgaagtgaaaattctcctgagattgttgctgaatgctgccacatttcttctcgatgttttggcctaggggaatcttaagaaagctctcctctcatttttagaatttctggcattagcttactagtctccaacaataactcatttctcaaattgaagatcctgtgaactcacctattgaagttggaactgatattcttagaatgaaggtcagggtctcttcccaaatgtattgccctgattgtctttggattgtcaagacttccaaactataatccacttactgtcattaagctcttggcgcatatgggaaaactagcagatattattaacaacaaacaacacactctctctctctctctctctctctctgtctctctcggcttgtttccatgcctttctcacagccctgtatgtacacctgcattttgtacatttagtatgttcctggaagtatagccaaaagttttgctttccttagagtgggtgtttaatatttacattctaaattaagtgaatacagcctggagatcctattttcaactctcctttatgtaagctctaagaagtttcatctccaaactttggggattatattagtaaaatcagatcataaagctctagttagaacactcagaggatgattgttttcaatagccaaattttccagaatgctaaggttttaaccctttaagtactataatgttaaaacatcttggatagaaatcattttagaatatattatgtgtctttcctgggcacagtggctcacgcctgtaatctcaggaggccgaagcaggcagatcacctgaggtcaggagttcaagaccagcctggccaacatggtgaaaccctgtctctactaaaaatacaaaaattagccagctgtcgtggtgtgtgcctgtaatcccagctactagagagactgaggcaggaaaatcgtttgaacccgggaggcagaggttgcactgagccatcacaccactgcactgcagcctgggtgacagagtaagactccatctcaaaataaataaataaataaatgtatatatatatgtatatattatacatacacacatatatgtatgtatgtgtgtgtatgtatagatatatatacatataattgtatatatatatctgcactccagcctgggtgacagagtaagactccatctcaaaataaataaataaatatatatatataaaaaataaaaaatagagtatattacgtgtcttaggaagttaaattagatggtacatgttaaatgcctacagctgtgcctgacacagaacagattggcaatgaatgttagttctccttatccccttctcccttttcttcataactttgagatagcctagtgaatatcaatgattgtgctatgatttctttccagtttttaggagtacgtagagtttttccatgtaactgggctcattgccatctcctatctgttcttctgtattttctgtagcttcctttgttgtcaagctaccattgcaactcattttaattcacacaacgcactacatggaggaaaagatgagtaagaacaaaagtctgccctcatagagttcccgtccagtgagcataagtacacttaaaataataaccgtaataatgcgagccagtacaaagttaagtgccatgagagaggggattggaaagcaggcaagatcacacctagtttagatgtttcaagttatcggattgatatcatataggcacccttcttcctgttctaaatttatgtgttagatacagaatctagatgagtttcatattatcagttagatatggaatctagatgagtttcatattatcagttagcataaatagactttggcttgcagcccttaagggaaactttttaaataaaaacatgatcatctggaaaatggggattaaaaaatacaataaaaacatgggaacactgcagcctggactttgtgaccatcagatttgatttttccttgccctcttgcattattccatgctggctgtgatccactcgggtgtggtttctgcaaagcttagttccagacaggtggatattcctgaacacagggtgtgcatctgtgtattcacacaaatacacatgtatccatacaaagggttcctacctaaccacaactgaaagagtagtagagtgaagagccaggaatggtaatcatggcaggaggaagaaaaaacagaggactccagaggaattctgattccactgtgactccagctgtatctctgcctcttagaagactactgccaggaagctattagaaaaagctttgaaattgtgagctcaggaaaaatcccttgctaatgcattttgaacaagatggagcagagatcagtggcaaggtaactgtgcttaaaattatttcattccactataaagcaggttgttctgacttcagtgtaagcatctgagtgctcctgacttcctgacacctaattgcagagagagtgggaaactggatcagattgctccctgttgctttccctgttgtcttctctcaatctgcacaagtagcttcctcctacctgctttccagtgagatacattaatcctgcttttactcactccgctgcgaagtgcacaatactatgggccaggatatttaagcctatgtattttagagtatttcggaatactttccatatttaagaatctcccttgaaattgcaaacatgggagggaggttattgttactgctcctccaacctcagctgacatagacgtccaaaagcaactgagtctctacagtggaagggagacataaatagcaccatctaagcactcatcctagccttccctgaatagggccctggcgtgtacatcagccatcaatctgaatcccctttccagaatagaccataatgttagttcttaccatgatctttcattccagagcacatattgcgtttccaagttctcagctccagagacagcagccctgctgaaacaagcctcacccctgggagatccagaaatgtgtcagaaatatggttccaggaaggatacacttttacctcagttttccttctttattctcaaggctgtgatactcatgtcatctaccaactctccttttttctctccctgactcccatttccaatttctctggtatgctttgatggggatagggacacaaacctttatgcaaatgcttgggggcagatgtggtctggaattaggagcttttaatatttttgaaaggtattcaactgaataaatcatgtactctatcacctttgtgaatctggggcaccatccctatgtagatacactaatgtttctataacaaatgtttaaatattcacacaaaaaggaataaaacataaatatcatcatattcattcaagtcagattttgctgccaaaacttaatgagaaaactttagccttccaaagctgtttagatttcagaattgcaataaattccagtattagaacaaagaaattatttcttcatatttgagttttcagttaaaatactaaaaaggattggaggactctggatgtatctgcacattttccctttaaaataatcttctcttctgaactttatttttcctcttttggaaaatatagaaaattattaaaaagaaaagttgaaaatcccttgtaatacccctactattgaaaaaaattgataaaaccctcttcaatcatacctccctttctcacctaattcctccccaccccagctattgcttatgtctgccaacttttcattagcttatctcagcatttctatatgtggaagataaactaatgtatcagatatgtgtatatgtacttttttcttttttttttggacaagaattagatcacatttcccacagatctgcatctgttgttgttgttgcttttcacttaacagtgtaccctggacatatttctaaggcagcacatgtaaagctcttccatgatttataaaggctgcctagtattcttttgtgtggatatactctaatgtgtgtatcttattgtctattaaagatgctctgagtttttttgctattataagcaatgttagaaatgttttaggtaaccatgtattgctactgcagggcagatatctagaaatgagattttggggtcatggagtgtctaaatcctaacaggttccaccaaatcgctcgacagtttttccagtttacaatcccatatccttgggcaatgagcaagtcccatatccttgcctgcactagatgttttcacacttaaaaaattttactcagtgtttacttaaacagactccttataatgtttcatttaaaagataagaattaactgaaagatcttaatagaattacctctaaagttatatagtctagatcaggatttctcaaaatctaatcagaggaccgtctgcaccagactgtccttggggtactttttaaaatgaaagttcctagttcaaactaggcctactgaatcagatgcacagaaggtagagcataggcagccagagctggctcagataggctcacaagagccaattggtaatttgcagtgtttttgtaagctgattgttaaatatcgcaatcattaaaaataaaggcaagaaatactcaaaaatctttatttcctaattattttactaattttactattatctgtgcacttgagggtatttgcatctgttgtatctgtgtggtggaaatactacaaagtgttattttactgctaatttcttcctaaagcagtgatgtcatgttggtagcttgaaattggctgtggtgggaaaatttacattgaaatcagctatggtggaaaaatttacaccatggaaattgacaaatagtgcaagtcaaagttctgtctattattttgctggttgtctagacctgagaaaatgatggagaggatgttggcaatgtggattactgtaaatgcccccaaaaatttaggacatattcttccaggatttgcagactgttacccattacaccaaagattttactgacatccttaatgtgcaagttccaacataggtctttgttgtttcactaaacaaaatattatttcactaaacaaatatttttgtttcactaaacaaaaatattaacaagcattcttgtctgaactacttcatggcaattacaaccatcagtgggctataaaaagtagagcaaaagtcaaggaaagaattatgtgagagtcaacagcttatatggagttaataatgaaaagtattgtatattttattattatttgtaaattgctgcacatttttgccagtaaaaactgtaacaaacatataaacacaccagtagtgtgtatttttttcacagagccaatgtattactagaatatcactgggcccaggattctgaaattttaacaacctgcctcattgatttttatgcaaactaaactttgacaactggcgctcaaattttcctagcaaggattaaagtcactcctgcatttttttcctgtagaacaggtgtgtcagggcaatctcctggggcctaggacatgagcagaataatttgcatttaccaaaataagtttaattaaatctcaattctcttaagaaaaggggagctttgaaagaagaaaatgcatttaattactgtctggttattctagcactttatttcatttagaaattcgaagaagaatttattttcttaactttttcacaaaatttggcatttggattttaaaattctttaatagaagccacttacaatgcatatctgacattctcagagatccccctccccatatacaggtgcaaaaatgttccttcttcacacttgatttagatatatctttttgaagaatgggccaaaataatttatattccttcatttttttacattttttattttaaagtggaatatatgtgttgacagacactagaaatggaaaggaagaggtccatgaaaccaaatctgaaagagaaatgattggcaagaaggtaacattcaacctgcacgaaacgccatggcctctcaggccttttcagttaaggggaagaggttgaaatgggctgagaaagcactgtcgaacaggaaagcatgacgtttttttccttcttctgaaaagaaaaggagtaagaccaatggatgttatgtgtcatgtactcatttgtttataaagcactcgtttttaaaatcagagacagagaacagagttcagagtgacagaatgagaacagcctaactaaaagggatcatcaggcctcacccttccgttttacagaaatgaagatcgatgctcagaaaggttgcatgacttgcctaaggtagtccagtgctattaaaaaccaaaacaatttaattcatattggttttctagtttgtgtatgtaacaaagttcatgctctaactatgtaaaacaagtaatagagtcactgtttttaaaagtcttttgagccatagttatgaagtgaaatgaactcatgcacagtagaattaatattaataaagatcagagtggtttacttcatctcatttgtgccttttcattttcatgtctgaagtaatccatttcccttatcatgtagagatatttctaaatcaggttgcttgataatcccactgatttcagaattgtaatcggatattcttcatgttcttctctaaccttcattatacacaagcagcttgatgtgagtcatgcgaatgattttaggactatttagtacctcccaaatgatctgaaagaagcctattatccttcagtatttttttcttgcagcctcttcacataattgtgagctctctgattctctagcttgctgcatttcaactttgttaatcatctttagtatggaagacaaatgatcctcagtcatctcattgattccatgggacacctgtttattttaatacctaaatatggccattatgtatcaggaattacactttcattcatagggttatgagaagatatgtaaagcactacagttatacttcttttttaaagaatatattcagaatgttttttatcccttaaaacgtggatttttaaaaaagtaattcaacattgagcagagcgtaagtgatgtcttttttgggaaaagaaaagctttcctacatgcaatttagtttttcagatttacatttagttcttctagtttttttgagaaatccttatgctttacctttattgatccctttgcaactcatgtttttttaatcgctcataattattaactcatttttaaaagctggtcagagctacatagtcatcatctaattaattccatttgaattaatggcaaatagcattaaatttttaacccaagtaaattaagaggagaaataaagtcacttgctcactggcacagtctaaaattaggagctacaattctgtttcagtgaaatgtagttcagggcactcacaacactaaacgaggtttgtttttcactaaccactcccactcccacaggcttcctgcctttcacgctgttccccactgctctcttcatggccctgacatgtttgtttattatgttctaggaattctgggaaaagaaggaatcattagaagtgctgggatttgcacattccatttcccgtttagtactaatttcttttatgttaattgactgttttacttgtaaaacgaaaaggataccctaaatagatacatgacctaaaaaagcatttgatgaaaaccattcaaatataatgtttaataatatggacagaatattctattagcaaaataaaatcaaaccttccctagacccagaagagaacattctagccttcctatttctcccaatagaaacattattcttttcatccagtttggaaacccttcaccttatctccatttcttttcattacatattaattattcttttttccatctttaaaaactttcaaaactctttcttctcatggggtcatctgtcctcccccacacttttcgagtctcatttctttgcaagtacgtcttatccttgtttcacaatttaactgtgatgtacccctaataataactgaaagtaaagtaaaatctggtcagtagccacagacccttctacactgacgttttgtcttatagtataaagtcttgcaaaattccaagggaatgttgagagagaattcaggtcactgaagggtttcagtatttttttcattaacatagtaatcatacttagcatttatatactacttttcaatttagaagtgccttatgttacttttttaatcctcatactacattactacataaacatattgaatgactgaaaaattaatactaaatcaaatgtatgaggtataatgttcaaagtgtattccctaattaataccagggactacatgcatacatagttatatgtaaattagatactttggatttattttttcaccaaggaaccaaaacacaatacagaatagtattgtaaatagattaagatgattgggttgaaaatgtagatactgattttaggttgaccttaaaaaatatatatattcttattaaattatagcttttggagaatataaactttctgtgttcccaacaaaatggatagttttgctgccaggttaccctccctttgtttatcatgagtctttagaggtttaagtaaaacaaaagagagacaacacattgttgcacaaaatagttgagaattccaatgggaatgaaaggaaaccttttatatatgtatacatacacacacacacacacacacacacacacacacacatacacacacacacatatatatgaaaacaccctcaagactattcaaaaatttataatagagaattttatacgagaaatagttttcagctttatattttaaattgtgtttaaaaggactttttaaaatcaaagctcttcaatcccttttcatttcatgatttattttatctagtactttctttatggtttctagacttttgcagctacattctggactcagggaaaaacagataataattgggacaacgcaaaaggaaattcagattaacatttaaagtgtatatatatatataatgctatatatattttatatctataatgctatgtatataatgctatatatatatatcagctatatatatatatatcagaggtaagaaagtgatatatatcagaggtaagaaagtgatatcagaggtaagcagttagtaggccttttgactagaagaaagaggaaataaaaaaagtaaatatttcttagtaaccaagtataatatttaaaactgcccaaccaaagcccatgaagcaagtgaacaagttagttaaatgtttcttttggttttagccaaaagacaactctttcagaagacaaatgaatgtttaaatatggtatatacataaatataaaggtttaaaacttaatgcctcaggaaggggacgtgagtggaggatttttgggtgctggttacatgggtgttagttttttaagtttcctggatctgtactttctgatttgtgcacttttctgtgtatcagagttcaataaagagttctaaagccaatcaataattttgaaatttagcactgtactttaaaaaaataactttatctaggattggtgggttttatcttttaattttactttcttagaaggatgcctctggagcaggttcataattttgagagataaaatagtataaatcataacttcactgtagactcatatttttttgcattcataaaagatggaaacaggaaagtgctcttacattaggtgtgccataacatcctccacacacacagcaattataaaagcaggttggagagcctgccttcctgccttccatttgatctcttttgcgaacagcacaggccatcatttgtgaaagtcgtcgtcttgcaggatggataaatgcgttttctcttccttgccgcaaggcaaatggaagctagtaatttctagtcccatagcagtgaatacaaaatcaaaagaggctaactcaatgcagtgacagcttcaaaaggaattgtttttgaagattcttttttcccatagtgctggtttatttagcactgaaggtcatctgctaacccagctttcagcagcctccaggaaaacctcagtgtagcttgtgtcatgtattaacagtcccccaatttcacttatattttgctaagcagatacacatttgccatgacagcttaaagtgtcggtgcttttgaatggagactattttatctcgatgtatctgtaactggagagtcctcatgctcaggactggtaactcagattttgttttgaaggaactaatttttaaaaaaatctggtaactcagattttgtttgaaaggaactaatttaaaaaaactttaatatatgaattttctggttaatttggatgaccaccatttttttgagtactgttaactgactttaggacctgcatttctaatccagatggtacaaaaaaaaaaaaaaaaaaaaaaaaaagagctgtgtcttagcttcattaaaaccagagtttcattcaacgtctctaatagagcccagagtgaacacaagatctggatccgcttttccctcagttgggttcattttttatttgcctctcatacctatgtcccatctctctgcagcagtttcagttgcacagaaatgaccttttttatataacagcacagcccaactgtatagaaatatctttttaaaaaaacaacatggcccaactgacacagctgacagcaatctgttccaatgctaaggaaactggctgtgttggatctgttaggagacctcactctttattctcctacgggattttcaaagtaattataattatatgaaatttccctcaactttagaaattaatccccaaataatctcctactcctgcttgatcaccttgggagccatgatttagccccagcaaaacatcctgtcccagtaatttaatgttattaatttagaacaaagaaccataaggtaaagatcaaaacagcttaatagtcaaatagttattacaacatctatgtatgtgtattattgcaaagtcatttgcatttagtgataatataaaaatgatgtccctgattcatttttgtttgtatgttcaagacagagaaagtagagaaggtggcctttaaattagttcagaacactctgggagggtgggaagatacgatacagtttagaattatttgcttccaaattttctaaattttttttttttttgaaacagagtcttgctctgtcacccaggctgaagtgccgtggtgtgatcatggcttactgcagcctcgacctcccaggcacaagcaatcctcacaagtagctggggctacagtcacacgccagcatgcccggctaatttttttttttttttgtagaaatgcagtttcaccatattgcccaggctggtctcaaactcctggggtcaagtgattcacctgcctcggccttccaaagtgctgggattatgggcatgagccattatgcccagcctaatttttattattgaagatgttacttctttttgtttttcctaagacttggcagtggtttcaggcatactttttagtacctccttaaagaaagaatccattatccaaaagggtggcttggaatagttggaaatgagtgtgctctaacctttaccttcaccttcatagaagagtgtggtgaattgaaaatcactctacaaatgtctttctgaaggactttcccaattagtgggacgtagtttataacaatacattggttccctcaggatcagcggttaatctgtctttttattgaagcaggaaacaaccaggacaagatgagctcataaagtatagagcactatctctagaggaaaaattaggagagaccaacagaaccatctaagatcatctaagaacgtaagatgtagtaggttattatcgtgcattattccacataatttactacttagctaagaatccaagcaggaactacaagctattattagaaaagcaagctaaatagtttgggatgaataacctcatatcccatgcattcacctcccattaagagaattcctacttaagtggatgtccttaattaagtaccactggttacttacccatttttgcttaattcctctatcttagcttcctaggaattttaaccttggaagtctctaagatatagaacccttgttttttatttttgcctttttttctagtaaatagcatttattaaacattaatattagagaattatatttgatactcagatgtgtcaccaattagctgaattactttaagaggcaacacacttaatctctgtgacctctttttccctatccataaagtgtaagatttgaacttacactctctgagtaaatcatgtctggtttccctttcggttctgagattctgtgagtctatatatctgataaaataattcggcatggttatacatctctgcttaagcagaggaaagcagtttctcaaaggcaagcccagacccttgtgaagcagtcattcagtttcatcttccttaaaattagattctgattgaatgctattttcaagtctcatccagtatctggaaatactcatttctttcattatcagactactctttggaagtcttaccacccaacaaccagcactacaatattgtcctatgttgtgatggcctctaaggcattatcagacttggctattttacatttctttttaaaaattattatttcaacttttccactgtaaatgtcctcaacattacaaaagcttcttgtacatgcatatgacattataatggaatagtgacataatgaaatatccctctcagttttacctcatacctatctagtgaatgaagtttcatctccatatcttgaaaacccttacactaaaattatttttattgcaagagaacaaccactatgaaaaatctttttaacagggatgtcttggggttcagttctctgtaaatacaggacattagtagctaaaggccaggtatttgcctgtgtacctttgagagagagttaacctggcgcccaacccaatgaaagaaagaatatttactttggaataataaaactaaaataagaataaatgaaaccacctgaaaagaacagccgttaggacttttgcatgataatgttgtacagaataactgaatgtacattggaagaataatttcatgatcaacacaaaaatgacctcactgtcttttctacaaacctaggatcccgtcgaactgacttcaagcccaaaactcagaaaaaaaataaggttgtcttgggactggtcaaggagtgcattgttactaaaagtcatggaaggaccctgaaacattatcaacttctttacggtcccatggcctctaatttaagaatttccttttacccagaccatggcatttatcttactaaaatttctttgcttcacttatgattttattctgtatctagctagttcagacccttctgagaacatgttttgcacaataacataccaaatttcaattctaatttcatttttttaactattttactcttttaattttcccatgtttttcctgctttcttctagtcctgtcttattacttggagaaattttatgtgcttcagtttctttcattaaagaaatttcacactcataactgtaaaatacatttcttaaaaataaaatattcatgtactgtattttttggaatataccaatagaataataataactaagcatttagtgattttttcctatgctctaaatagagtgctaagttctttacctaagttatctcagttgtagactacttagagtttcttactggtataaatgttgatcactagtgctaatctattgagtattaagtacctagattttacttctcttagacaaaggaactcagtgagcacttcgttgaaaactgatgatggtcctgtaaggcactatcctatgatcaaataattgtgcaggattgaaaaatacaaatgaatcccaaaccttctatttgacaaatttggcatgtggaaatgtgcaatatttatattgaaatataaattcaatatttatattgaaatgtaaatctatagttcatatagcttatataaactatatataaactaaatatatgtaaaatatatataaatatattttgcttcctttctgcctttccttcaaattcaatcctcttacctgactattttagttttttgattcacgacagttcccatctgttttttaagcagtgggattccatttctgtggtctttggctctgagttaatttgcctatctattcttctccccccctctctcctttttacttttattctagtcacagaataagtctatccagctggcttttccagccaggatatatgattttgatattctgagttcattttctgtacagttcttaactgtctgagtactgatttgttttttcattttatgtagtaaaatattagcagaagcatcaatttttattgcaataaacgttttaactgtcaaatgcttttatgatgatgcatgtcagagacagattttatatatagcctaatgaattgaaatcaattaattcttaggaggtttcatatcttgtggcccaagcactgtattacaacagaaggacaaagtcagagcacactgcaaatcatcagggaaatatgcaaaactagctgaagtttctgagttcacagaagtaagatcagcatagaggttatggaaataataatgcatcactgtggcaaggatcgtgttggaggtcataatcttcacaccaaacactgaggctgaaatatgctgcttatcaaaactgccacctgctataggagcagctgttgatccaggacccctgttggcctccagaccaccttgtttgagggcattcaagttgctcccactgggacttctcactgtgtatatgtgcaagcatatgggctcttcaggtcaaactgtggaaagctgtactggaagaaatttaaagtctctacaataataaaattctattttgaaataatatatgaatgtcagtagacttcagcaatgcctaaagtgtatgaaaacctaaattatgaactacacttcttagaaaataaaaaagtcttttgtttggtgcagcatggagcaaactattttagttcagcaacttttctgggtttttcaacaatacagataatgcatagagagtattaacaactttctagtatctagtatgtctgcaggaaagtcaatatattggtcagtttgatgagtcaagaaataccatagactgcatgaaatgatagttttgtttttgctgttatgatacattggcaattaaaggaattactggatatgaaagtacttagtaaatcataaagaaccatacagatgaaacataacttgtgttttaaaatatttggttataatcatttctatcttactagttggaaatccattttctacattatcatatttaagatatgtgtttctatgtgtgttttcagataataacaaggactgttctggtgtgtccttacacctcacacgtctgccgtaagtacttccatttttcctagaggagcagcaactttaacatctttgcgaacttagagtgggaagtttactgtattaattatctgtgggtaaaaattaacctaaactgggttaaaacaacaaatatgtattgtctcattttcctgtatgtcagtaattgggcacacttagctggatcctcaggcatgtgttctcacacagaggctgtagtcagaatcttggctggggcttcagtcagcttaaggcttgactggggaggagccacttccaacatcactcacatagttgtcggcaggcttcagttctttgctgagtgttggctggaggtcgccctcatatccttgccaagtgggctataaacagggcagctcatgatatggcacctggcctccatcatagaaagtaagcaaaaaaaggaagagagggcatgcatgcaagatggaagccagagtctttcagtaacctaatgttcaaaatggcataccatcacttttgccatattctatttgttaaagataagttaccgagtaactcaggaatggaaaaccaaacattgtatgttctcactcataagtgggaactaagctgtgagaatgcaaaggcataagaatgatacagtggactttgaggacttcccagggtaaaggatgggaaggaggtgagggataaaaggctactaattgagttcagtgtatactgtttgggtgatgggtgcaccaaaatctcagaaatcaccactaaagaacttaggtaaccaaataccacctgttccccaaaaatctatggaaataaaaaaaatgttaaaaatgtttaaaaagatgttactacacttcttttagcccacattaaagggcaggggattagaccagggcatgaatgtcacagctaggaatcatgagagctgattagtcagggttctccaaagaaacctgaaccaatagaatagagagaaagagaaagagttgttgtaagggattggctgacactattgtggggactgattaagtcctaaatccattgagccaattggaaattcaaggaagggttgatgttgcattcttgagtccaaaggcaattcacaggcagaatcctttccttttgaggggaccttagtcttttctcttcagactttcaatggactggatgaagcccacccgcactatggaaaataatctgctttactcaaagtttaatttaaaggttaatcacatttaaaaatcacctacccagcaacacctagactggtgtttgaccaaacaaccaggcacctggccaagtcaacacgtaaagttagctatcacaggaaccatttagagtctgccttcacatgaaaaagtattttttaaggaagaaaaatttttcctctttttctacttcaattttcaaaagcatcacattttataaaccaaagtattgaggtatatgctgtttttccaaaacagtcattttgactttttcaggtattttagaaaaatgttatttttttctgcagacagcctttaattgctggcatgtaccttatgatgtctgttgacactgttatcccagcaggagaaaaaggtgagtaatgattttttaatatttaccattacctcattacctaatctgtagaaatggatttatactgtattttttataaactttaaaaataatcaatatttttatgtcttggaaaaatgaaccaatactttattgtccttggatttaaaatagatttttgtattattccaagccagtggtttattacttttccattctttattgagatgctaggaattgaggcccttgtgtaggtgtgtattatataaattaaagaataaatcttgagtatttaaaaataaatcatccattcttgagatgcagaggacacactgcataatgagcagtgacataaacttctacatagaaagatttaaaaattaaacgactagcaaatccagcaccaacttagtctttaaacttggatatagttggcttacttctctacttgcaaaatggggatgataatagctgattctcccaagcttactagaagcgatgagaataagtatattattatttatcaatatattttacgatcctctgatgaaagtgccatatgaaatattgttcatttgttttcgctgggaatctcttaaagttaatgaccagtatggtctctttgttaccattttttcatctattataaaatgaatatttattgaatagctactgtgttagactataaggaaggaacagtatgaaatggcctcttctcaacaggaactgtcaatgtagtgatgttaggtgtctgcattcaatttttcaaaaattctttcattccaaaaataaaaaccaatttttaagctttctcaactggataaatttcaagctaaaggtaacaaattaagcctatgttttcactaacagagtattttgatttggttctagtcattctgtttatgaataaaataaaaatataaggcaaggggttcttaattcatgtgagtaaagtggctggcacagaataagtgcttaatatctgtgtatttaagtcataagaaaacctcagtccctagcatcttgtgaataccctatgcataattttagataagaataatgtcattttccagttgaatagtgacttttgtctgtgttttcatttcccacagtggtgaattctgacatttcatgccattataaaaattatccaatgcatgtctttgcctatagagttcacactcaccatttaggtaagaactttacatgttaaattataaatatttaccattgtgcttcctggtgccataaattaaaatgcaaattgtgtttgaccttaagtctgtttcaatgaaagtgatttcatataagaccttgaaatattttatgctgttttatcatattgtttttttaagatactcagtctttgcagctctgaaaatactcagatttctactttaaagtaggaaagtaaatatgccttttgtttttctaataccttattatattaaatgattaaaatttgtgtttattacaggtaaggtagtaagtggatacagagtaagaaatggacagtggacactgattggacggcagagccctcagctgccacaggtgggtaaaatctagtttaattttgagagaaaaaaatattaaccagcagaaagtaatttttaaaaattattatgcaactcttgtgaatttctctaaaaatctctaaatctgccttaactgtataactgagctgtataacctcctttttgcaacttccaatttgttgctttctttgtcagttttctcaatatggtcaaaccatgttggtggcctttcacatcccatcatttattcaaagacagtatttcagacagctcttctattatcacatttattctgatttttatgggatgcatttgctaatagtatttttttgtttatttcaaagtttggtgctcttgtcataaagtagaagttattaattaaaggtgaactgtttttatccgatgattaaaggtgaactgtttttatccagtgattatttgtgtatgtgggtgggtgtgtgtgtgtgtgtgtgtgtgtctatttcactgtctgtcttcatcctctctacccagagtgtaccaagcttcacattattaaagcatggggttctgtgatatatcaatagaattaaggtcaaaaatcctctgatcagttgaatggatgctgaaaaagcatttgataaaattcaacatcccttcatgattaaaccctcaaaaaaggggtaaaggaggaacatacctcaacacagtcaaacatgtagttctggattttattggtaatattaatgattcattgtgtttgtctttttggtaggctttctaccctgtggggcatccagttgatgtaagttttggtgacctactggctgcaagatgtgtattcactggtgaaggaaggacagaagccacacacattgggtatgattctatacattccactatttaaagatattttattgggataaggcatgattacaggtgacagctatctttgtgaataaattgtacattttttgtcctgtcatggacaattacaacaaactgtggcattttatcatttcaaagctgattgattcagataaaccccagaacatgtgctcatttttttgtgctactctttttcttacttcctcaaaaccttcggtatcatacctctaaatattacagttatcaaagacttcatattactttctgaggctcatcttaataaagaaaatataatgataatgaaaattttttttctcaagtgcctttttgccctgtgttcacggggtctacatttggtgattcctattaaatactcagaaccatgatgttaaaactctcgtgaatttaataatttccagttgtttagtctactaaataaggataataatatgcaacactttatcaaaaaagaatgttgagccttttaaataattttttaaatactgagcctccttgaaataattatattctataacactacataaaattttcaaagcactatgaactctttcaaaaaaaacttacctaaatgaaaaatgaaaggtagtttcttttcatgctttttgatagaaaagaatcaaggagacttctttttatgttaaacaacttttaaatatttactgatgccatctggaagctagagttttaaaccatttatgtcgtaatcaaagagaagttacagaaagtaagcatctgaaaatatgctttagatgccctaaagatgattcttgcgatagcaacactaactgttggctgtatggagaaagggaaaaggtactaaggcaggtttaaaaaggaaagcaggagcatttgatatagtgtaaaagaatttttatgtcactctaaatggcttttttatataagtaagcataaactttaaggctaaggataaaacaaataaacctttatcaatttctgttacagaaatagtttccaacagctttgcttttggataaatttgctaaatttggcaaagagacttcaggaaagcaatattattattgagttatgggaaacgatgatggtaagaaaaagactgacaaaggaggcataactagatttgaaagaaagagcataacgagtcccttcttaacaatctttacatgaggtaacatgattcagagggtatccatcagttgttcattttatgtcagtgcagagccataggtagtttacttaaatgccccaggttatgttattaacctttgtagtaagtaaatagagcagtaaaaaaatccctttcaacacattacctgcattgacttacaagttttaagtgtgggaaaaaaacagaattttttgcctagagggctctttacagtttgcagcggggaggtttgttactttggccaaattctatccttttgagttctgtctgtgaggtaatatctgccatagaaattaatgacttgttatagtactaggatgggaggccaaagtgatctctggaggcctctatcagttccatgagtctagaataattcttgtcttttttaaaatgtgcattttgctttaaaataataccctaaaatgactacactaatttatcctttcacaaatctcatgtgggctaaaggaaacaccattttgtaataaaaatgaaatagaaaggaattataggaaattaacttattgggtgagtccatattctgaatatttaatttctactacagaggcaatttttttaccagtggaatgacaaacaagtaagacaagttttaatacatttaagtatgaataaaagttttcataataatggataatgttctcatagcagttaatatgctttttatttttagacaaataacaacagcaatgtgtctctgttttataaaataataggcaaaacctccatagatgattacaggatcacagttgagaatgtgaccagtgaaataaactagtaatttatgatgtcggttaaattaaatgatactctgtaaatccatatatctcctctccctcttctcttttcccatctacctccaacccacacatacaaacacacattcccacaggacacagatttgagccccgagcgtgaagcacacataggtataaatcacacttaactaaggataggctggggccagtaggtgcctcctccatgtactgcgagaactctcagcttcaagttttaaacctttctgttctatggttacatagaaactaggttttacagaaaaaccgttgacagtagcctactaggaagatttacagttgagtgattcttctaccaaaatcaagcttaactgtattaagctagaaattttggaactggagaaaactttgcttgggtagaacaatcatgggtaactaatgaacagcacttaaaagtagaggctgattttcccataacagggattcatcttaaaataccacgatgtaaaaacaggagatggatttaaccacctgagtgtccataaatggatgaatgcataaagaaatgtgttttacatacacatgatggaatactatttagcctttacaaggaggggggggaatcctgtcatttgtgacaaggtggatgaatctgaaggatgtattaagtgaaataagccaggcacagatatattaatacaaataccacatgatctcacttatatgtggagtctaaaaaagttgaactcatagaaatagagaatagaatgatggttactgaagggtgggaaaggaggtaataggaattgttgatcagaggacataaagtttcagatagacaggaggaatagattttgagatctattgcacagaagaatgactatagtcaatataatgcactatatatttcaaaataattaagagaggaatgtcaaatatttcatgattaaaaaaatgatagggccgagtacaatggctcatgcctgtaatctcagcactttgggaggccaaggcgggcagattgcctgaggtcaggagttcaagaccagcttggccaacatggtgaaaccccatctctacaaaaatacaaaaattagtcgggcatgatggcggatgcccataatcccagctacttgggaggctgaggctggagaatcgcttgaacctggaaggaagagattgcagtgagccaagatcatgccattgcgcttcagactgggctatagagtaaataacaggagcaatgtttccctgtctccgtctcaaaataaaaaaatattaaaaaaaagataggtaagcaaagtgatggatttgttagtttgatttaatagtaccacactgtatccatatattaaaaaatcacattgtaccttatattacaaaattattttttatttcaatagtttttggggaacaggtggttttttgttacatggataagttctttagggatttctgtgattttagtgcacctgtcacccaagcaatgtacactgtacccaatatgtagttttttttatccttaaccccctcccactcttccctcctgagtccccaaagtccattttatcattcttatgcctttgcctccgtgtggcttagctcatatttataaatgagaacatatgattaagtgcttaccattatttgtcaatcaaaagtaatattaataataaaaactactttaaaagtaggtatatttaatatgagatatattaataaatatacttaatggtaaaatgttttacccatatattatatttatttttaaatagtaaatatgaataatatagcctaaataaagttgcaccaaagtattatatatactgacaacatagtactactaattgttctatgaagaagcaatattttgtgcttgactgcattacatattttatattcaggatgatacttctctaaattcgtttcaaatgtttagtcaagtttaaataaaaacagaatttaattaagtcagccaattaagctcattaagtcagctaatcaggctaaaagtttatatgctaaaatttaatattaattattgggactaggtagacaatatttaccaatttggtcagttttgttggtcatacctttcatttggaatgggtcatttcattaaaatatgaatgttcatggataccaacatagcactttaatctgcatttttaaatatattacatgcaaagataaagttacatgataaataacttcttaatgtatacatttaaaggcaccacgaaactttttaagaaatgattaacagttttgtaaaatgacttctttgaagtttttatatttctttctaaaattactattaccgattttgcctattttcaagcctaacatttgttgaatataaacggggtagaggtgaagaattcttgagctagtggagtgtttgcggtatagacatggaatacaatgatatttggaagtttttaagtcatacatttcagattacttggtgctttattaaatctgtattacatatctttctaatataatatattttaataaaagctctcatggaacctaggtaaatagattagacagatggataaacagatatggatataaataaatattttcagaaatcccacagatcaattgagtacaaaaatttgatctgactcattattcagtagtataatatactagggcaaacatgctatgtcatatgaagttgtaaacatttattaagcaggattattaattcttccttcattcaacacatatttatcaagggcttccaattttcaggctcacacattatgtcagacctaaagctatttatattaagtatgccagtataaaacaggaagttatcacataagcactttattattcaagaagatgaaataaatgcactactgtaattttggaatgtaagtaatgccagcagtcatcattttaaggaatcacactggcattggagaatgtttaaagggccattcagtggacataatctcccttcctactttctcatgttcataaatcactcagattagcagagttgaattgcatatgttgatctcggtggaaattaagggtacatgtgtcaaaatactcccttaggaatacagaaagcaatttgttttaaaatgagattttttgtttttgaatgaaaggtgaatgattgtaaaataaaataagcaaactgtgatgctgatactaaggatgatttgactcctgacatttttagcatatgatagtttctctgtcacataggagctcagagttaccttgactacaagtctaattatagatggaaaggaataaagtatgactctttttgttcagctcttttaatgaaattttccttgtgatagcaaagattcctaaattatttgataaaattcaattttgaatcatagaattggtaccccaaatgaactgtattggtgagctgattaatatgtctcagaaaatcacgtgtgtaaaggcaaacacatttatatgtgtatcaaattaacacataatgtatgtgtaattgaattagtgtattgtgtgtgtatgtatatgtgcatgtgtgtacacacatacatatatgtatactcttacacatatatgcataatttttctcaaaagttaattcagtacatggtaagataattcacttttgaggaaataacctgcgaccttagcttatgtttttatttttattttctcaaatatgctatttaaaataataaagtgtgatcataagttgtagaggacaaagagttacattattcagaaagttactgattttcctttatttgctatacttaagtacatgtgtttttcaaacatgtaaccttgtaccttggtacacactatttctaatatagtaattgctgcctttgtctccaatattagtatataattattctaaacttatgccacctttttatttcatattcttctccataattacgatctataattttcttttgttttttgttacttactgctttttggtgataataatgaatttaatttagtaagagtaaattattgtcctgatttagccgacattgcacaatttaattccttgttctcagattaattacctttcacttgtttgaaatgaaatttttacttttagtacaattttttttcaaatgtatgttaaaaacaaatccttccaaatatacatgtaacaccaaaattatctttgaggaaatatatattaacaagatattttatattagttattttgaagctttgcagtattagttgcttcttaaatctctaatggatttttctgaaagcttgaactatgtgtttatctgaatggatggacagatggacagatagaaggatatagatagaatatacatagatatttacctgtctttatacagataagacatgttatgaaacatttctagctacacatctgtatgcatatctatgtatattcatttgaatagctttatatagctttactacatgcacactactctattgaagaaatccttttgattggtcattcttaaacaatactagcattttgtttctacctacgtaagagcaagtcttacagtacagcttttcttaaattatgccctggaacacacagcaacacaaaggagcccggtcagattcatttagggaatagaacctactgtatccacgccccccaccccaccatacagtcatgagcacattgtgtattaaaggatcaggcagtacaacattgtttaacttgtatagcccaacattttcatttgttcatatggtaagatttttgtttgtttgcttttttttttcttttcttttcttttttttgagacggagtctcagtctgtcacctaggctggagtgcagtggcgtgagatctcagctcactgcaacctctgcccctgtgttcaagcaattctcctgcctcagcctcttgagtagttgggattacaggcagctgccactgcgcccagctaatttttgcatttttagtagagacgaggtttcaccatcttggccaggctggtcttgaactcctgacctcatgatccacccacctcagcctcccaaagtgctgggattacaggcgtgagccatcgtgcccggcaggccatatggtaagtttttctcaactcttctgtaagcatttcaaggaccaaagttttgtggtaataattgtggaaatactactctagtaggaagagtaaaaaaagttctagaattccctctctaagtattttataaaaacatataatagctcacagaataaacaatttccatttatgcaacagagaacacactggcccaagggaccaacaatatttagaccagcagtgatagttacttcattgtgtgtagctttttagtaaggaaaaaaatcaggatactggcttcttacatatgctgttgtgggtgggtataccttctccagtgaaaacatgggtattggcattcccaaaaagagaaaatatggaaggacccatccattgatgagttgcaagtttcatgaattattatatgaatttaaaatgtttttcctttcattaatttgagatgcttaaatgattattttgcctttcctctctgcaagatgattaaaggtttttaaagctagagccacatctaaaattcctttttcctttttgctcagttgatctacatatacctccttttttttaaagcaggaaagagaaggataatatggcgggaggctccagtttattatttttgcaacagccattccttttatagcacatactgaccaactccaaggctgttaaaatgtaattcttaggaatggtgttttgacaccatgaagacatgtgtagtgaacagatgtttgtttggctttgcacttcactatttgcttatatttcacgggagaggcaattacactgacaggtatcagattcagagagtaagaagccaaatgatttctaaagcataaacagagcttcccatggcaggggcttattcctgtggtctctcaagggctctatattttcaaagcttagagaaatcaaatccctgtttgaaaaatatttttatttttttccttcccttgctgatgtcatactgttgctatggagagaaagtgagtgctgcatgacattgctggaaaaatcaacactgatgtatttctgtacagcaaataacctacctcatagcttttttttattagtgtaggcttgctaaaaattgtcaatactaatactaaaatggacatgttcctttgcccaaacaactttgctatgtaaaagtcttgtgaaggtgtacttaaatggttccttcctaataatgctaaagagaatgaaatatataataacccatgtgaagtaaggaagcagaatacatattttgtaaactattagatattttttctatcattgggaacttttttcttggaaatatccactgttttaaaatctatttttaacattgagtcattcaactgtacagcactacttccgtcacatctcaacccttaaaaaagattagtgctgatttcattttgagtcattcctgaggcattcttttcaaccctgctataaaagcctagttgccaagtcagacatcagggatacactttgaatgtcttagtggggacacatgattctagattcatctggctgtaaggaaggaggcagttaaccaaaaacaaggtccaggacttttgatgttaagaggaaaagccatttttaaagacttataataaataatatatgataattatattgaaggtttctgatttttaccattgttaaggaaataataaagattttccacgagaacaataacttttcccagtctatgagttttagcaaataggaggggactaaagaataaaaagattcaagagagaaaagaaagtaccatattccctcatctactaaaatgccattttcatcagtggtatttagtagtgttcatggtgtgcctgcaaactgacactccattgttaagtggaaatatgcctttgacaatgtgcttttgatgttgaaaactgtgatgggttttaatgaaagctataaaataaatgcacaatatttctacctttgaatccattgctggcagatctaagggcttcatttttcttgcattaagcatgtgttttatgtgaatagttgatttgttatatcttttttttgcctgcagtggcacgtctagtgatgaaatgtgcaacttatacattatgtattacatggaagccaagcatgcagtttctttcatgacctgtacccagaatgtagctccagatatgttcagaaccataccaccagaggccaacattccaattcccgtgaagtctgatatggttatgatgcatgaacatcataaaggtaataattgatgtttaatataaagtaatatatgattttgtattttatatttttgtatgtatcttgtttgatgatatttaaaatcatctttattcccttcttctaccagtcacatgtacacacatatttcttattttctcatttttctctttcatatcctatctcccctccctgacatgtacccatcagaacagttaaagaggaaaatctcagccagggatgaaacagattcattttgggaccaatcccataaatgtagaccttttttcacttaattcatgttttctcatttcctcatctaactccttccctaaccagtaatgacttacacagtttatgaatttatgcaccatgttctaaagatcactacagtttgccagggaaaatggttatcatctccagccatactttaaattatccatttaatgggcttcttcaggcaaagaacaattattgatttgtgaagcattgctagtcttgactttttttatctaattctcagaattgttatttaacatatatatagttcctctgcaaaatggtcatattgactgtcactttttaacttaaaattgcaaagtctactccttgttttatcgcatgaagtatgctgagacttgattgagttttgcaagttcagtcttaacacgctagagcagcttcttatttctttctagtggaaattttatgagagaagttagcatagcattctggccatttattaagattctactatatttatagaatatgccttaaagtgttcttaaatgttcttaaaacagtgctaaatttaatttaagaaaacaaatatgagtcattttgtcaatgcattttgaaaattctgtatcatttatatattattgaaagggtagttgacctagttattaagtcagatgtcttgtaattggtaggttgtgctggggggtggggggtggggagcttatgaattagagcatttctgtcttataaattcttaatacggtaataagcacaagaccctgaatagtatttttatgttgatggactatttccaataaactattttaagtatgtaatacatactgcaaatttatgctcagcttctttgatcctttacagaaacagaatataaagataagattcctttactacagcagccaaaacgagaagaagaagaagtgttagaccagggtatgtatgcttatttctataactagtcctataaaagtatcaatttccaagtaggcaaccaaattgtaaagttactgagatattgtatgtctctctgtatctgcctcaaacactatgtattgctatttttatacaatgcataattcatgagaaaatggtcaattattgcactttagctttgaaagtaaaattcattcatataatttagtgctgtttcattttctgtctttgttttacttcatttaatattataatttttatgtatagtacaaataagtgcaagcataatcattaaaaaccatcaggctgcttttgaaatctaataaccttaaccatttaaattattgtatattttgtatggtatgttcattaagtagatttgagattcaagaaaaaaagaaattaagaattaaatccacatcttacctctataagtcattcttctctgccttcatcaaggtaggagcgattattgtcttatacatctatagttttgtgttaagttgccatctgcagagtttaaaaaaagcatcattcttcccctgttctgtttattgaaagtggtaatgtttgatgcttgtatgtcatatactgcatgtgctggtactaaaaaattacttccctgaatcttggctttttgccagttgtttggaaggtagtgctttgggttaggctttggagtttgttatcctaaaaagttgtttttggcctacgatacacgtttttaaacgttagtttcatgttaatgcaaacccacttctactgacagcacaaataggaatagaaaggatttttctattagcaacatgtagaagtttcctgtttcttattgctagctgctattggaattcttcaaaatgtattacattaggtctagttcaaaaatatcactcttgtatgaatagtttttacaaaattaaacaattgagactttagaaaggggaaaatgcattctgaaagaagcataaagtaaactgtgatcctgaggtttttaaattatacagcggatgttttataatatctcattctaacaaagtgaccttcaaaaaaatacagcttagctcaaagcactaaatggctgagtaatttaaaatagctaaatttatcaatcctgtttatatatttgtaagtaagccagtaatagcagcctaaatatagtggtattcagagtgtttactgtaacttcttatgaagtttgttcagactttcaatgaattattttgacatttcaaatgctatttgaaatgtatgtctttaaaataattttgtcttagaatacatttacaaataacaacatatatgaaacaatacggaatgagataccaccatttaatagatgcatcttataaaatggtatgtttctatggaaactgcagttggactatggtttccttttgaagttagtcaagttgatcaagggaaacactgacacttctaaaaggttaaaaacccaggggttttgttagtgaagcggtattaaaggttatatttcatctgttctttccaaatagtaggatgtaggaggtgttatatacgcctacaaaccagattctttaaaatactttcataccttgccattcatttacccttttgtgttttatagcatatatataatattcagaggtgaacattatctatatacccaaatatacaaatatacccaaactcttactggtccccgagaataattctatggacacataagaaattattttcctgcagtttctattttcttctgtttgtgaataaaaatgctgtaactaaaggtatttaacttgagaataaaaaagcattctgatattatcaattttcatattgcagaaaataggctgttactcatatgttgaaattagtgggcccattaaaatgtcatctctaatgacggtaaagacagtagcctaaccaaaagccatttcaatggctagcatagtctgtgtatgatcctaccagtctatggggaccaccagcctagaattaaaagagaaatacagaaatgtaccaaatgcacatttgtacacatagttcatgtgatgcactaatgagattagtctgtctccttacaacacatagggcaaatctcattgctgaaagagtatttcattcttcttagagatatttgtttgcacaaagtgtctatttgtatgcattctttggaaagtcaacttgaccaagtagctaataagggggctttaattattcaaataaattatgccatgtatgttaatttttaaagtaagccctcaaacttcacttatcactttatttggtgttctggccaaaacaatttgtgtagtatttctttacattgtacaattattttaatactttttagccccaataagcaaaagcccacattattgtggttgtgctagccacaagctaacagacaccatctatgttggtcctacagaagatgtgaaacccctgtagaaaacagcacaatgtggggtaggaagaaaagacttgaaccatcgatggatatgtactcatggacaagctctatacctgttagtgggtacagatagttctgtaagtgatgtagatagttccacctggttaatactatatatagtgtatatgtgtgtatatatgcacatacacacatacatatatatattaaataaatgctatttaaattgtactatatatagtattatatatatatatttacttcctatcttaatacattggaaaacaggtagaaagatataagtcaagatatgtaataaatgttatgttagaaagaagaaatgacctttactaagatagaaaaaaaagaaggaggggagagatagaaataatcatattccatagactaaaagaaagaaatgtagccatgccacaaataaacaggaagtgggagttatctctaacatggaggaaaaaaattcaaagaaagttagtgatctttaaagaaagccagtgatcattaaaacacagatttatttagtactctgtttctccaggagaaatatattttctttgaaatttgtatctcaaaaattgctagctattgatgttttgccagaatattaatcttgattagaaattaactagaaattaactagatgtcttgacatctaagttgtgcaaatccagtctgtgctttctcacaaacacactaacctttcaccatatctttgtctacatctgctctctgtagaacaaaatctggtgtaaagcaagtgtacctcagattctgtctcaaaagatgtaattacagagacaccacaaaagcatcattatatgacagttttacttatcatgttgtcctggatcatgcaacaataggaaacattttaatgaggctttaattgagtctgtagggatttctttaaaaataatgcttattttgactgattttttaaaataatattcattataaaagataaggaaattatgtaaagtataaatatacaaatagaaatcatccgtagtccccagaaacatgagtacatatatgtatgtgaaatatatattatgcatatatttacatattcaatatatgcatatgtaaagcacattattttaattataatgtatacacaatttcatagccctttttaaaaaatataccttgaatattttctccagtggtaaaaattattggcaagagtgatttttaatggctgcataatacgtgcatattcctgcctatatcaatttgaaaataacccatttgcatataagggagtttatctgcgaatgagttgattatgtctgcctacagggagaaaaacacaaatggatatttaaaacaaactaaaatgtcaccgtccttcaaagacattgtgagtgaagaattacctatatatgtaataagtacaataaactatacaatagactcaattaggcagtgattctgcatggaggaaatgaatcctaggagactatatagaatgaggaagttcacactgatgtcttccaaagcagacacacacacacacacacacacacacacacacacacctcacatatattaaggttggcacttttagaaaactaacacattttgtaagttctctttatttcttatgcattataatttcttatatgcgttcactataccaaagctataaacatcctgaactttctataaccattgtttaagcaaagaatatgggcttgaaactaagaagcttactagatggaagcaaaagtctacacaattacatttaagagttctgaatttgagtgtctcacctctttaatattcaaagtctagatgtagtgttgaaacttacgtctgttgtattgggaagattcagtgtcttaaattccaggcagaattgaaaatcaaaatctataataacagtatgtccttgttattatgtattatgctctagacaacatttatttggctgcagaaacagcctttaacatgttttattcagtttgctccaaaatctcctcattgtagtctttgtgccctcatataatcaatctttctactcaaaggtcagcataagctactgtattcccaaggcagagagaatatgacaaaaatataatttattgagggaaaataccccatgaccccagatagttaaaggtcttcggacaccttctgtgaaacagtaatttcacagtggttttatgctaacaaaaatgaattaccattggcatgttttatcaaataagcagaatcaagggaacaaggttgccagttaaaaacacaatagtctactgtcaaagcctgctaaagttacagttgtaaacagtttatgggaagagttaaataaaggctgggcatggtagctaaaatttatatttcattgatttgttcaaaatagggcattcctttgatcctctaataaaacacaaataattttagtaacatcttcttaactaattccaagcactctctatgccactttgctgttttaaagaagatacagtttttgtttgtatgcctattcactaaaaatttattggtttcttatgatttatgagcacttcacaagtctttatttattgaactcatctatcaaacacaattctaaataccccccaaggctctgggaagctgactgaatgctgttttgaattggtttcctaataacggaataggcagatgtgaatgatcatttatcacacagttaggctttccaatatagatctgtgtgcatggtagttatgaaaaccatcatcttctatcttctccttttttatatttgtctcgttttcttaaaaaggaagaaaagttgatttctgattgcttttcaatcaaatgagccctataaggggaagaaataataaagttcacttcatttgtgatccttgagctggtcaccatggtcatgtgttttatttctctaaggctagagaataaatattgtgggacagtaataagtaaacaatcaataaaccaaattgactttaacccgaagggaaaatcagttaagactaagtcataaaacaaattattaaattctaaaaagagatgcttttatttttccattcctcatatcctctcattaatcagttatgttccatggctctaatcatgttaacttggttacttgacatattttgtcagtggctaaactgctgctgaacatcctatttactctccttatattatagaaattgcagaacaataagcagtaacaagagctgggtttttttaggtaatgaagaactagtaatgtgtgtgggaaatgggaatttatattctggaaagttctgagaggtatttgatcatttttaaaaaataatagcacctgcctcattaagattttacaatttctaaaaaattagatacttttttttttctatccagtaatcttaaagcattttttaaaaaaccttcataggaccatttttcaatgtatatttcatctattttagtttttctcaccatattcctgaaagtacatcagagaaatttccatgctgggagcagggaatagtgagtggtccctgataatagaaaaatgtccattgatccacaaagcagttaatgcaagcacacaacttaggaactttaattggtggtgttattagattcccatgtactatgctgcattccttttctccacacattagctgctactatagttgtgttttccatataccaaactcacacaattgaattccttaaaagatctagagcatttgggtattttataagaatcaaaagttagggaataaaatttaaaaatgggaaattactgcagcctaaaatcatcaaggaaatatttttatctctgctaatgcagatgcaagggctgacatttttaacaaattattattcatcccagaattgcttattgagtatctgctaggatagggaaagtactaatctctggaactatgacaagaaataagaaatgagagggacttttttatataaaactatagttctatcttgtaatttctcccttcccagagataatttaaatatacagaaagtatttttagaacatcttaaagaatttggtcatacatgtaaggtacattttttcaaatcaaagaaaactaggcctttttttttttttttttgagatggagtcttgcactgtcgcccaggctggagtgcagtggcactatctcagctcacagctcactgcaacctccacctcccagattcaagcaattctcctgtctcagcctcctgagtagctgggattacaggtgcccgccaccacccccagctaatttttgtatttttggtagagatggggtttcaccttgttggccaggctggtctcgaactcctgacctcaagtgataggcctgtcttggcttcccaaagtgctgggattacaggcatgagccacagtgcccagccaaaaactagtcattttttaagctagttttgtgcaaatcgctgtggtatgtatgtattgaccagtttgcacgtttcttgtgttacgatatggacaagatagaccaggatatgacaaagagaaacccagttaaagaataaacctagcacttgagctcagaagatggttaatttaaaaagaaaaacaattaagttttttatagtaagattgataagtttgagaagaatgtataggaaaaagtgtaatggccagtacagaaaagacagggaaacctgaatccagtctagtgagcagtttggagggcaactgtcattctgaccgtctccttcaaatcccagttcaatttcctaccagctgtgcaggttagtactgtaccttttgtttcctcatataaaataaggacaataataacaatttaatagagattaaacgtattaaaccgtataaagcattcagcaaagtgaatggatcatgctaagctctcaagaaattttagctgctattattattttctatagtttatattgttctgaatatgttaactctgtcaacaattggtaagcagcaaacgtctccatttttctaggactgtcccagtttatgcctagtataaatattattaacacccttttccttttaaaaagtattctagtttgagaaacaaattatatggtcaccttagcagggagtcccagaatagaaatagaaaataccacccagaatatacccaaggattttaaatcattctactgtaaagacacatgcacacatgcgtttattgcagcactattcccaatagcgaagacttggaaccaacccaaatgcccatcaatgctgcactggataaagaaaatgtggcacatatacaccatggactactatgcagccataaaaaaggatgagttcatgtcctttgcagggatatggatgaagctggaaatatcattctcagcaaactaacacaggaacagaaaaccaaacactgcatgttctcactcataagtgggaggtgaacaatgagaacacttgggaacagggaggggaacatcacacaccagtgcctgtcggggggtagggggctaggggagggatagcattaggaggaatacctaatgtagatgatgggttgatgggtgcagcaaacaaccatggcacgtggatacctatgtaacaaacctgcacattctgcacatgtatcccagaacttaaagtataataaaaaatgccacaaatcaaaatcaaagttagtccagtggaaaaaaaaaaaaagaaaagaaaataccactcagaaatatatagctgaacagagctgtggaaaaggtagctatggggatataacccaggagtgtccaaggtgggtagggtgccatcaatcacacatcagttccgtagaggtagagccacttttaataccatcctagacagattttgtcatccagagcagagatgggggtcctttctgaggaaggagaagagtctttcactatgacaatcaaaagataagattcccaaatgagtactggtggtaaggagggaaaagttgatgttgcaaatcagcctaggttggaccttgtgattcactggttagagagagaagaacacagttttctgagttgatttactcaaaaaagtgtcatcactaagagagacactattaaaaggttaaaatatggcgagaagattaagagctccattttagacattttaagttcaaatgagacagacagacatccaagtgggattttccagaagacagttttgtaacaccagtttggtgttaggagagctccaggcttggtagtcatgtgcctggaggtggtagcttaagttttgtaagtgactgagatcacttagtaggaagaggctttagccaggggaaaaatgtttcagggacagacttcccaaaacaccagcgttttttacatgatggacggtaaaaagaggaagcacagatgataggtggagaagacctgtaaagaacaacattataaggagagaggttctgaagggaactttcaacagggctacagcctcccagtagatcaaaataaagagtctattagcattggcaattaggatcccttacctcttggagaagtcatacaacggtgaaataggaagtggaaagaaatgcatccaatttagggagggaaaaggatgtaaggaagaatgaatcagcaagtagccctgcaccatccaatatggtaaacactaggtgaaaatatttatgttttgaatataaattaattcaaagtaaaaaattaaaaattaagtttctcaggtgcactagccatttacaaagtactcagccccatgtgtctgtctagcagctattaggttggacagtgcagacatagattacatccattattacagaaaattcttttggacagtgttggagcttgtaaaggaagagagaagatggaaaagcctgaaggatatgttatgttagaggagagtctctccccacctccacaacaactcaagccctaagtgagtgtatgtatagcctgtgagtcagatatgaggtaaagaagttgtatttattaataaaaaagaaaagagagaagacaggagaggctttagggaattctggaggaatggcattcagaacagtggagtagagagagttctttttccaaagatacgctaaaagagatggagaaggtacagatacagcctcctttggcaaagccagtaaccaattagctgtagtagccacagtgacttattaagaaaatagagggctaggaacctaaaagggctttttttttaattttattttttttacttatttattttttgagactgagtctcactctgtctcccgggctggagtgcagtggcgtgatctcagctcactgcaaactctgcctctggggttcaagcaattctcgtgcctccgcctcctaagtagctgggattacaggtgcccaccaccacacctggctaatttttgtatttttagtagagatggggtttcaccacgtaggccaggctgttctcaaactcctgacctcaagtaatccgcccgccttggcttcccagtgctgggattacaggcatgagccaccgtgcccagtcctaaaagggctttttgttttctattacaaaaatccaaatgtttgactggaaaaaggagctgatttttaaaatattatataaaccacaggttgaagcagatgcatgttgcaattagtttgttttttcagtcagtaattataatagctataatttagtgacacctactttatgatatgtactggactgggtattttaatattagctgtcttctttaaatctacaaagtaatttctaaaggttattgtcactatctttattaagttaagtagaatttacttaaaggcacaaagtagaattatttcttaggggcacagaaatagggtttgatgtgtatttgaattgaggagttgccatacagggaaagaccagagtgctataggtgcacccagcagagacccctgagttgaattgtcaagaaaggcttttttgatgtgacacctaagatctgaaagttgaggagctagtttattagtggggagggagtggtccaggcagaagaaacaatatcttcttagagttgatattcaaggaaatgaaaagccaatatgagtggaacataaactgaaaagaaaaaggaaacattgagagatgacacaggggtcaggaccaccaacttgctttatttatgttctactccatctgttatattcattagatgtattttctaaataaacatcttaatgtgactaagaaaattggttaacatttcaggattccatattatatctagtacactagaagaggaaaaaactctttctggtttgcacataggaatgtaagagatagccatctagtggtctctctctcatgtaacaagatgtttgtacagattctgctctgaaactttattctggcaaggcctgtgcaactgtgtgcagccaagcctgttgcattattttaacaatttttgctttcctaacccaataacaattttaaatgataaattcacatgaactggagtgctctacctttggtattttatcacagcttttagatttcctcttacaaacctgaatgactatgcatagttctgaacctgtcttcctccatcaagattaccctaaacacagaggttgcagtgagccaagattgtgccactgtactccagcctgagcgaaagagagagaccctgtctcaataacaataatagcttaaacatatggattcaagtttttatttaattttaattttttttgagatgaggtctgtctctgtcactcaggctggagtaccgtggcgtgatcatagctcactgcagccttgaactcctgagctcaagcagtcctcccactttagcctcccaagtggtgaggactataattgaatgccaccacacccagctaatttttttatttcttagagagatagggtctcactctgttgcccaggctggtctcgagctcctgggctcaagcgatcctcctgcctgggcctcccaaagtgctgggattacaaatgtaagcctccactcccagcctcaagtttttaaataatggtttatctctccctgaaatactcttgtattttatttcctaaataagacgtttcattgtacaagcatatgaaactatttatatttaatgtgtggtacacgagaatttagcagtaatgaactgtattaatttttcttctgtgaggcagaatgccactgtgccctaacagatttggttgacttataatttgctttgtttattttactgagattggccctattacttggtaattattttctgattgaagatttcacctgggataagctgatttcactggcaagaattgaaaacctactttgaaacattaaaccaagactatttgtaaacatgacagaatctcttagcatcattttggaaagacttcatctccccttgcaccactttcttaataatatattcttcagtgaaatacatcatggctaaaccagttatcattttcatttcctaatggtcatgaaaagagattttataaatgttttctaattgtgctgtaaatgtaattaaaacgtaagcaacaggactccatagtcgtaagtaatttcatcattagcagcacctagtataggatgaggaaaaggaagaactggtggttgcccttgggtttggtgtaggagagcagatttgtgttttcattgagaatatgtttaccattcacacagttgatataaatggatttgaagtcatcgtggaaatgatgagggttaaaatacttcatgaactttctgtagtcatattttgtatatgtgataatattttacaaataatttgctttcatagaattggagtctcatacccaagtttactccttaatacaggaaggcatagaatgcattttagtgatgaatcaccctaatgatatcagtttattaaaatcttttcctttgtttgaagctgatttaaaagtatcctttgctcaaaaaattatttttctcacttgctcattttttgtttaagaggaacaactagagcttacagtagcactgctaacaaaataataataaaatttaggtttcccagttgtcaaatggatacgtatttacttgtgttttacaggaaatgtatatttcctgctcaagaaatgtatatttcatttcttgtggcttgcacttcaataggttttaaaggacaactgcaaagagtttcttgtgcagatagctgttatctaatgtagctattgatgatattttattttagaaatctgatgagctcttaatttccgtatcaaactatactttgaaaaccatttattgaaatgtgccatgcaattacataagcattattttttctactaatatgtcaatagatgttatacataaagaaatagatgatatatgaaataaagtatttcatcggtctaggaatttttcttttttttcctcctatgcttaaaagtctgagtgcaaacttctctcttatttattatgagaaatgagtagatattttttaaagcaccaaattttgtaaattttgcaatcttatctaccctccacgcccttatctcttctcttttttccacaggtgatttctattcactactttccaagctgctaggagaaagggaagatgttgttcatgtgcacaaatataatcctacagaaaaggcagaatcagagtcagacctggtagctgagattgcaaatgtagtccaaaaaaaggatcttggtcgatctgatgccagagagggtgcagaacatgagaggggtaatgctattcttgtcagagacagaattcacaaattccacagactagtatctaccttgaggccaccagagagcagagttttctcattacagcagcccccacctggtgaaggcacctgggaaccagaacacacaggaggtgcgtgtagggtttcttttaagcagtaaagtgtgaaatgctacaatccacgttagcaaaacctgaagggaataagaattaatgggtgaaaaaattcatcaatgaaaaggacttatcattagaaaaaaattactcagatttgggctatcagataacatctttgaagatttttttttgttttggttttggtctattactgcataaatttagtgtctgttctattggtgagccagaactacaaggaccaaaaaatatttggatcatttggggaaaggaggcatatgaaattcaggataaaaattcttacaattgaatatttttcattttgctcaatggaaatacattgaaaatttaaaacctgatatgtaaagtcccagtttaagaaatgctcatatactgtctccttgtaaggtaattaaattcctctcaaatgaatcttacactttcaacattctcatccagttgacttgtaaaatataaccatttttatgattttgatttcttaagtttcattataaattacaatcttaattggaaagttgagtatttctgaagggacctctactaagtcaataactatcagatttatctttatttctagcccaaataggcttccataagtagaggaaaataccttattcccttcaggtttccgtaccagcaagctatggatgcctcatctttgtctttaattgtgttgtggcctctgtgatattgattgcgtttcatgttacttgctaatgtggaaagccagataatacagcatgtggagataatctccaaaaaagtaacggatatgcgtgcatggcagctgtccatgtgtgggttggaatggcacaggctgccagcttgatgttttcaaattcagctttgtaggaggccataaattattcaacacccagctgatttttatttataattgaaaaaaaattagcatgcagtgccttttgttcacatgagagtttcaaagcatagtccattggtactggcctaatggtttctgtgagatgttaactggaacctggatttttaacttttcatgtttaaacaggatcagccctgctctaactcattctggatttgacaaataaaactatgtttctcatgaggtggtccctggacctccttgcctcagaatcacctaggatgcgtaagaaaaatttagaccctgaatcctatcaaagaacaactgaatcagcatttctgagtatgatgcctagaaatttgcagtttatcatgcccctatccatttcaaaacacacaggaatgtctgcctgaacttatattttaaggacagtgaattgtaacccagacaacatggaaatataaaagggaaaagagcctctttggtgggaatacaattgtgttcatgtgtgaaatgtgagttgcagcatgctttatttattccatgacttgtctttgttattcttagatttgaaatgatatcatggtcatttgtaggcatcaagagtgtcagtgtcccagtcagaatttgacttaagatattgcatttctgaaacttactcagtttttctacgaaataaatccttaaaatacccaagtgcatgtacttggcaaatatcctcatactttccaaagtggtcaaatggtagtgctcaagagaaaaatgcttctctagtatctgtttagggaaatttccttcctgtgaatgtcactgacgtgaataacatgagtcatagaaacatacagcacaactgcaaattaataaaggaacatgtatttcctttctaaaataatttaatgttatttccctactctaattacaaaaacttttaaaaaataaaatgcaaaacagaaaaactcatatttaggtaagctgtttctaaaaggctttttcttaattctctttcaccatttactgtaatgcagtgtaatatctaactttaatcgatgctgtttcattcctttgggtaagccagaggaaaacctatcctcaggaagcttccattttgtaaaaaaaaaaagtaggaagttattagcatataaggccctaataaaacttattagtaatctaattaatgtctagtcctcagggtatagtcaaagagaataaatttgatggataattttccattgtttctttcatacccttctccaggcaaagctgagaatgagcctaatggtcggaggaattaactgtttccctaagtgcctaatttactataaggaattgtatttgctgcatagaagaaagtaactttttatatgagattattataaaaacaaaaatgtcaggctggtctgttgcttaatattatagctcatacttatttcagatatctttgacatctcttgttaattttcaaataaagaagctgaagccagaagttaacctgtttgaatgaggtcacagatctaaatctgaaacttggacttgattatttccaatgtgcatcttctagtttcttacatttcaatacagttgtgctcaatcaaagagatcctaatgagcttgcccaattaagataaacttcccaagaacactggaccctcactgcttagaagatggagatttctattcagaaccctgatctgatgtccccagttgttgacaccagcataatctaatacaatggtgttttctgcagcagtattttagatttcatcagttggtctatatgttggaactgtaatatgatgatgaagcccatccagttgacctgagggttcaaaggtgaaattaatagatcagctcaaaaatgtgggtgtgactatatggtaggcctaggaacacctgagggtttcaaaaaccatactattttctgaacctttagtttggtcaggattccacttgttttccaccctggcatctgcctttaaaactgggttctccacctcgttacgggttggatatcagtggtcaccaagctacatgaagaagacaatagaatgatatcttctgacttagcccagctgagaaagtccttatcgttccccagaacaagacggttaaatactgtgtcttattgtatctctaggagtacaaatatctgcgaatagcattttttttaggttttatcttcatgacttttggtgaagatctgaaaactctgaacaattgtgaaaacagcattagcaacagaaacttcctggacaagttcagatacactagaccagaggttttcaaactgttgtttgaaaggagacccatcaagtaggaggtaatagtcacaggcttcccaacacacacatgcatgtgcgcacacacacacacacacacacacacacacacacacacacacaaaatacagcttccccaaaagcagttctgtatgtggccaaaatcaaatttggaaactacttcatggagtcagtataatgtagaatattgcaagtccaggtacccgactgcctggtggctttgaattccagctatacagttttctatgtggtctctatgcaagtataaaaaaattcactgggctttagttttctcatctataaaatgagattataatagtatactcctcgcagagttcaagtgagggtcaaatgatattatacatgcaaagtgctttgaacagtgtcggcatgcagaaagcatttgaaaatgttatagtacattaacaattgtgactattattgctaccattactgtcatgttatgttagattgagatttttaaaaatgaaataccaaagtataaatattgattatttgatcttaagcagcatttgtgagacagagaattttcttgcagtatgcaggaaagcagcaaaatttggcactctaagttgataagttaagaaaaaagtgacttggcagtgttttatcacagtgggaacttgtggctcttcaaacatctgatcacatacattgatctaccttgatatttgcatgtgatatatgacatacagtgtgaaaatgctaacctcaataaactaagaagcagatgtacttctttttaaacttagtatagtttagtttctatcattaatagtttagatagagatagcattaatagagtagaaacaaaatcttaggtatctttattctagttgccctctggaaactagactcattgaacatttaaaaagtagaactaactattctagtggcagatttgattggactaccacatacttgcatgtggaagcctgattcagtctgtattacaaacctctggatgtgagaaaatacacctgtatttgtgtgacaattctgatcagataagaggattcagaaggtgttcaattattcttatgatacatttagttttttcttcatttctatgaacaacttatacttaatttcagagtccattcttatatttcagccatagtcttacctctaggttcaagtcttgcagaattttcagggtaaaataaaccattcagttggctgaattttgatctctgaggggaggagaatggttaaaaaaaaaaaaacacctatacatagcacttactttgagccaagcttagtgttttagatgcattgattcattagaaaggaagaaagtgatgaaaggttaagtcacgtatccgaaattccacagctcaagaaaccaagatgcaaagccaggcagacttgctcccaagtcttgcttcttaatcactctgttattctgcatcacacacacacacacacacacacacacacacgcacacacacatacacacaaacaccctagatatacaaataggaagatgattttttctagtcatctgattatctcaggctacaattgtaataactataggtattataggtgtattggtcatggtttcctgattagtattcagccagtttgaccaatatgaaaatctcatttgcaattaaagaaattttaaaaaggaaaagaatactgctaatgcttttgagcccctatttatatggtaaatctcttcctcacttcactcccattaaatgaagcattataattaattcttgttttctttcttactttggtataaatatttctacaatagttttagttaattatagttattgctggcatttctgatgaataacaatccctgaccaaaataagacatccttttctcaaaagatgaaaatttacaagtacagaaaaagcaagcaccatattttgtttttgttgaagtcttctagtgatttttttcagttctatttcttaaaattaaatgtgaagagccttgttacactgaaattaattcatagttctgggtttgaattttttcctcaactttaggtctgttagtctttaggtaacacagataaatgaatgccctttcaaatacttattaataatttcatgtgaatgcaacagtgatcactaatattaatctctttctggaaaagtataatttattaatctttttcatgattaattgatgcaattttaatagcagtatttaatttttttctaaaagtagtaatttctttttctgaatatatggcaggatatgcggctgtacattaacctttatttataataaatgtaaggacgtaaggattctttatagaataatataatttatttatcataaaaagtgttatatgtcattggaaaaatattttaagatttcaggggttctttcaactttttaatcatcttttagaaacaaaaacaaatttgtatcaaagctactaggatcaataggtaatgtatatttaccttatttttctaaaagtattgtttccagtaatatgttctcaacatgttctcaactccagattttaaaaacaagcaatcaagcttgaaataattctatcatttgctatctgaatttagagcaactgacaaagttgggaatgacttgcccaaggtcatgggtaagaaatttgtatttaatttttaggctaacactggaaatctgtagcattaactagtcatgtattgaatcatttcttaaataataaccaagagaaatctgaactagaatttttaacttctctatcatcaaaagtgtttaaggtagaactcaaatatattttatcatataatttctttaataaggattttaaattgttcttaattggggattagaaaataattatccctgaaattgaggcctaaagtctggctcaaggctgaagttcctttcctgtcaaatgaagacagttatgtggaataattccgatacagttctagcattctctgattctcatgtcgtgatgagcaggaattggaacaataatcaatattaattccacttacatacacactagtcctaaatcaatgcctttattcttgatcatttcatcgtatagggaatagcctttaactacctgataattaaaaatatggtgacactggaagcaaaagtattaattaacttagctaatattcacagaaaaaaaccatgaagtttttctttaactatcctagaatttctggttaataaagagactcagatcctgaaagttttgaacacttggctaagtaatgtaagtgtgcaaagacaatttaaaataaaataacaataatgtaatataatttttccaaacattcagtactaagagaaccaggttgctcatggtgttagacttcatacatttttttacacatcatctttactgttttgaaaattcactaaaggtgtatattttcataaatatgttctagatatttacattaattttccttcttgaaaatttccagcctacaggggttctaatatgtgacaaatgagtgtttttgtaattggtgaagataggctcaaaacaacctatgcgtccatatttttttgcagacttccaagcacttaccagtttaagggcatatgatagttgagatcattcatagccagattaaagttctttaaacagtatttccaatattttatgaaattcatatttggccccaaaataatgcaattttttagacgttgcatattttctgtaagaatagtaactctgcatcttcatgggcacttagctcccagtacctagttggcaggccactgaatagaaaggttccagaagccattatatgtgtttattgtctttattgatagtaatcagccaattagcattttcattgagtattctcatagtatcttcagcattctgctatgggtgaaaaggtagtacagatgaattataaggttgtaggggagtttgaatgctaattgataccataaacaagtagagactaaaacatagactttaatgcatttatgaggccatacagtaagtaggccaggccctgtgtgacagttggtgacaaaaccatgaataagggatgatccttgcccttgaagaattctgtctagttgtagcagttctgagctctgagaacgtgatgaaagcaattaaatatctgcattgtcgtgagctttgagttccccttggagcccatctagaagtttcaggagtggtgaatgagtaccgaattttgacaactacatgagagaagaatgaatgaagtgcaatctgagattcaagcaactttgaaatcattttaaacatttggtgggggaatgacttatccatctgttgatttatctagtcatttctaaatctaatgcctatactctgtttccagagttcactttcaaaaatacagcattaatcatgtcaccccatgttttaaatttcccatggacatacaccatcagagagcctgaagacagttcctccccacccagcactgcccctgccagtgcctgcccacatcattgaggcctgggtaccaacccagcctgccggagtccagacacattgtccagggatctgaggattcacccgccctgtctaccaccactggtgtctgtgcactcctcccaggggtctaaggatgggtctgtcaagcctgccatcaccactgctgccagcacccacctgcatgagccacaggggggcctgaggactggtccttccagcccactaccaccactgctggtgtccatgtgtatgacttggggatccgaggataggttcagtgctgatactgcctttactaatgccatgcatgccacccctgggcccaaggacctaactgcccatccagcccaccactgccactgccagaacctgagtaagctgcctggacctgctaccactgatacctgcctacaccacctaggggcctaaagcctgtcatgctcagctcactgttgccaccagtggggcccaaggatcaacccaccttgtgtccttgtcctcagcaaagcctccttagcttctgctaaaaactgcagcctaagctgctgaggaactcagagacaccactgatgctgattatagccaaagaaatcatacagagactactgtgtccacttagaagtaaaaccaaaccaccctattcaaccaacactatagttcatctataaagaaaaacatttttccttatgaaacccaatctataaaactggaagaagcaactgttataccacatatagaggtatcaatgtaaggacacaagaaacatgaaaaggaaacatacctctaatggaacacaataattcttcagcaacagactcaacaaaaaagaaatctatgaaattcctgaaaaagaattcaacataatgatattaaagaagctcagtaaaatagaagagaacacagataaacaatacaaataattcagaaaaacagtttatgatctgaatgagaaatttgacaaagagatattataaaaaagagtgaaacagaaatcctggaactgaagaatttaatcaaatgaaataaaaaatacagttgagagcttcaacaatagactagatcaagcagaaggaagaatttctgaatatgaagacatcttttaaaataacccggtaaggccaggcatggtggcttatgcctgtaatcccacagtttgggaggctgaggcgggtagattgcttgaggccaggagtttgagaccagctggccaacatggcaaaactccatgtctactaaaaataataaaaataaaactagccagacggggtggcgtgtgcgtataattacagctactcgggaggctgaggcataagaatcacttgaacccaggaggtggagattgcagtgagccaagatagcaccactgcactccatcctggatgacagagtgagactgtccaaaaaaaaaaaaaaaatcctgagattttaaaaagaaaaaaaatatttaaaaatgaagaaagcctatgtaatatgatatataggacactgtaaactgaccaaatatcctaatttttattgttctatattgttctagaaagtgtagagatgggcaaaggcatagaaaacctatttaatgaaataacagctgaaaacttcccgttttgaaagagatacagatatccagatagaggaatcccagtgatccccaaatagcttcaacgtaaagggtcttctccgagacacattatagtggaattttcaaaagttaaaaacagagactaaattctaaaaacatcaagagtaaagcatcaagtcacatataaggaaacccccttcggactaacagcaactttctcagcttaaaccttacagatcgggagacagtgtaaattgatatattcaaagtgttaaaagcaaaaaacaattcatccaagaatactattcccagcaaagttttcccagacaagcaaaacttgagggaattcattcgcattagaacatccctacaacaaatgcataaagaagtccagattttacctctataagcaaaacaacaatatctaccatcacaaaaacacaagaataaaattcagtggcagagcagacacacaaatgagaaagagaaaggactcaagtgttgcctctgcaaaaaaatcaaaccacaatgataaacaataggaaagaaaggaaaaaaaggctatacaaaacaaccagaaaacaattaacaaaatgacaaaaataaatcctcacctaccgataataaccttgaatataaatggattaagtttctcacttatatagactgccttaatggagagaaaaatataacccaactatttgctgctcgtaaaaactcacttcacctgtaaagacgcataaagactgaaagtgaaggaatagtaaaatatatttcatgcaaatgaaaaacaaaaacaagcacgagtagctatagttgtatcaggtaaaatagactttaagaatggtaaaaacaacaaacaacaacgaagatgatcattatataatgacaaagagatgaattcagcaagaggatataccagttctaaatatatatgcatatgcgtcactggtgcacagagatatataaaggaaatattatttgacctaaagggtgagatagactccaacacaataatggttggggacctcaaccattgtcagcatcggacagatcatgtagacagaaaataaacattggattgaaactgcgctttagaccaaattggcctaacagacatttacagaacattttatctaacagctggagaatgcacattctttttatcagcacatgtaacattctccaggatagaccatgtgttaggccataaaacaagtctcaacaaaattttaaaaatagaaattatatcaagtatcttcttagaccacaaaggaaaaaactagaattcaataacaagaacaactttggaagctgtacaaatacatggaaagtaaacaaaatgctcatgaccaactattgggtcagtgaagaaattatgaaggaaataaaaaaaaaaatttgaaacaaatgaaaatggaaacacaatgtaccaagacctatggaatatagcaaaagcagtgctaagaggggagtttgtagcagtaaatacctacatcaaagagtagaaggatgtcaaataagcaacttaacaatgcacttcaaagaactaggaagcagaacaaaccaaacccaaaattagtaataggaaagaaaaagagcagaactaaatgaaatagagactaaaaaaatacaaaggtcaatgaaaaaaaagttggctttttgaaagataagcaaaatgagtaaactgctagctagactaaccaagaaaaagagggaagattcaaataaataaaatcagaaatgaaaaaggtggcatagcaacaaataccacagaaatataaagaatcattagagatatactgatttctgtatgaaaactgtattagcatacagttttcaacaattgtatgctaataaattagaaaacctagaggaaatgagtaaattcctggatgcatataacctaccaagcttgaactagaaagaaatagaaaacccgaacacaccaataacaggtaatgagattgaatcagtaatgaaaaaaatctcccatcaaagaaaagcccaggaccagatggtactgctgaattctaccaaaattataaagaactaataacaattttttcaaactattccaaaatatggaagaaaagggaattcttcttaatttattctatgaaaccagcattatcttgacttcaaaaccagataaggatacagtgaaaaaagaaaagagcaagccagtatctctgatgaacataaatgcaaaatcctcaacacagtactatcaaaccaacttcataaacacatcaaagagataatgcatcatgagcaagtgaaatttattgctgggatatgaggatggttcaacatcaaaaaatgtggtacagcacatcaacagaatgaaggacaaaaaccatatgatcatatcaatagatgcagaaaaagcatttgctaaaattctatttttcttcatgacaaaaactctcaataaattaggcctagaaggaatatacttctacataataaagtccccgtagagcaaacccatggctgacatactgaatggagaaaagaggaaagcctttcctttaagaagtggaataagacaaaggatggccactttgaccattcctattccgcatagtactagaagttctaaccaaagcagtcaggcaagaacaagaaataaaaggcacccaaatcagaaaagaggaagtcagattagtccctctttgtagatgacgtgatcttatatagagaaaaaccttaagacttctccaagaaaagtcttagaacttataaagtaattcagtaaagtttcaagacacaaaatctcaacatgtgaaaatcagtagcatttttatacaccaataatgaactagctgaaaaagaaatcaagaaagcagtcctatttacaatagcttaaaaaaatactgatgaataaatttaaccaaggagatgaaagatctcttcaggaactacaaaacactgatgaaagaaattgaaaatgacaccaaaaaaatggaaaaatatttcctgctcatggacagaaaaaaatcatattgttaaaatgacaatactacctgatatggtttggctgtgtacccacccaaatctcatcttgaattgtagctcccacaattcccatgtgtcatgggagggacccagtgggacgtaattgaatcatggggtcagtttcccccatactgttctcgtggtagtgaataagtctcacgagatctgatggttttataaggggaaaccccttttgcttggcttgcattctctcttgtctgccagcatataagacatgcctttcaccttccaccatgattgtgaggcctccccagccatgtggaactgtaagtccattaaacctctttttctttataaattacccagtctcaggtatgtctttatcagcagtgtgaaaacagattaatacaatctacagatttagtgcaatcattataccaatgacatttttcacaaaggaaaggaagtcaatcaaagggataactgtacccccatgtttactgcaatactatttacagtagccaagatatggaatcaacctaagaatatatcagcagatgaatggatagagagaaggtggtgtatgtacacaatggaatactattcagccataaaagaatggaatcctgtcatttgcagcaacatgtgtgaaactggaggtcattatattaagtgaaataagccaaaaatagataaataccatattcatactcatatgtggaagcttaaaaagttgatctcatggaggtagagaatagaatgatagttaccagagcctgggaaagattcaggggaatggagacaagttggttaatgggtaccaacatgtagagagatgaaataacttttagtgtttgatagcacagcagggtaaatatagttaacaacaatatattgtctatttccaaatagctagaagagaagatatgaaatgtttccagtgcaaagaaatgataagtgttcaaggtgatgtatattctaaataccctgatttgatcatgcttgtatcaaaatatcacatgtaccctataaatatgtacaattatttcgtaccaataaaacatgtttctaaaccttcagtggctcccaattgccggtagcagccatttgcaattgttctcccttttgtgacaagcaagggtgatagatgatagatactgttcatctgagcagctccattcacatccacttctatacctaggattatttgcaaattcaggcataccagctgtcattctgcccaccttctctccaaaaggcatatcacaatacacatgagtgacaatgacattttcatatgctctaaaatatttctaaagcaaattattccctctgtgctttactgctgctaataaagtacttgtaatgtacctcaaaattttcagtagaagtcaagacaccacagctacacactatatgatcattgttaaatccagcctcctttatgtggtatcagcacattttccagtctaaatcagaaatcagggtcagctaatccagtccccagccccccattccacctgacatacacacgtatcctttcctgattattttacaaaatcttacaacacattctgcaattataaacatcctcacttttattctttttgaccaaaatattctctgcccacttctacacttaatgaattccaccttacctttaagtgcatacaccaacgtttgctcccgtgggaaaccttttaagtagaccttaatcctaccctatcccagccctatccttgggaaggattctgggccctctcctatattcctgtactactttgtgtcataagtattgggttcctgggttttaaaaacattttattctgtcatattcctatcctattatagccctattatatccttttatttactaaggccaaaaaccacgttttattcctttgcgttcccagattctaccatagtaccttacatagaaaatacgcttagggaatagttgttgaagatgcttcagaaaaaaaagaaggaaaggaaagggaaagggaggaaaggaaaggaaagggaaaaaaaagaaggaaaggaaagggaaggggaggaaaggaaaggaaagggaaaagaaagaaggaaagaaagagaaagagaaagaaagaaaagaaaaaagggaaggaagggaaggaaggaaagatgatgcttcagcaaaggttgaactaatctgggcatcctattgtgctatgttttgttaatttttattaaaaaaatgtacaaagtttaaaatattttgggtgaaaaggtacttttctgtagttgacagaattattttgaagtgcttgttctcacacaagcatcctttcaagttttcatagctgatcatataagctttgagcttctctttctccccccagtctttaatgtccgtctttgaggatttcactgcatgttgccacatccttcagagtggcaaggaggaatgagactcaaattgctgcttttctcctcagaatctttgttgaagaatttgggagggacagaaatatcaacgctgatacaatagctttcatagtcatcttcataactgtatatcctcaattagtatagatatatacattgtacccctttatccgtgagcgtgtttataaaagggattaacacaagtgaggctggctgtggtagctcacacctataatccccacactttgggaggctgaggcaggaggatcacttgagcccaggaattggagaccatcctgggcaacacagtgagatgccatctctcgaataaattttttttcaattaactgggcatagtagtgcacacctattgtcccagctactcaggagaccgaggtgggaggattgcttgagctcagcaggttgaggcttcagtgagctgtgactgtaccactgcattccagcctgggtgacagagtgagaccctgtctcaaaacacccacacatgcaaacccagatattctctgaagatatattctgatcagaaataagaataatttggaaatcattcagtcacagagtttctgtcatttttttcttctctcattttaggaaaccaaatatgaacagtgaaagagagagtcctattcttatagggtcactgaaattaggagaatgagactgatatcttagttctgtgtaacaaggaataatcaatgagtggtttattatgggggctattttatactgaatatccagaatttactcaggagatgatagattagatagatagatagatagatagatagatagatagatagatgagggaaaaggacagaggaacacagagtgccaggcttattgcccattcttcctatttatttaaaacatttaaaagcgttgtattaaaatgccatgtatgttgtcgtattttccaaagagagtaaagtaaaaatcttgttgagaagaaggctgtctcaaatttaccctttaatgacttgggttagctggctttacaggcatcttatcaaaaggagaagaaaacagtcctaatgcaagttcccagtcacttcatcactcagaaagctacttggaatgtgcatgtggtataatttatgtagagcacggcttgattgtctttttttatttctttgcatctagtgatgttattgcatgagcttcttgtaactattatgaatcctcatgaggcaattcgacctttcccttttacactaaatgtgtggatatatcttttagatttccacatggaagaggcactggattggcctggagtatacttgttaccaggccaggtttctggggtggctctagaccctaagaataacctggtgattttccacagaggtgaccatgtctgggatggaaagtaagtaatattttttcttcaataagcaaatgaaaataaaaatagtgtacataattttttcactaaactaagaataatggtgagagaactataaaggttttttagaatttgacttttatgagcaaaatgtatttgtccttttaatgtctgactgtagtaagtagcagagaggaagtcttgtgtgctttaaaacaaagtagtttcatgaaatagtttatggaaagaagacagtaacaatctgtgattctacccacttaccattttgctccctcctgttatctatctataacattaaagatagttaagccagtaccttagtgaaaatgttcaagacttcaaggagagtgcttatgaaaagtgatcaactaagaaaggttgctgatggactataacaacgcacttttgttattttcacatcctgggtgcagaactatgccaagaccattgtcctggacagtgtggttggggcagtttggccactacatgtgaagaaatagtaacttggccttaaggttttaatatagactacttttattactcaaatttgctcttttcatgagcatcaaaggcttaagaataactctaggactatctattactcctgctttatcctctggattttccttttctacctccttagagggatttttagtaaaaacatagaacggttattgagtgtttcctctgagttaccatcattattcaggttttacagatgtagaaaccaagagaagttaagtattgtgcccaaattagcaagtggcaaagccaggcttcagttgcttcccatctaactccagagttggcccacttagccactttatgatactgcttttaatggaattgtaagcatgttcatgattgtatttttaaaagcttgccccacaatttagctaaacaatttttaaaagctaaaccccacaatttagcagcttattttaattcttttaagtaatgaatagccattattcatttatttcaatacaaatttacatagggagataaattttaagattttttatcaattacatctaatatatcttctcttttcatacatataactatgggtctcatttggaaaatcgaggatctacatgtataattcaattggttttctccagtttcagagatgttgattaaatttatgttaaacctggttctgtcacgtatgcatatgtctaatgtctaatattctttgtgcagtcgaagatgaaattcaatcaacatttcagaatacattggtagcattgttactgtttaattgtcctttccagttgtcatacttgaaaatggaatctgaaaaagatcacttcagagttcaaagtaaataatcaaactcaacattctcattcatacgcctctgttgcatcgtcttagtcattattgaacatctaatagtattttaacaagtgcttttaaaagcaaactattactattcatagtagcatattcttcattttaatgaatattgctacattttctgcatggatttctagccacattttaccagaggagaaaattacagcatcattttctcccattgatactgtttcagctgactaaagctaaattggacaaaggccaatttttcattttaatgtgatattcatttccaagtaaacagcagagactggaatagtttaatagaaaaagggatctgtgaagtccagtttagggtggaagatgaagtaagactatgaaacaggaaccacctaagagcattttctgtggcttatctggctgtgctagcatctaggtaaccaggatcctgtggaaatagattctggtttcattggcaaagccccagagtatttgccctgataaatgacatctacaaaggggtgcagttgaacatgcaagatgtcttcagaggaaactgctgattttactcactaaatctctgtttccttgctcttcttcatctttgtctttcagatgtaaaactatttttttttctctctttccttctcccttcctggtattgcctgttgcccttagcagactttgcaatccatggttgtaaagaaattcttttctggcactcagctctctgagtagaattagaagtagattactctgttagttattttttaggaaaataaatttggattagttcaaagaacaaattagattcaggctccattctttgaatggtaatgcatggccatcattcctaagtcacattctataaattggatgaagtatatcgggttttttttgtccttcattaaaaatccaaggattatacaaagaaaaagtaccttcctgtggaatttatgatgtacaggtgagggacaatacaaattataaattagttggaaactccattcttcttgttactactgttggatggtgacaaatcctgtattaattttccttgaaatctttcccattctgatatttctgaggttcacagaattgtaggttctataagaccagggcatattctaaatcaaattgaagcacattatatcccatagttcgtaagatgtgatcattctttaaatatcagacagtacttggatttaataataattcctaattaatactcagtacccaaaggttctttaatatcattgcatcagctgtctttataagtaccattattcttcattcccacctggtaaccctgatcagcccttattctttgacttaaacacactaaatatacatagcaaccaaaattataatgatgataaacctctgacctgaaagatgatagtcactccctttctcaatatgatttccatttttctcccttacttcaatatcgcttctcttctagctgaaataagaaatgcctattgccagcagggtgtaatgaaactttaaagagtctcttgtctgccctggtgttagggcagcatggcagctagagctctttaaagtttaaatgcttcccagcaggaactgggtagcttttgcctcagtaataactgttcctgagtttctgtcttaaaatcgccaccccactcaaagtgtttcttggcctttctttcatgtacctgagctatggttggggtgtactatgcagaactcacatcgtatacccacttaacttaactatgggtcttgcccctaacttatagatgttagaagttgtatttcttatttcatttatcatttcttctcttggagttggaagggatcttggaattagtataacttcagattctttctgttacaaataagagagaaaactcaatacaaactaacttaggaaaagataaaattagtttgtataagtgaaaacttcaaggaatatagtagcccaattacatcatcaggatctgttttacagctcatttttctgtggggtggctccatttccagtctttgattcattctgttgctcctctccatttgcaggttcaattcacattgtcatcctaatgtcacagaagagatagtctatatgcctgataagtcaacataaactcactaaaattagtctttatagcattccttcgtctgacctagatcatgtctcattgcacgttaaaccagttattttgggcagaggaataaaattgagtctgtggcttagcctgtgtcttttgttctgctcatgaaatgtgggagtagagtcaacattatctgaagcaatgggctgacagtggagctcaaaatgttgggtcaactagaaaaaggtaaggtttcattatcacaaaatgcaacaataaacatgtactcccaaaacagcaagtgtccatcaaagagcttatctccagcctcccacctaatgtatacatctcttctacagcaacttcaaccatcatccagtgtttgaattttttcaatgctaagaaactccctagatatgagacatgctttccaattatgggacccatctagatgttataaagttcttcattattttacctaaatctgagtcctgttacttcaccttttagtaatacaggattaatttattcccatttatccatgtcaattatttgcatatttgaagaaagccttatcttttgcaaactgaatattctccaagctctcaagcaatcttatgctgacatgatttatttcaactgaaggaattttggtctctctcccctttaagtgtttcgcctagaagtggtcatagtacctcacatattatttgatcagtgttacaattagttcccttgatgtgtatgctacacatctgttagtataagagaattgtattccctttttttagcagttacatcactgtgttgccttatgtagaatttgtaatctatgaaaatctccaaatatgtgtcaaaaattgtgctgatatttttactggaagtttatgcttatgcagtgttttaaaaatattgaattcagggctttattccaattatgttccactttattacatttagcattgtttcaatttacagacattattttaatcttaattagccagagactttgtgttagttctcccagctttgtattaggtctctttgataagcatgccttttatatcttcatagatgatgtttataaaatttgaatagctgaatggttggttttgcaagtttcgtttgtagagaactcatagtcttctaggaatcttcttccctcctccccccagatagctcacaaaccatctctttatcaatactttatggacttttgccaagatctattgttttagaaatctgtctgcttcctaacttgtagaaaaatcagttcaagatttgcttcgctagttttctggagcctcagttaagatatctgcctgggttatgcttcaacttctgcgatttctttcctaccttagggtttaactggccctggagaacagaactcaaaagtgtctgttacctttgtaccatcatgtctgagggaaaactataaggggttctacaaaaaagaatgtttcagtgttctatctttctcatatcgcaatttcacactttaccggagcctttttcttccagttttatgctattttctctagttcttcttggttatatgactgttcttccatctcttctacagtacacattgaatttgataactggtgggagatttaccaattcagtcaggtcaatcctagtaagagaaaatcacgtttttttgaagataggaggcctggatttgaatcttggttaccatttcctgtttttgagacttgcatcaagacgtttgaactccctgattctcagttgcttgcctaaaaagtgagggctttaataattatctcatactgttaagtaacaaaatgcaccttgttaagtcacttgtccccagtggccttattgactgaatagaatccagagcctggatgtatgatacctagttcttttttctcttcctatctatttgtggtatttatagttctaggcctaaaatggcactaaatagtcatactgaattttttttgtctgcccatctcttttcctgcctcacagggactttttacaatgtgtctattttcagaagtaagtgtttttaacataatattaagttatattccatcgagagtctctggcctttgtatatctttgcttttctaacattgaggttacattttcacttatattcttgcatgaaaacctacagttatttctctagcttcttaatttatataattatattatatttcatatcttccttcagttgctgttatttaatttgaattcccttaattttgattcatggcatagaattttattttctccttactctagctcttttgtgtgtgtgaatatagcaaagcatttcttcccagccttatctaaactgtttgattagctgctaatgtgaaaaatcattaatggagaattcaaactgctaaaataaagaactgatgaattccagcccataggccacagttcagtcttttcaactgagtgcttttccagagaaacaaagaaaaatcaaaagtgctccaggcactgtgtgaaatgttcagggtattattatagcctgtaaaaagttaaatgtagttgaaataaagacctctctgcagcaaataatgtggagtagctgctttagaaaactaaataagcagtttgctatagcaacggtgtatccagctctataatctgacagccatttgtgaactgttcaagggttacctttctttgaattacaagagtttataaactacttacttagcaagtttaacatgtgtgtttggagggggactgtgattttctcatttgagaaaagatgtcaatttattttattatttgccccatgtaaccgtcagggaccagctgttagttccgtgaagctccagccatcccaagtgaaaggattaggactggtcaaccaatcatctgagtaaatgaatgtcccttgatgctgccagtttaaacatatagacgtctgttaaaaaacatcacaatgattttaaatgaactggtcaggcctattatgtagtgattaattcctttaaagctacattcttcctaagaattctgggtttttcttatttgttatttacattatggaagtaaattactacatttaaatgagctgtatatataagtagagtgttttatctttggattttgttatgttttgttagctttgtgtcattttttactttgtttttgaggggtggtagttaaatgaacagattctctaatcagtaaattctagaatttgtgttatcactgatattcttaacagtgaaagtatagtaataatatgaataataatcataaagctatggaaaagtagctagtcttaagcaaacataaaatgccctttatacatatagatgacatgagtgtaatttgtgatagcaaacgaaacctaaaaagacccagataattagttgttacattgtaacaagatactgggaaagatatcttgatatgttgcaagacaattttttttaaggatccaacttttaattgtaaatatctgaactttgggaggtggagttgggagaattgcttgagcccagaagttcaagatcagcctggtcaatatagggagacccccatctcaacaaaaaataaattatctaggcatggtggtgtgcacctgtggtcccagctacactcatgaggctgagatgggaggatcacatgagtctggtaggttgaggctcccatgagccgtgatcatgccactgcactccaacctgagcaacagagaccctgtctcaaaaaaaaaaattactctgatttacttactctgtcttattttgtttgttccttatttttcttcccattccttcatttgctatttttcttctcattccttcatttgctatgtcaaaattttctattacaacaccaaaaagtggataatgaaatagaattagatgatcctcaaattagttaattttactatttgctgccaccactggaaacttgaaagttctatattatgaatataaatgtccatacagaaacagtgtttgtggcagcacaatatcaattacttgacacatttttttctacatttgtgtgcagtgcagaacaatgccattgatagaggatgtttttcacttacctacttatcaactgcaacatttccatttgacctgactggcacaaggactgtgggtctgttatttatatttactccttaatgcagcttgttttcttggaagccaagcccagcatttcaggtctgtgactctgagactctaatcttacatggctgtcagtgagtaatttaacctatagtttacactttgaaatatttgagcatctagagaaataatctggacctataagaaatgctttaagttacagaagttcagtgtatgctcctggagagggagggaaacctttttactttctcctcatcaataaattgtaggagtgctatttcctaaaataatatgaccagagatttaggaatgatggtgaatatttacatgaatgacaagacagatcaaaggggcagttatcttacagaaatactgcatcccattcttggagaaaccatgggggcaagtaaatatatcaggtttccctaatgttttgtcattctgcagagaggggaagatgtggaattatgtgtgctgaggtctaatacgaggatatataataggcatttggactgccactattattagctgtcagtggtgagtcagaactcacaatctacatataaagtagatagcacttggcaagaattatgaattggaattatgaatcagtaacttttcatattccacaggtcgggatggggtagaaaagtaatgtactagtatattccaaggaaataaactaagaataaatgaaaatattatatatagttttattatatgtagtgatgttatatatagttttgcaaaatggagaaactgggtaaagtgcacacagaattgtttttatttcttacaactgaatatgcatctacaattatcttaactaaaatttccattaaaaaaagagggggaaaggttttaactcttaatagcagaagcataattttcacattatttagattgccattgtgcctttacaaagcactgaaatgtttctgaataatgaggaatgtgagacttaaaccttgcattagttccttctcatgctgctaataaagacatacttgagactgggtaatttataaaggaaagaggtttaattgactcagttcagcatggctggtgaagcctcaggaaacttacaatcaggtagaaggggaagcaaaaacgtccttcacatgatggcaggaagaagtgctgagcagaagtgggaaaagccctttataaaaccaccagatcgcatgagaacctgctgactatcagaaaacagcagcatggggtaaccacccccatgattcaattactttctaccaggtccctcccaaatgggagaattcagccaaaatgaagaggctacaggccccatccaagtccagaatccagcggggcagtcaaatcttagagctccaaaatgatatcctttgactgcatgtctcacatccaggtcacagtgatgcaagaggtgggctcccacagccttgggcagctccatccctgtggctgagcagtgtacagacctcctctcagctgctttcacagttggcattgagtgtctgttgcctttccaggcacatggtgcaagccgtgggtggatctaacattccaaggtctggagaatggtggccctcttctcacagctccactaggcagtgcaccagtggagactcttcgtgggggctctcaccccacatttcactttcatactgccctagcagaggttcttagtgagggttcctcccctgcagaaaacttcttcctggacctccaggcatttccacacatcttctgaaatctaggcagaggttcccaaacctcagttcttgacttctgtgcacccacaggctcaacaccaaatggaagctgccaaggcttggggcttgcaccctctgaagccaaggcccaagctataccttggcctcttttagccaagtcctaggacacaaggcaccaagtcctgaggctgcacagagcagcaaggccctaggcctagccaaaccattttttcctcctgggccactgggtctgtgatggaaggggctgctgtgaagacctctcatatgccctggagacattttccctattgttttgacaagtaacttttggctcctcgttacttatgcaaatttctgcagctggcttgaatatctcctcagaaaatgggtttttcttttctatcacatcatcaggctgcaaattttccaaacctttatgctctgcttcccttttaaacatacgttccaattcaaaccatatctttgtgaattaataaaactgaatgctcttatgagcactcaagttacaccttgaatgctttgctgcttagacatttcttccaccagatcatcttccacctaaatcatctctcttcagttcaaagttccacagatctctagggcaggggcaaaatgccaacagtctgtttgctaaaacatagcaagacctttattccagttcctagcaagcttatcatctccatctgagaccatgccagcctggacttcattgttcatatcactatcagcatttttgtcaaagccattcaacaaggctctagaaagttacaaactttctgacatcttcctgtcttcttctgagccctccaaattgttctaacttctgcctattacccagttccaaagtcacttccacatttttgtgtatctttatggcagcaccctatttctggtaccaatttcctgtattagttccttctcacactgctaataaagacatacccaagattgggtaatttataaaggaaagaagtttaattgacttacagttcagcatggctggaggagcctcaggaaacttacaatcaggcagattgcttcagaaggggaagcaaacacgtccttcttcacatgatggcaagaaggagaagtgccaagcaaaagggggaaaagctccttataaaactatcagatctcatgagaactcactatcatgagaacagcagaaagggggtaaccaccccatgattcaattactttccaccaagtccctcccatgacatgtggggattatggaaactacaattcaaaataagacttgaatttatggaacttatgtaaagtctcagtactctacataaataggagaacaaaaaaaaattattaaattatattctttggccattaaaaaatacaccacacaatttgggtggggacacagccaaaccatatcaaaccttaaaaagagatagtgaatgaagaaactttaacctattacatatgaatgtgaaggttacaatatactgagtctcagatgtgctgaacttgttagtcattattatagtcaccttggaaaaataaaagattattaatggttgaatccagtacctatgtttttcagaggaatagttatgatgtttttagtaaataaattcatattgaaaataaactttcagatataggataaattatttggtgtttcatactagcaagagtgacttcatattttccctttaccattttcccataatttaataatactatgagtattcttacattggttcctatctaataaaatttcacatttcagttgataatgaccccataaatatcttatgaaatctgttttgttaatgatgatacttccatttcataaatttatttttttctagataccactgtgtggtttttaactgcatataatagcatatataaagagtattactgaagttttagattgacaaagctgaatcaatattttgtgttcaattgaatgcatcattaataagaactacttcagggacttattgttgtctttcaggaaaactatacccaaaagactgtaacagtcaagtagctcagataattgtgtggtgtattttttaatggccaaagaatataatttaagaatttttttttgttctcctatttatgtagagtactgagactctacataagttccataaatatggcagccaactgatgaatggattcatgacagatccaagcagtctgttaccttcccaaattgcaaatatataatagcaaatatttaatgttattcagattcttcttttgcttaaccagttgcactacaaaatattaatacttttttcacaatcttgcctgatgctataaaggcaattctgttttacagaaatattcataagtcatttattgacttgatatgtatatttataaacacacacacatacacacccacacacacacatacacacacacccccctcaactatgtactgatccaatccttttttgagaagataacttggtttcttgttgtttcatacatttacttctatattacagaagcttagattagaagagcttatctttgtcattcatccctgttgacatataacttcccaaacagaaaatgaaataagtaccatgtctgtgataattgtgaatttaagaaattatattactaacaatttaaatggaaatataattttgaaagtatatatatatgaatatatgtccataatattttataataatctaaaaggtactgagtttaaaagcagaaattgtcatatttaagttttttaattaattattgcatagttgttcattttgtagttatagaatagctgttatttggtaagttttatgcctctaagcatatttttgtctcgaggatagattcggttttgtaacttttaaatactttgaacatcctcttttatatctctataatatgtatatgcatgttgtacctaaagtataataacgaacattttgatcactgctcttccagctattattataattaatgacaaagttaaaataagtcatattttcttttgcaatatgaaagaaaatgtctattgaatgactgcatactcttttgaagagcttttgaaatttttcaggtacattaagagttcttgatcaatgtttctcaaaccccagtgagcataggaaccacccaagggtcttgtgaaaatgcagattcaggtccagtaggtctgaaactgcatttcccagcaatgccaatgcttccgttccactgaccaccctgagtagcatggttctacaggttaatggggtatattataatccaaatgactgaaatgtggcagacaaagagtgaagtcaaatacatttgagctcttttgattttgtatttatgtgaatggtctgcatttctcaatttcattggaatttatgattgtttcatgtcctatttaatgctttttgtttagctcgtttgacagcaagtttgtttaccagcaaataggactcggaccaattgaagaagacactattcttgtcatagatccaaataatgctgcagtactccagtccagtggaaaaaatctgtgagttaaatgacttatgttgttaagacttgtactacatatattgagtataaagtgtatcatagagtcttgaaattcgagtgttttgtataactgcacttgagaaagcagaaaactaactgggccatcccatctttcattttctacataggtgtttctaaatcttgactgaatattagaatcatctgggaagcttcaaaatatttagattcacttatctgtttgccatttgtatgttttcttctgagaactgtctgttcaggtccttgcctatttcataattgctaaatgagtatatttggaatgttctcacctcaaaaatgttaggtatttgaggtgatggatatgttcattagcttgatttaatctctccacattgtatacatatgtcataacatcacattgtaccccataaatgtatacaattaaaatttgtcaatttgtcctttaaaaaattagatttagattctgtatagagtggggctaataatcttaagttcccaggtgattttaatatgtagtcaagcttgttacatattacatatgtaatatatatcttacatacttgattaagtgagttgctgctcagccagatctaatgatccaaaaaaattcttcagcagaaaaattcttcaggacaaccaaactcatcaagtaatcaccattaagtaaaagagcttctctttttccgtctcaaagtgaatactaaacaaatgtcatttttagcattccttatcatgcgtatgtaatttggctttgaaaactgctcattatttagtcttatttcgagatggcacttggcagccaaaaaaaaaaaaaagttgactgatatttatggtcattgaaagaagtgagggaggcacttgcttacagatctcctgaaccattgtaacttgacagcttcaggaattatacccttctccatctgcttaagcacagggaaagctagcttcttcgcaaggtggatagccaccgttttgagtgcagctgcttgggagatgataataatgatgcttagaattttttaacagcattctcaagattgtgtgtcaggggtgaaatgtttgaacctgtttcattggtgctctatttattcaccagaagcaccctcattccagaaaggaattaaggggaaggcagaaaaactactgctaaatcaacttggccatcggtggagtatctgtttgaaagcaaatcataatcctcacattcagttgtcaaaacagggatctagttcagctaattagtcaaaatcagagtgttacagttatggcttatgaaaaaaaatctgtattgtcaacactacactaagattagaagctaacagagctattggattgtcggatatcattggaccaaaccacctcaatgtattgtccatgtgtctgttagctcagtccaggttccttacctagatcattaagattgatttgccagattaaccttctctaatgtttatctagctcactatttcactttgcttagatattcacagcccatgttggctggaggttatgtgctgtgggttttactgtctttaataggcactctttaaagcctttgagttatatgtctaatagtttatattaacacattacatttccttgcaacatgttttaaccgcaaactatatcaatccatttatgtttcttaagtcagttttatacatatttgtaagatgttaacacttatgacctcagaacctgtttttaaactgatactgttttctctaatataccatactttataataaacatttgtaatttatatgtaggcttaatttataaattttaatactattaaatactacctaaggtttgtcacaaggagatctcattataacagtttttattaactattcattttgttcttttctataataatgcaagtatacatttatcaatttataactttgcattgtctttacagattaattagaaaaatttctgtcacatatgccttgagagtaaatgtgtaattaacacaaatatttttattttgcaggttttacttgccacatggcttgagtatagataaagatgggaattattgggtcacagacgtggctctccatcaggtagtcttccttttggtaatattcaaattagaagctaacagagttatgcttttgaagagctctggagttgtatgggttttttgtttgtttgttttttcttctgtcacccagtaagttataacaagaaaatagagcagccatgtcttagttcagcatgttataacaaagtactatagtctgggtggcttatacacaacagaaatttgtttctcacaggtctggagtctggaattcaagaacagggtgccagcatggttgagttctagtgagggccctcttctgggttataggctgctaatttctcatagtatccttgcatggccagagagataagagtgacagtaatctctgttatctcttcttatggcactaatcccattcatgagaactctacccttttgtcctgattacctcccaaaggccctgcttcatattaccatcatattgggggttaggatttcaacatgtgaatttggatttgaggcacaaacattcagtccataacaatccacatctgaaatatttctcttagaactcaatgctagggaaagctagtatgtaaatgatgaagtcacatttgtcccttggaccagatatgaagcttcactcaaataactacatgggccctcccaaccattttcttaactgtctgtatttgcctttatttcctctgttcctaacttgttgttgttgttgttgttgttgttgctgttgttgttgttgtttgagacagggtctcactctgtccctcaggctggaatgcagtggcacgatcttggctcactacagcctccacctcccaggctgaggtgatcctcccaccttagcctcccaagtagctgggaccacagtcacacaccagcatacttggctaatttttttaaattttttgtagagatgggattttgccaggttgcccaggctggtcttgaattcctggactcatgcaatccacctacctcagccttgcaaagtgctgtaattaacaggtgtggccatcgtgtctgggcctaagtcttatttctatttttttacttatttttttatgtttttttcttaaactaccttaatcttctataaattgaggctaggcctctagtaaatgtatatttatatataaaaagtgaaatttgtgttatttttaaaagaagttatatcaagcgtaatatgcttttcatgaataggtggcaaataacttggaaaacatcatctcagtaaacatttattgctcatgtattatctggagtgcattgtagtattatctaaggaaagacaaaaaggaaacatcagggtggacagaactgggtatccatgtactagtctccattcactactaattaaccgcgtgaccttgagcaaatcatttaatcttcataggctttattatcaaatgaaggaaccagaccagatgatttctaggatcccgttcagttctaacaagtattaataccttcttttaaataagtctctgggagcttctactccaattgcttgtgaaagtggtcttagtcatgtgggtgtaagtcactaataaccatgaaaagtaggtaaggcttttgttcctttttaaaaaggtgttcaaactggatccaaacaataaagaaggccctgtattaatcctgggaaggagcatgcaaccaggcagtgaccagaatcacttctgtcaacccactgatgtggctgtggatccaggcactggagccatttatgtatcagatggttactgcaacagcaggattgtgcagttttcaccaagtggaaagttcatcacacagtggggagaaggtacccaataagactcttaatctccagttgtaattcttagccagtatcactgggaactaaatattggccaacactcacattctttaagctgtaattgtcccctacagggtcattgtaacctgggtcattgtatgcatccagttagcttgtctctcacacacacacacacacacatatacatacacacacacacacacacacacacacacacgtcttgtaaggaaaataatgtatccaccaaacaactatccaaatagggagaaaatctgtaatgtatttgtggataaaagacattataaaataatcttataaactgctttaccttatctttcccctggctccaggcatttaatggtttactatcatgaatttagaaacatactagagagtcaaactttgggtgatttttaacattgtgtatctaaggcttttttttgttctgcagagtcttcagggagcagtcctctgccaggccagttcactgttcctcacagcttggctcttgtgcctcttttgggccaattatgtgtggcagaccgggaaaatggtcggatccagtgttttaaaactgacaccaaagaatttgtgagagagattaagcattcatcatttggaagaaatgtatttgcaatttcatatataccaggtatttcatcttaatatgtttgttgtcttctgtcctactgtactctatccttaaaaattgtgttatcttaatgtgctctttttataaattttctttgctatatatttcacatcttaaaagtatcttacaactgttagtgtgttctaactcagttttgattaaggtaccactattcattgtacagaaacaatgaagaactcaaaggatttaacacctgtttgtaaggggttaaaaatgttcccaaacattgattttcattttatcttaattatgatcatctgctccagtattaaataattaatatttgtcttcacacatcgacaaatggtatatgtctgataaaatcagtattcaaaatactcatttcacatttttaaaaacagtagtgaccaatttttttaaagataaaatatgtaaaaataagtgtggcttatgcctaaataccaggataaataatcaataaaatcttgaacttttttctcattttcaaaatagattttcttgactctaagaaaatctgaaaaataattcagactaataaaatacatataacttatattacaaaacaacttaccatattttctttaaataatgaaaatatatttaatttctgaaatttacatacaattacaatttttttaaattgtaattgacatagtaattgtatatatttgtagagtacaatgtgatattttgatgtatgtttacaatgtggaatgactaagtaaggctaattagcaaacccatcacctcacatacttatgttttatggtgaaaacatttaaaatatgctcttttcacaatgaagtgaaatgagatcaataacgaggaatttttgaaaaattcacaattaaagggcacaacatattttaataaaaacatctatacctgtattaaagcagcattgactatttataggtattactgtaatatttatgtttcttataagttgcatatggctactatctggaccaagcagccccccaaattatttaggacataaaatcaagggactcaggtgattgatagagagcaaatttggcttcctcaaggaataaagaaaaagtaataagaggttctcacaactatcattctttaggttggtttgccgcacatttaaagaaaaatttgtcaggaccctttacttaattaagagggtgatcaagttcataataaacaaaaataaattaaatataagaagaaaattatcagttgagaaggaatatggttaagaacagaatctaagcaaaagataattttctctataattttgcacaatagtaattgatgtttatagtgttttttatagtacatcctagaaaactataatccttcaagaatgatgaaaatatcttcaatggtggcttagcattgtgtataatttattatgttttaattctttgaaaatgtagtggttcaatcatctgaattgtttatttaacgtaaacatcaccattttcattgttctgaataaacagtattgtgttaagaaatataattttactacaaaaagtattcatggtgtgaaaattaaaaagatggtcttttttaattaaggaaaatatgtctttgataatctgaaatatacatctcacattttcaaattctagttgtttaaaatcagattgttctatatagactgtaacttcacttattttctttgattttctcttggattctccatgtagctatggcaaatattacttattttttaaaagatctgagactccaaaattattggcctaaataacctgactttccccaattcctatttaggatgcctgtaatagctatatatgtgtattatatctatatatcaatatctatgtatttctgatttctactggttttccaagtggaccacacatttcagttcccgattttcctgtcacaaggaggttagtcctctaaccagtttgccactgatctggttactcaggaggagacactaagtattttatattctacttttgttgccaattgtagggaccaggttgaccctaaatttattctttgcataatatacatggatatattagaagtccattcttacccatattttaaagaaaggttaactggatttgctgttgcaggcttgctctttgcagtgaatgggaagcctcattttggggaccaagaacctgtacaaggatttgtgatgaacttttccaatggggaaattatagacatcttcaagccagtgcgcaaggtatttacacacattgtctaggtttcaattttcatgagaagaagactaaaatataaatcttggcattcaatctgtacttgaatagctttagaaaaacttttaagaagatgtgataactttcttagcaaggttgatgggagtgttctattttattttttattttatattttatttagaataaatgtctttgtctattcctagatcaatttcttcagatgcaaattagcacgtgtgcagttctaaggttcttagtagaactgcacctgcatatgatggcaggtttttaaattcactatagttagaatacaaaaaataaatcagtcgctttctggtttcatccaagtagagaaaacatcacaacatgttaagtgtactcttaaagttctcttagacccaacagacatcttgtttgctttctttattgctatgactgtgctaagcaacaagacttgaaaatagcacttcctggaatttattcaagttctaaagatttggttaagaaactaaaagctacttttggcttcaaaagtgttttcccactgtttattctaacgtgctttttataaacacagcaactgtgttcagtgtgcccatggcccttctgtcttctcagtgtacttactctgcagtatgattgccagagtgatcagaatgttctctacactgtatgaatgtgcttggagtatatgaaatttagaaaattcagcctgctaaaatgctacaaataagtgttattcttcaaaacatgtaaagattcattggttttaattggatcaaaatacaactatcatcagctactgaaccaagtttatatcttgacacttataatgttatgttatttttaagataccagatttgctaatttaaaaaactttaaaatgcctcaatattatatttttaattaaattttaatttttaatttttgtggttacacagtacatgtttatatttatggggtacatgagatattttagcacaggtatgcaatgtgctaaaataataataatcacatcatagaaaattgggtatccatcccctcaagcatttatcctttgtgttacaacaatccaatttactctttcagttatattaaaatgtacaattaaattattattcagtatagtcacactgttgtgctatcaaatactaggtcttattcattctgatttttttaaatctctattttcttgttataacttactgggtgacagaagaaaaaacaaacaaacaaaaaacccttacaactccagagctcttcaaaagcataactctgttagcttctaatttgaatattaccaaaaggaagactacctgatggagagccacgtctgtgacccaataattcccatctttatctatactcaagccatgtggcaagtaaaacctgcaaaataaaaatatttgttgtttattttgatttttttaaatcagaatgaataaccatcatcctgattaaccaccgccacctaaccccccgccacacacacatacacacacacacaaacacacactcacacacacacacacacacacactctctctctctgtcccatacccttcccaggctctggtaaccatccttctgtaccatacatctatgagttcaattgttttgatttttagatcccacaaataattgagaacatgtcatgtttgtctttctgtgcctggcttatttcatctataatgatctccagttccatccatgttattgcaaatgacagagtcttattctttttgtggctgaataatactccattgtgtatatgtaccacattttctttatccatttatctgttgatggactcttaggttgcttccaaatcttggctattgtgaacagtgctgcaacaaacgtgggagtttatttagctctttgatatactaatttcctttctttttggcatataaccagcaatgggatttctggcttgtatgatagctctacttttagttttttaaggaacctccaaactgttctatatagttttactaatttacattcccaccaacagtatacaagggttcccttttctccacatcctcatcagcatttgttatcacctgacttttggatgaaagtcattttaactggtgttagatgatatcttattgtagtttcgatttgcatttctctgatgatcaatgatgttgagcacttttccatatgtctgtttgccatttgtatgtcttcttttgaaaaatgtctattcaaatcttttgcccattttttaaattggattattagattttttactatagagttgtttgagctccttatatattgtggttgttaatcccttgttagatgggtagtttgcaattttttttcctcattctgtgggttgtctcttcacgtggttgattgtttcctttgctgtgcagacactttttaacttgatgcgatcccatttgttgatttttgcattggttgcctgtgcttgtggggtattactcaaaacaattttgcccagacagatgtcctgaagtgtttccccaatgttttcttgtggtaacttcacagtttgaggtcttagatttaagcctttaatccattttgacttgatttttgtgtaaagtgagagatagggatcaagtatcattcgtctgcatgtggatatccagttttcccaccaccatttattgaaaagactgttctttccccagtgtatgttcttggaaactttgtgaaaaatgagttcactgggccaggcgcggtggctcacgcctgtaatcccagcactttggcaggctgagacgggcagatcatgaggtcaggagatcgagaccatcctggctaacacggtgaaaccctgtctctattaaaaatacaaaaaaaattagccaggcatagtggtgggcgcctgtagtcccagctactctggaggctgaggcaggagaatggcgtgaacccgggaggcagagcttgcagtgagcgaagatcgtgccactgcactccagcctgggggacagagcaagactctgcctcaaaaaaaaaaaaaaaaatgagttcactgtaggtgtgtggatttttgtctgggttctctatgcgattccattggtctatgtgtctgtttttatggcagtaccatgctgttttggttacatagctctgtagtataatttgaagtcaggtaatatgactcctccagttttgttctttttgctcaggttagttttgactattctgggtcttttgtgatttcatataaattttagaatttttttcattactgtgaagaatattgatatttggatagtgattgcattgaatctgcagattgctttgggtatatggatattttaacaatactgattcttccaatccatgaacatggagtatcttcccttcttgtgtgtgtcctcttcagtttttttcatcagcattttatagttttcattgtagagatctttcacttctttggttaattcctaggtacttaaaaatatttttggctattgtaaataggattacattttctatttctttttcagattgttcacattggcatataaaaatgctactgatattttatgttgattttgtatcctgcaactttactgaatttatcacttctaatagtttttttggtagagtctttaggattttccaaatatcagattatataatctgcaaacaaggataatttgatttcttcctttccaatttgatgtcctttatttctttttcttgtctgattgctctagctaagacttccagtactatgttgagtaacggtggtaaaagtaaaatgcttcaatgttttattaatagaaattagtctaatactgacagctagtctggtgtttatcaaattttattccagagatatgcattaaatacttactctgtatcaggcattatgctaggtactaagggtataaaggtgaataagggtaaaagggtgaaagagacacagccttttgttcactggagctttaagccatagtaacaggatctgaatataaccaaaatgaatctaaactaaagattccagtatacattcctttctttaggtttctatttatataaacaaataagatttttctagaaatatttcaccagaaaagcaataggcaatgaaatctcaaagcatagcaaccctgcagaaagaaattcattacactgataataaatattttattccatagtgtttcagatccttattgattatccagtcttcattgttgtgcccctttgaactaacttcctcatatctgttggtaaaggaagtgagatgcttaactttcagttctttgctttgtattagtggagtgtttgccttgctcattcttttaatgataatgtactgtgtcaaccaggatattaacttttaatttaaatatgcatctagaaataaaaactaagtgctaagcaagaggctaaatgagccttaacgtcataaaaatctgaagagttctcaattaaaatttccaaagcattgtgctttcatcagatgttaggcaaagaatgagtcacaatatgtgggtcaattcagcaaacttgaaaagagtctcactccaagatgaagtttgcttttcctttcagtaaacaagacttgatattacaccaaaacatataaatatattctgtgttgacacagtaaactgaaatcagtttataaatctctcagaattttcattaaatagattattatcacaaagattaattttgggtgaaggaaataatatggtctgttgactcctgtgtaaaaagagattcctcttcacgatgaaggtcaagttttacataagggggttgtgcttctgtttgtgcatacccactccttatctcctcttacatttcagttctccatcttctactattacattctttagagatgtttccatctgaatgtagggactctgtttttatgtctgtgcagggaagcttagacagtaggacaataaagaaaatggttctatcaaatgctatcaaaaagctgtgagagaaaaatacacattgtcattccccaagtcattccccctgtaatcaaaggacagacttgtggtccctcattatctgcttttatacacacccttcggacaggcatattttttgtcgtcttctgtgtggcagctcatatggaaaagaaagagaatgatccccatccttccataccaaaagaaaaaaaagtgagcccagatttatgtcatttttccaaccttcacagtgatgattaaaatgacaatacttgagctgaaaagttcacttaagttaaattacttgttcaagctacatggagtagcatatgtggatctcaaacctaggtctttctgactttgaaatgtgctgcttaaccttttcattcctgaagtacacattggtatgccaagggctatattaagccacaacataaacattgtgcaacttagaagaactgttttacttaatattaagtacatttaaacttactatgttgaagcaaacattgttatgctatggagtagaacacgaatttccttacgagtttttaaaataaaatacaagattttgaaggcagtttgctccaggctttgtcaccagatgcctggtgaagatattatcatgcttctgtcatgttgattttattttgctgggggtacctcaaaagaagagtctgcaaaggctagattagaagatctttatgtctgtgtagctctaaaaatactaaagcttggtcctaaaatttaaccacataattttgtttcaaatgacacaaagcactagaacagttcattgaaaagattacaactgagttcttctgactgcaagaagacataatgagtcttcataatgagcaagaagacagagtcccatctaccacgcctccccctgagttcctatagtggccccaaagtactgtatttctagcagaacccttggcttcatggatcagtgggaccaaggttctgctataaatacagattagtggctctctcacttgagagccactaataaaggtttattattgttgttgccttgaatttatgacatattgtgatttatttaaagcaaagttcttagccagtgaatagtttacacattccctcctcacctttattcccccatcattatatttttcctatcagaaaatatgaagtattctacaaccatatgttttacaaagaaatttctaagaacatattacggtatagaacaggagtggcctatcatttggtagtcttttgccatccattaactgaacctcccaaaaaagatgaacatttaatgacaagcccgcaggatttcagcaaggcagcattttgatttctggctctgtgttttcctctacatatttgtcacagcttatttgaaagtatgaaaaaaaatgagcctccttggcatggctatctcatttttcttttcagtgtgataaacttgatgatttctaaagtacgatagtatctccagagcatgtattcttctgccccgcctaaactgagctaggaacagtagtttgtctcattagtaccctttgaaatcagcacatcagggttaggcagatgctggctgataagcccatggtctggatactcactagtcatatttttgataactgtgtatccaggcaggccttctggccttaaaggtgaaagatgttatctatatcctgccaactgccagacccagggcacctttggaggcttccagagacaatggaaatgtcagcagcacaataatttaaggcttctcttccaagaactagtttggtgatccccaaaagaaagtcacaaaaggatctcccctgtctcttgtgtcctcataatggagatgacaatgatttgaaatagagaaagatatattaaaatacagagcatctgaagtagggacaaaagcccaggaagtacttggaggtaacactcaatttctttcctttgctgactgaaaacatcacaaacataagacttcaagagtataaaaccccacattgctacgtatctcttagtgtacatttcaaaaaattaaatgtcccaaatctctgaaatgatttttcttatcaataatatacaaatagtttttaaggtagcacatgatagcttgatgggaataataaaaattaatacctagacttttttacttgtacaaatttaaaaaagcaaatttgatagttattaaaaggtagaagaaacatgtaggcaaaaaccaatataaataactagacagataatgcaacaccaagtaaacagtattgtaaaaaataatatacctgtaaattttcacacttaaaagaattgaaagtcagtagtgggggttccttagcatttcccaatgtttagaattatgcctggaagagtcagtacccaatgaatgaatgaatgaatgactcccttcagcctagggttgcttcaataggaaatattttgctttggtttgagtaatatgttttgttgttttgttgtgggctttgctttgtttttctgtcttttcatgaaggattcaagtaaaggctcaccactctaatgtgtagcttcttattttggcagcactttgatatgcctcatgatattgttgcatctgaagatgggactgtgtacattggagatgctcataccaacaccgtgtggaagttcaccttgactgagagtatggttttcacagtattattgttcacattttccctcagtttgattgcttaaaagcatatgaaacaaaaacatttgcatttccttatctttttactgatgagagtaggaatcaaagtataaagcagttgttaaaagacctatttggtgtccattaagtggaaagaaacgatttttttgctggcacttatccccttgtttccacaggaaattcttgatgcctgaagtactgtctgttacattaaaagtcaacattaattccagcttagttccagaaggagagagggggctttggcaaagcagaggggctgacttctttccataaagcctcattccccatatggccctttagctctcagtagctgctgagcatctagagataccagcatccgtttgagacatattatcccaaatatgaatatttggaaatattcaaagaagaagcactttgaattttctgcttggacttcagctttcccaaataactgaattgctatattttcatgtaactcaaaatgttgtctaagtatagatttgctccatcaggatcctgccaactagttttggagttttctaattggaatttggacatcattttcatctctaaaaagcagactaacttttaacccctaatatgctaaaacaaataaattttttaaattgaagtgtaccaaatgcttgataggacacaaacaacttcaatgtccagaaatacttttaaaacatggcagggcccaaatagcagaaggtgagagtaaggaaaataattggggatgataaatttgaggtatcaggagcttcaacaggtagttttagataaaggacaaaaaaacaatatgtaaacttgatgaagaaaaatattaattataaaaggaaaaacataaattataaaaaggcaagaaaacaaattacagcaatggaaagtaaaatcaggagtccaaacacataatcagatacgatatagggcttggatctcaattaatttggtaacttttgtagtcagaactatcctttggataacgtttgcagttgtgtaaaaagaaccaagttagggttgagtgagcagagatgcccatggactatgccactccagcagtagcttcacatttcccttgcaaatgtggctctctcaccacccgaattgtcaaagaggatccagaaggcagggtcagacaataaggcaaagatagatggataacccccaactgcatgactaaagtgtggattttcagaacaaaaacaaatgcaaaaatactttgaaagatggagaagacttcagaagaaaatctaaccaatatcttaattttatggataggaacatgattcctgaactcattaatatttcaatctgaggccctgtataccgtgatccccagcctttttggcattaagggaccagtttcatggaagacaatttttccacagaccatgggcagagggaatggtttcaggataaaactattccacaaggagcacgcaacctagatcccttgcatgcgcagttcacaaaagggttcaggctcctatgagaatctaatgacaccactgatctgacaggaggcagagctcaggtggttacactcacctgccactcacctcctgctgtgcgttccagttcctaacaggccatggcccgggatttggggacccctgctttataccaccctagtggtttgaaactcagaagatgcatgtcagatttacctacggggggggactgttacaatacacatggccagtccccactcaagatctacagaaagaagaggaataatattatgtgtattttagaaagtcctcccaagtgactttggtacatctcctgatggaaaagcacagcgatatggcattcagcttcaaaatagagaagccctctgcatagcgcagagtgcagtaaatctggaaaacagtatatctggaacagtaagactgccactgaacactaaatcggtgtctcatttatttgcatccttgtagttaactggtcaaatccattaacatcaactagaagactgctaacccaacatgtcagaactagtaatcagtctaagatattgtccacatgaaggcagatctgcttggtctttcagaaataatacaatattatgaactctacaagaaataactcattgtaaatatgaagtccttagaaatattttagctttccctaggagattttatccaggattcatggaccacctaattagtggtttgtattgaactctttcctaatataataatgcatttgatgaattaaggaaatattttctactgagtaaaattaatatcaaagttaaattttcaaatgttctttttggagattctgacttttctctctccttgttgtgttgttacagaattggaacatcgatcagttaaaaaggctggcattgaggtccaggaaatcaaaggttggtcagattcctcttattactataaaaccaaagtctggctgtgttgaattcttttatggcccttgattgcaacttaaaaaattaccaggctaaaaatataatctggtaaattatcagtgacttctgctatgtactgagcctttaaacctgtatgttgccacttccctttttttttgataaatggagcagtcataatgagctcaaattactgatttcaagtgatagaaagtgattgaggatacaaaaactttgtaactagtgagccagagatattccgagaagaaaaaaagtcagccactttggggagtacattaaccccaggcaagtaaaaaaatatgatttggcatattggaaaaaccttttcttaataggccctaatataaaggagtgaaaaatatctttggtgggtcagtgctataatggtatggaaagattagctgtttctttagcttctatcgtagtaccattcagcttccacgatttactgagggccttttgtgtgtaaagcactatagcaggtctaagggaaatgagactgcacctgaccttatagccttataaggagagagggggaaatttacatacataaacacatatacaaataagtatatcactggtatataatatcaggactaaggaaatgggatttagctattggtaagcaaccactgggttcatatggagtccctgtcaacttattttgtctctttcctaggatcagtttatgtttgtacattctagcatctgcagggttttgacatgtcatttccagttaaggactcgctatgagttgctcatgttacctaatatttaagtagcaaggggattccattattagttgctttacaaatgattcacctagacattcagacacaaacctaggcttacttgttttcttttctcatcaaagcagctggaaaagaaatgaaaagcagcaacagcaagggggagtttaaggattttatgcagacagataagaaaatatagccagctcaaggggtaataaaatattataaaataaatagcaattgtttggcatttgtagagatccaagtgacactactaagtggcattcatatcacactcatatactaaagaaggttcctgtccccctagttttatgtctttgctatatatataattattggtaagttctgtttgccctggaataaagacgttgggaaagatcatgttgttaatagtagctatcacttacagagcagaaacaatgggctatacagaaattattacatttaatccttatgccaaccatgtaataactgctattatccccattttacatatgaggaaattgaggatcagaattcctactaagatagtacattttagagtcaagctttaaaccaaaatctatttggtaccaaagcctgcactcttaaccactattgctatactgctgaggagagactgataccaccaattcattcactataaattctcccaagaactgcaggttgggaatggttatagtttactctgaaacctctagaattttaaaatagtctcaactcatttctgtttaaatagatctcaccaaaaaattctaggtggtactggttggcctggtgaaaacagcttagccatactgacctcatcttagccggtcaatgatggatgaataatgctgtcatataggccatttcctctctcctgtgtgcacaccactgagtccaattggtcagaaaccttccgactttgtggaagtggtttgtggtcaaacccagcagttcaaacagtaaattttattgaaatgtcttgccttgacagtccagttttaatagttaacccaaactcaaatgaagttgtctcttcttccttgaacccatatggctctcattaaacctttaagattatgttcttattacaaagggaatgtaaatcatgctggatctctagatcttatgttttatcaatatcttgaaacttaattcaaaccaccctttataaaagagaagggaaaacacaatttcagacttaatagccttgtagttacatgttaatttttaatccccaaatttgagttgcctttgataacacttatccctactatgaatggtcatataactaattattattaaaaaggtttcagaaccagtgttctaaggaagttgtaaggataagataatttcagatgataaaaaaaaactgatgaaaaggattaaactttctaataaagttactagagataaaacaggtatagcaatatctcaccaaagcatagctctcacccccaagcccacccccccaaataaaagatgataatggccaatcactttcaataaaacttttaaaaaataaaaaaacctctttagtgcagttagctttttaggccttatggtaagcaacacattgtaaggaaacacattaaaaaaaaaaagaatgatctcattggtgatatatgcacttttcatgtcccgtaaccagttacttcctagtatgccatttgccttcagccttcagttctgtctgtgatgaactgggatacaattgctgtattaagaatgtccttcccttcctgtccaagttattccaattccaagtggtctctagacttctcttctgttagggggagacagatttgtacatacatgtatatgtgcactcacacaggaatgtagctaacctccatttctaaacgcattgctttaaagaagaagaaaaactgtcatacatcagcttttagaaaatttgtttatttccaaatatctatagagatgctacaagggcttgcactcttataagattttaaggcatgttcattctacccagaatacacctggcattttatatgacaaaagaatggtcattctaggtgcctcctgttttccagaaacctagtgttctggctaatcttagagcttcttcactcttcattcatcatagatgctccaaattactgggatttttaataaaagaatttaggataaagagtgaaagtggcagaatttggattattcttcaggctttcagtggaattcttagactcttaagttataactattgttttaggcattttaccccacatacaaatgctcttgtgaagagtagcaatattgtttattttctttagaatggaacattttaaatttttagcctcctttttaaaaatgtagagcatcttttaaatcttaaatatatttcagccagttccaaaagttggactgtttaagtatttttagtagataacactcaaaatatcagaagtgatgtgaaaatcaagaatttctaaagtgctgtgtatgtattatatcttagtaagttcattgcctcattctcattactttctgtgaatgctaaactgattcttttagtctttcacctgtatcatccacagttccttccatttaatgttgcccaattctggttctgccttatccatgaaactagatatgacctagtatacccattgtatattaggtgcatataaacttactaaatgacaggcagtaactactctggtaatacccaccttcaaacaagaacaaatccttcttccaaaagaaacaagttcttaaatgccaacctacatctttggcctgtgttttttactcccatgatctatttattgcaattttcttatttaaatatagaataagcttaaatatagagcaattttgtatatctttcctatagcaaccaaaaaaaaaaaaaagacaaatgagtggtcagaaagaatagaaatcacatctgtattcccctcagaaactagacatagaaaagttatatttgaaccatttctaggtctatgaaccactcctttccttccctccctttcaagtttcaagagtcacttgagtggacaaaagaaaacaaaggatggtctccctttagccatagtacagggaaggaaaggaggactatgaggtcatctacaaaatggtgatgataataatagtgcctactcatgagcttggtgtgatgattaaaggaaacgatgcctgacaatggtgtaagtactcaatagatatcactgagactgtcaaagaggctggctcagaacgttgaagcaaagagttggaacctaccatctgtttgtattataaattatgttgacagcatcttaaatgatttgggaaacatttatttggaggagtatccagtaaactactaagctgaatctatacctactaaacattaaccaaagattttcctgattgtgttatccctaccattttgtcaaaatcttcttgaggctttacaatgcattctgtatcgtagggcagaagggcattccaagaagtcgaaatttcagaaatgtatgacctgtgagtcttcctgcaaatgtggttgtaacttttagtctgggcaaattcttactagtctttgtacactagagtttctatacaaatacacatatgtgcttcttgtagggcaaggatgtctcaaggctcaacctcattttcatatcattagttattaagatcactgcagcagcttatatagtttcattgcatcaatttcccaaacagtactttaggcttgatacctacccagtacctgccaatgttacagaatagttttagttattataatagttgttcttttcatcagtaacaaaaggatatacagttcatctgtctgtactcacattttgctgaaaacaatataaaagagcctgaaaagcacatagttccttttttcttttgtaatcctagcattaatgtgtgcagctgtccatgtgaaataccaaaaattaattgaacatgaaaaatatttttaaactaaagatacaaggaaacaaacacttattatatacattttttatgacagacatttacacccaacagttttatgaaggaggtcctattattacagttttatagatgaagttactgtggcccagataatttaagtaacttgcccaaagttatacggctagtatataggagaattgggatttgtacccaggtttgtttgattccagtatgcacaccagttctttcccctacacagtactgtcttattaattttacctttggaaaaatacaaaaggatatatattctgtggaattatagctaaagagcatattaaaagtagaacaaaagaaaactaatttgaaggtgaaaaaccattcagtggaaataactaatcacaatgcctgctgccagtttggtagattcaggtattaaaacatgaaacccctgtacactggagtcaacaagttctttgtgaacagttattgatttgactgggtaggggtgggtaagggggttttgaaatctttgagtcagttgaatattgtgaactcttctttccctgaagaagccgaggcagttgttgaaaccaaaatggagaacaaacccacctcctcagaattgcagaagatgcaagagaaacagaaactgatcaaagagccaggctcgggagtgcctgttgttctcattacaacccttctggttattccggtggttgtcctgctggccattgccatatttattcggtggaaaaaatcaagggcctttggaggcaagtaaaatgagccccgtgaacttggaacctgcctttgaaagagtgtttggcctaattatcctcaggagtttgattgggatttttttcactgtatttgtttttttgtttttaatgctctctaccatttttgacattattgtctatgttccaaatattgcccctagttaatatcacagtacaaaatagtatctggagactctgaaatttggatagttagattaaaatataacctttaatactatcttttagcaattggcttaagtccaattaatgagtccatacgaaattgtaggtagtagagtcagtataaattagctgaaggatcagaggaggagatacctgctgttaggaagaggcccagtcctcaaagtacctgggtcagtttttcaggttgtgtttttctcccattaggctcctagctacatgaccatgggcaagttacttaatctctccagaccagttttctcataaaaaagtggggataaaatagttaccttacaaggttgtacaaagatgaaataatgtacataagcatttatcaggatacctggaacctaggaagtactcaataccaccaatggttatgatgaataatcattggtaataaagtaacaaaaggcataagaagttataaaaaacacttgtcttaaaccttagttttcaagaaaaattaattctataacaaaccatttgatagtttttgaatagtcataatttagctcatcagccttccataactgaacaaggcagagtccaataccagagttagtattttatgaaatcattatcacaatataggatccaagagctgagtttattttaggacatctaaataaataaacaacccaattcatgtttcttaccgctcagtagcagtcccttggctgggtccccaggtcctagagcaagtctatagctgtgtgtgggaagaaatccatggatcagggagagggggagcatttgatcaagaaacagcatctgatcctatttcaggtcaaggcagccatggcagggattcagtgcccttggcaaagccctgacacagaaaaaggcatggaaacagaaaacagaaaattcagtttaatatgttgtaaaagggaatttttattagactttattttgcttttcatgtgccatcaataaatctctataaaaatatagttaactcttcccaaaaaggatttctattaagtccatgttacagatctggaactgtcataagtaggggcaaagagaaataaacatagtcattgtcttcatggtgttatatagatgcttcaaaagagcaagaatccatatcttgagtactgatatgtccccagcacaaataatagtttctgatactagtggtttaataaattgttgttgaaagaatgaatgaataaatcaaccgagctcacagaatagataacatatgaaagagacatgaaacaaaaaagttatagtagagggtggtaagtgcagtgataaatacacagagtagtaggaacagtggggcctaggggaaggtggcaggaattgtggtaaccaacccaatctggcagaagcagtggctagggaataaggaagatttggtctctcctgtttgttgttaagcacatgtgacacagcactgttacatgatgctgactttacaggaatgtgttaggaaggtagagacccaggtagaaccctagaaaattgccattatttgaccgtgttttacttagaaaaattgcagtttcatatgtagtagtagtagatcagcttctcactttttttctgaatttgttcttgatagatcttatccagtctaaggttattaaaaaccctaatggaccttccatttattcatcattccttattatgtattgactccatatcagacactgtgctaggcacatggggatacaaaactaaggaatgtccttgcagaacttacaatctaatttgttggctttctaacagtcttaccagattcttcttcccttcttgcctatttctttccacatcactgtcttctccctttcctctcatctgcgctatctttttccatgatgctgacttcagtcctggttaaagacctaacaggacaaccccaggcctgactttcctgaccatagcccttgagggagtgatgaagcctgggaaatagtacagggagagacacagcaagggaaaaaatgaaacccattgggagttctgtctccccataaggaaagagagtctgtcctttatggagataggcagtcctgttgggaacatttaggtcacctactatgcttggaaaatactcagggtgtcatgtgctttcccttcacttatgtcttacataaagaagaaacgatatacatggatccaaagctttctcaagcaagatacgtactgtcagtagaaagagtaaagctgaaggcaaatatccctaaattgtcataaccaaagatggaaaaattttataaattattaataacatttcctgattaaaaaaatagctatgatttattgagcatttactgtatatctataggtagtgttctaaatgtgtcacatgcagtgtctgatctcagccttacagacagggattctccttgacctttcttttgtcagaggagaaaactgaagctcagagaagtaatttatcaagactgcacagccagtaagagacacgggcaggagtcaaacccagcttgggccctttatgtatgtctcagaaatataccgcctttcttaaaaattagaattgcatacagacaagagccaggccttgctttatcatttaccagttcctattttaagttggaagttgagtgcatgggttgagaaagatgactgggactcattttgaaatgtgccatctttttttagcagattctgaacacaaactcgagacgagttcaggaagagtactgggaagatttagaggtatgcctatgaccttttagaacccttcatgtttggttcaaagtcaacaagcacatgtcttttaaaaagcaaggagatatttcatattttgtctctgaagataaagcaccttgtatgcagcttagcatctcccagagtaaatacagaatgcacaccataaactaaactgaagtgcatgggtctggcagcagatttcccagttttatttttcccattctgcattatctaattctcttcccctgccttttacctggcttcatttgtcttcagcaaattttctgtcactcctgttggcatgtcaatgtttgtcatagtaaagatgaccttttcttaaagtcattgaaatgaggagctgctccagggaggctagttctggatagagagctagagaaaagcaggaggtgaaagtgaatatgaaatattcctgcagaaatacataatacttgggagcttttgtttttcttctttaatagtagcatctatatggctctgtaggatacgtctctgtctgtttttctattttatttttaaataaaataatctcccctttcccatccccaccttctgactttatcatttaagaatttacaaggtaacagacattgctgcaaactttacccaattctgttattgtttgctttttttcaggaaagggaagtggaggcttaaaccttggtaatttctttgcaagccgtaagggctacagtcgaaaagggtttgaccggcttagcactgagggcagtgaccaagagaaagaggatgatggaagtgaatcagaagaggagtattcagcacctctgcctgcgctcgcaccttcctcctcctgaaaaccaagctttgatttagattgagtaagatttacccagaatgtcagattcctttccctttagcacgtttaaagttctgtgtatttaattgtaaactgtactagtctgtgtgggactgtacacactttatttacttcgttttggttaagttggcttctgtttctagttgaggagtttcctaaaagttcataacagtgccattgtctttatatgaacatagactagagaaaccgtcctctttttccatcataattctaatctaacaatggaagatttgcccatttacacttttgagactttttggtggatgtaaataaccccattctttgcttgaacacagtattttcccaatagcactttcattgccagtgtctttctttggtgcctttcctgttcagcattcttagcctgtggcagtaaagagaaactttgtgctacatgacgacaaagctgctaaatctcctatttttttaaaatcactaacattatattgcaatgaaggaaataaaaaagtctctatttaaattcttttttaaattttcttcagttggtgtgtttttgggatgtcttatttttagatggttacactgttagaacactattttcagaatctgaatgtaatttgtgtaataaagtgttttcagagcattagctgtcagtgtattttccagtttttgcgtatttgcagattttacatacaacttttataataattacacaaacccacaaatattagtgaaacttactcgatgtcttcaactaaaagaaatgtgtgtattgtacaaaatttagaagatactttagccaatataaattaaaaaccagcctgagtttacataaatttgtaaagtcaggctcttctaaaatccaaagagggtttttgcctatatatcaatcagaggataaatactttaataaaaggtaatcacagctaagtggatacctgtgtctcaaattacatatgcaaatgatccatcagtagggatcactaataatagttttccttttaaaaaataatttcagggcaggtacagtggctcaagcctatacttccaggactttgggaggccaagcagaaggattgtgggaggccaagcagaaggattgtttgagcccagaaattcaaggctgcagtgagctatgatcaatccactgtactccagcctaggctacagagtgagatcctttctctaaaataaaatacaatttccatgtatccataggaatatattcatcttttacagtgattgcagattagttttaaaacgtctttttcgtaattcgtcaatgcaagttagtaagaaccagataattttccattttaaaatgataggaatctaaaactctttttcaaaaatgccaacctgtttttccggcatcatagtagttggaataatacagatataattgactaatcataaagtacatgagagtacagaagggaaatttggaaacggtaagtctgctagggcattacaatcctgtcctagcactccacctttattctgccaacctgggttaattaaagatggtagcctggaaagtaatgaatgacattgacttcaggcaatctttccactgattattcttggctgaacttcatttatcgagtcagagaatgcactgcctgagaaatgtcccagaggagtgaatcctaggcctggccacagtagaatcgcctggagaatttaagaaaaaaattgttgggcactcactctttccagtgatctttatttagttggcttacaatggaatacaggtatggttcatgtttttaaatttgtccaggtgtttctattgtgcagtcacagttgaaaaccattgtcttcgagaatagctattctatcttgccagttacaataagtggatagctatattttcacataaattatagtttacagatgtttggagggggaagacaggatctgaggtgttttgatatgactgttagcaccaaaatctgaatgccttaattgttgaatgtgttaaattggataattaaaatgggcataaatgacttattaaaaaagcaaagggaaa

SEQ ID NO: 594 - DNA, 19312 bp, Homo sapiens
gatttcgtcctgggatgcggaagtagcagtcctgtcatgcggaagtagcagtccggtcctagggactagcaggtgggttggttgggcgcaggaggacgggggcgcgcttcccataacattaccctggctgagcgtgaggctccagggctgggcaccgggttgacctcttattcctcgctgagggcatcgttaccgcctgtggctgcaagccgaggcgcgcgggtggaaactgggtcgaggtctgggtagacgtctgagcgatctgcacaaggagtggcgcagtctggaatttgattgaggattcctaacgccctccgcttgatgttctggtgattcccgggggctcggcttcggaggaaggtgagcaaggctaccacgctgtgtttggagagcaccaggaagcttgtgaccaaagcgagggacgcgatccggctctggtcacggcctgttactagatgggtgaccaagtcacgtcccgtatctggaattcatgcttctcattttaaaagagtgaggagggatgggcattccacatggctggggaggcctcacaatcattgctgaaggcaaatgagtagcaaagtcacattttacatggtggcaggcaagagggcttgtgcaggggaactcctgttgataaaaccatcacatctcatgagacttattcactaccacgagcatagtatgggggaagctgcccccatgattcagttatcttcacctggccccacccttgacacgtgaggatatgtgtgtgagaagagctactgtttatttttttaaaaactgagtcgtcccttgcctgctttcaagggttggctaaactcacccatctgctaagagtctcagcccaaagctttcaggaaagagcgagcttcgctgtggcatgtaacttgaagccttgcctactaagtagatgtccagtttgttgattggtctctattaactaggctcaaacatcctacgaggttttaatgtaatctaaccaattaattgaaatttcctttacaaccctctctttcccccagacttccccttcctttctttttctctgacttaaaagaatgctggctaggagaaattagttgactgtgtcgtgtatcaagaggacttttccaggttatgtagtacaatttggcatttatttgtcaagagtaacattttctaaaattttccccaaaggcaccaagaaactgataatgttcctttgaattggcttctgtatttgcttcatcaatgtctctcatactgaatatcttaagagagatgctggaatattttggcgttcctgtagaacaggtaaatgtcgttttggattggaatggatctgttgtatttgttcttgggtttcattttgaaaatgacttatatgtaatcatttgatttaaggcaaagttgttgcttctttttagttggaacaaaggtgagtttgtaatagtatagctttgatgatttgagttagaagagggataagattattgagaacatatttacctgataggacaaatgccaacagaagatacaaaggaagcaaaatatagacatgagcttcacagaattacatttattgcacagatacattaaaacttctattcaaggtaatttataaacaagttcaatatttaaagctcaataaatccagaataaatctaatggaaagaggatgatttaggcctgagaattataagctgtattagtctgttctcatgctgctaataaagacataccggagactgggtaatttataaaggaaagaggtttaattgactcacagttccacatggctggggaggcctcacaatcattgctgaaggcaaatgagtagcaaagtcacattttacatggtggcaggcaagagagcttgtgcaggggaactcctgtttataaaaccatcacatctcatgagacttattcactaccacgagcatagtatgggagaagctgcccccatgattcagttatcttcacctggccccacccttgacacgtgaggataattacaattcaaggtgagatttgggtggggacacagccaaaccatatcataagcaaatcaaattttatctacttgttgaaaatctgctgtatctaagacaatatgcttgtttctgcaggtaatacagaggagtaatacatggttgtattcataatgcttaaaatatgaggaataagaaacaataaagataactgtaatatgagattgtaaggaagacgggtggggtgaattagaagaaagtagtcaaggataatttaagatttttttaaagcaaaagtaagttgaagaatcatagtaccattattataaatgggcatcttagtatgagaaactagtttgaatatggagatgaggtgagtcagaggtgatgttagaacatataagtagaaatatccttcagacaattggatatatatatggttttagtatgtaggaaagaaaaagattcagttttgggagttatctgctttgttttgatatttaaagccatggacttcgataatggcaaatgtcattagatgtgattgaaacattctaaatatcagtaatcgagagactgaagataacagctgaacatttgtttatcactattaggttattggtgaccttaagaatttctgtaagtggagaatgggactgtgttggagtagtttgaagaatatcaggaagggaggtgggatcagcaaccttcttttgaaaagtttgcttgtgaaaagaaattgagagaggccatcagcctgaaggggccgcaggatggaatttttctttttcttttaaagttagaagtaacttcagcatatttgtcatcactctggaagaaacagacaggaagaaatttaagatccacatgagagaggattgagcaccgcctttgagaaggtagttgggcaagggatctaattaaataagtcttggaaaggagagagactgtcctgccttaaagaacagaatgaaagtgagagagagtgaaaagagattttttttttttttaagatggagtcttgctctgttgcccaggctggagtgcagtggtgcaatcttggctcactgcaacctctgctccgaggttcaagtgattctcctgccccagcctcccgcgtagctgggattacaggagcctgccaccaatgcccaactgatttttatatttttagtagagatggggttttaccacgttggccaggctggtcttgaattcctaacctcaagtgatccacctgccttggccttccgaagtgctgggattacaggcgtgagcccctgcgcctggcctgaaaagagattttgaatggagctaagtaagagaagtgaagttgaggtatgtcaagttgaagttctcggttttctcagtaagagcagagacaaggtcacttgcaggtaatgaagtggtgggatttgagaagggatttcagagattggagactgctctgggcaatgtggtatagaatgtaacatgttatgaagggatttcagaatacctgtgagaacccagctgaagtcatcatggaattgtagtttttctaaatattgtcgttttgtgatttttttttcctagctaagagtaattacagtagtgtattcattagcagtgtgggagcacataatatcaaaagaatgaaccatttttgagtggcattgaacatattactgaaataattaaccagaaaatccatgcttggtaggaaaattagtaaagtcaaaatgtgggtactagaccaggaatagagggaagatgaaataataagaatggtgaagatggccagatgtggtgggtcgcccctgtaatcccaacactgtgggaggctgaggcaggcatatcacttgagctcaggttttcaagaccagcttgggcaacatgatgaaacctcgtctctataaaaaatataaaaattaaccaggcatggttgtgtgcacctgtggtcccagctactccagaggctgaggtaggaggattgcttgagcctgggaggtggaggttgcagtgaaccctgatcatgccctgcactccagcctgggtgacagagtgagaccccatctcaaaaaaaaaacctcaaaaagcaaacaacaacaacaacgaaaatggtgaagatggccaggggcaatgaaggaatgagaggaaggacaagagtttattaggatggaaactgccgagcaagataggaaggtatcatttaaattaactaagaactaacccaactcttgggtgactgtatatgtcataggtagccgtcatggtagcaaagcctctatgcctgttgttcttagcaggggtacgcagatgaatggtctgtagaacactttaaatataaatgctcaatcctccaaatattctactagtaataggtctgggatctatatcctctaggctgtgcaatccagtatgatagccactggccacatgtcacttttaagtactcaaaatatctgaattgagatcttctataggtgtaacctatataagggattttgaagactgagtgtgaaaaaaatgtaaaataatcttagcaatttaaaaatattatcggttgagcatcactcaaaacctgaaatctgaaatgctccaaaatcccaaatgtcttgagtgccagcatgacaccacaatgggaaaattttacacctgacctcacatgatgggtcacaatcaaaacgcaggtgcacaacccacagtttatttagcctgctgttgttagttgttgctgttgtttaacagctgagaccggcggtttattggttgttttaatgaggatgctaataggtggctacctatatcagttgggatcttaggaaaaatgtccaatttattatatcacatcttttggctggtgggggagagtggttcctgtggcaatggtttacactaatttgggaagcccacactaaaggatgaagtattatttgagctatagtagcacattattacttctaatgccttttcaagagctgactgccagcagatatatttcactttatgtaaataactctgaattgtctaggacctgatttatttattcccttttttatttctcctttaaaggaaattacataagtatactccatattacgtcgttgcttgataatttgaaattgtctatttttggttgggccaaaaagatgggatttgtagctgggggaggggatgcaatttttttgaacaaagtttctcccaaggtattggacattatcagaaatagaacaaaatgaattgtgctttttaaaagatcttcctggaatgtatatatgtttactaccatctctttttaagacaaatactcacaaagttctattctttgaagaaaggctctgccattctatatttctttttaaaaataaatgttattttacaggactccctgtattaaaaaaaaaatgccactgcgtcttttttgtcttttttacatctccttttttcatacttatataaatatgcttaatcagagtgcattttaattcatactttatgtttaaaataggttttgctgatttgggaaaataaagactatggatcaactaggagtattgttcgtattattgggaaaatgcttccactggaaccttgtcgaagacctaattttgaggtaagtcagtcaacataaattgtttaagtaccaagtacaaaataatcctaggtactcttacaggtatggggtagaacaacaaaggaagaaacatttcctgcaagccaaaaacctgtagtttacccttgggaacaagccatttcatatatgtttttgtgtttttgtttatttaaatacaatcatgcatcgtttaatgatggggggatacattttgagaaaagcgttgtttggtgattttgtcattgtgcaaacatcacagagtgtactggcacaaacctagatggtatatggcctattatgcacccaggctatatggtatgacctgttgcttctagtctgcaaaccttttcagcatgttactttaccgaatactgtaggcagttgttacacaatggtaagtgtttgtgtgtctaaacatagaaaaagtatggtaacaatgcagtaaaaattagataaaaaatgttacgtccgtatagggcacctaccatgaatggaagatgggaagttgctctgggtgagtcagtgagtggtgagtgaatttgaaggcctaggacattactgtacactactgtagactttataaacactgtacacttaggctacactaaatttatacaaaaaccctttcttcaataatacattaaccttagcttactgtaactttttttataaatgtttttattttgtaaaaatttttgactcttttgtaataatacttatcttaaaacacacattgtactgctatacaaaatatttttatatccttattctataagctttttatgatttaaaaatttttaaattttttatacttttaaaatttttttgttaaaactaagacacaagcacacacgttagcctaggcctacccagggcagaatcatcaatatcactgccttctacctccacatcttgtcctactggaaggccttcagtggcaataacatgcatggagctctcatctcctataataacaataccttctcctggaatacctcctgaaggaccttcctgaggctgtggtatagttaactttttttttttttttttaagataaggtcttgctgtcgcccaggctgaacgaagtggagtcgcgtgataacggctcactgcagcctcaacctcctgggctcaagtgatcctcccacctcagcctcctgagtagctgggactacttgggaggtgtgcaccaccacacctggctgacttttttttggtctggtagagacgggatcttgctatgttgccctggctgatcttgaactcctggccttaattgatcctcctgccttggcctcccaaagtgctgggattacaggaatgcaccaccatgcccagccaacttttctttttaagtagaaggaatacactctaaaataataataaaaagtataatatagtaaatactaggtgataggaatatttcagtttcatcataatcttatgtgaccccatgtatatgcagtccatgatcgacctaaatgttacgtggtacatgtctgtaatgacattcacagatgggcaagtgtgaacaataactgaagagcttaattttattttgcattttgtgatagatgaaattaaccaggggagagaatattgcttagtgcttagacttcagcataacattttccccagtgttctttcgtgctaacaggtacatgtttttctattgaatattctttttatttttctttcttttggattgttaactaatttaataccatggggcatgtgtcttctcctgactccctgcagagctctgactatttttttctttttttactttagttgatcccgctcttgaactctgtagactctgataattgtggatctatggttccatcttttgctgatattttgtatgtggcaaatgatgaagaagccagttatctcagatttcggtaattttatatgcttatcttgggaagtgggctataaactgaattcttgcatgtgtcgaagcttgttaagattgattgagcttttttgttttgtttatcttcaaactgtgctgtgccctactgtatcttcttaataaagaagactggctgcttttcatttttttagccagttgttttttttttagtgcacatttaaacctaacaccaggcctaggagggagtggttattaaagggatattagaatcatgtttttagccaaaacttatatactgtttactgtgcaccaggcaatgatgttaaatgtatttcaaaatttggatgtgttactcctagggagtattactttatatgttagtatattcagatacaggctctaagcacattaagtgtcaattatttaagtattccggctgattttattatgtatcaaactggcaccaattttcaaatagttaaaataacatacatttcaccctaacataatcctgaatgtaaggctctttattaacttatatagaacttctaaataaattaacttacctgcgtttaaagttaataagtagaacaattgcaggtaattattttggttttataatctaaaagcaaagtttgttttgttcattccctggtcactgactggtcctccattggaggctatgttctgtttatattgggaatacaaagctaaataagatattttccttgtcctcagtggtgactctagaaacaatcatgggggatagagagtaggtttttttttttttttttttttttttttttgagacagagtcttactctgtcgaccaggctggagtgcaatggcacgatcttggctcaccacaacctctgcctcccaggctcaagtgattctcctgcctcagcctcctgagtagctgggactacaggggcacgtcatcacaccggcgaatttttaaaaatatttttagtagagacagggtttcgccattttgaccaggctggtctcgaactcctggcctcaggtgattcactgcctcagcccccaaagtgttgggattacaggtgtgagccactgtgcccggcctgagagtagcttttattttgttttattgtcttttgattttcacgtaggagtgtaagagtttatacctcttttgattggaaatatatcttccctccatttcctattttttttcacccacagaaatagtatatggaaaaatgaagaagagaaagtggaaatttttcatcctttgcgactagttcgggatccactgtcacctgctgtaagacagaaagaaactgtgaaaaatgacctgcctgtaaatgaagctgcaattagaaaaatagctgcccttgaaaatgagctgacttttcttcgctctcagattgcagcaattgtggaaatgcaggaactgaaaaatagtacaaattctagtaagtaacagtaggatttttgtttcagttagatgatactcatggtatagcctataccaacctgtacagcatgatactgtactgaatatagtacgtatagtagcatacaggaacatctagtatttaagtgagtacaattctgaataagtaccatgaaaacattaaatgtacataaaaggatgttgaatatacaaaattattatatctgatgtttattcaggataaattaagacacatttgtagtgaggggatggctttgatttaaagaagaactagctttactatactagaagattgtatttttgtattaaaaagtctgttgtcttctaagtaagctttttttttttttttttgagacgcagtcttgctctgtcgcccaggctggagtgcagtggcacgatcttggctcactgcaagctccacctcccgggttcacgccattctcctgcctcagcctctcgagtagctgggactacaggcgcccgccaccacgctcggctaattttttgtatttttagtagagacggggtttcaccgtgttagccaggatggtctcgatctcctgacctcgtgatctgcccgccttggcctcccaaagtgctgggattacaggcgtgagccaccgcgcccggccctcagtaagcttttctaactcttcatgaaagcattggatattaaagaggaagaatgcattggtttgaaagaggatataggtttgaggcatcatatgtttatagtttttagttattgctgctacacttccaccaagttgaggtgagtcatgttttccagatgattgttttataaatttatagagatacaacttgctttaaacttatgcacacacatacacacaacatgtatgtatgcgtgtataaaatgtaaagcaatctaggtactgaatgcttttcacaacagatttggctgtaaagggctgtgtgtaaatataattgctaaaaattttttaatacatatgtatatatacaaatgcataaatacacatataatttaagatatttatacagtgtatatttataacatttacatataaacacattatataatatacaataacttatatttatacataataaataaaatgatatataactatacacagttttcttaagcaatcgtgtttacccacagtcctttatgagcaaatcttaaagtggaaaagttaaatactcagtacccatcttaagctttgcttagaaaataatatgcttatttctccaatgtcattatacagtgaatacatcaatttgtgtttctaactacaagttgttgatttctgttttagcttttttaaaatagaggatgaagttcagagtgtatgtgaattactgaaaaaactcttttttttgtttgtttaagatgcattctcctccccgctctgctcttggacctacactgaaaattcctaactggattaaaaatgaattcacaatttgacttgactcttaaattactaagcagatgggattgacactctttccttgctaccatatcgctactagcattacagaaattgctcctgttttggttctaattagtgttattaatatatattacgttagagataattgtgcatgattttgtaataaaccactttgtttgtaggttcctttggcttgagtgacgagcgcattagtttgggtcagctgtcatcatcgcgggctgcccatctgagtgtggacccagatcagcttccaggttcagtgctttctcctcctcctcctccaccacttcctcctcagttttcatctctccagccaccgtgttttcctcccgtacaaccaggatctaataatatttgtgactcagataatccagcaactgaaatgagcaaacagaacccggctgctaataagaccaattatagtcatcattcaaaaagccagagaaataaagatattccaaacatgttggacgttctaaaggatatgaataaggttaagcttcgtgcaattgagcggtatgttgttgtaatttgaaaagtgaactgaaattttgtcaattttatgtttagaaaaattattatgtttatgaaaattaacatatatgtcttttttcttattcttcttcacccctgaatacctctcctagagataatgacattcaattatttttgactatttcttcttctagtctcttatcaccatatttttgaaacaacatacttatttgctatttcttgatattttaattatgttgacttccaattgtaggatattaggaatatattttcttagatactctacccaggacacacacacacatcttgccacgtcttcctgaaatagttaaaccacaatctttagttaaatgagtattcagaattaatatccttattataacagtgaacatccacagtaagccatttctcatattgtaacccaggctgtagggcagtgttgaaattacagctcactgcagcctcgacctcctgggctcaagtgatcctcccacctcagcttccttagtagctgggactataggcatgtgccaccatgcctggctaatttttgtatttttttgtagagatggggtttcgccatgttgcccaggctggtctctaactcctgagctcaagcgatctgcccatgttggcctcccaaagcgctgggattacaggtgtgagccactgtgcctggccccatttcatatattttgactacattttatttgttgaataatttttttagagttaataattgcctctctgagttccatgtgtgtgtgtgtgtgtgtgtgtgtgtgtggtgaaaaaacataatgagctctattctgttaacaaatttttatgtgtataatacagtatcgttaagcacaatgttgtacaacagatctctagagctttttcatcttgcataactgaaattttatactcactgaacagtaatcatttccctctcccctcatcccctggcaactgccattcttctttctacttctatagtttgattactttattttttattttatcttattaaaaaaaatagagacaggatttcactgtgttgcccaggctggtcttgaactcggctcaagtgatcctcctgcctcggtctctcaaagtactgggattacaggcaagagccactgtgtctggcccagtttgattactttagatgcctcatataagtgaatcatgcagcatttatctttttgtgactggcttatttcacttagcatgctgtatattgtatgtatatatcccatttcttaatccattcatctgttgatagacatttagtttgcttccatgtcttgtctattgtaaatagcactgcaatgaatgtgggtgtgcagatatctctttgagatgctgatttcacttcttttggataagtacccagaagtgggattgctggatcatagggtagttctatttctaatttttggatgaccctccatttagttcttggtgattctcctcaaggatccctctgtgcctgaaggatttccttcgcttacctcttgagcattcttgcccccttttttctatgctgcatcactgatttcctaaatgtcatatcttcctatagcttcctgagaaacataaagggtagattagtttactactttgcatgtccaaaaatgttcttttattcttttttttttttagatggagtctggctctgtcgcccgggctggagtgcagtggcatgatcttggctcactgcagcttctgcctcctgggtcttggttcaagcaattcttttgctgcagcctcccgagtagctgggattacaggcacgtgccaccatgcccagctaatttttgtagttttagtagagacagggtttcaccatgttggccaggctggtcatgaactcctgaccttgtgatctgccggcctcggcctcccaaagtgctgggattacaggtgtgagccaccacacctggcccacatttttaatttttaagagctgtttctttttcttcaaatgcttcttgttaaaatctttttggttttgttggtcttatcccactgacagtattaaaagtgtaggtttgttttaagtttcctctgttcttgaattactgtattttttgtgagtttcttttttccttttagctttgatctctatctttagttttgtagccttgggtaagcatctggtgattcttatttaaaatgaggcaaggaaaagctgatcgcatgttctttgtgtgaggtgggcttatcaacttgggagcttcacagtttagtgattagggagaggaccattttgttggccacaccccagagctgtatgtcttttcttttgggctacaggattttccttagaaagttcttcattctcccttgtggtcaggagggatggggattacacagcgggtgcaagtcaggtcattggagagctgagtggggaaagaggagcaagagagaagtgtcttatttagcacacgccctgtgttcagcagggcgcccacgccccatgctctcactttcatcagctttccagcttccggcatctggttgcaattcttatctcctgtctccccttctaatctctttgtccttgtggatatatagatctttttcatttctttactgtcattttagtaggatttcacaagggatttgccatgcttacttggaaatccctcagtgaggttttcggtgagaaaatagatatattttctgtatgatagtcctgggacagataagtcagttctgtttttaatgaggttgtgagtttgatccttgcaacgatgcagaagggctcattttaagtgaaatccttgtgaagaggaaagagaagggaaaccagtaaccacaggaagagcatgaggcagcttgttgagaagaatctcatggctgtaggtgcatgcttggtcccaactagatcttgtacttgtgttgtcgggcttagtatcaagtggcaactctgtgactgttaccatcactggaaaaacaactaaaaggccagtagcctctgcctcctgtccccctattctctcctgagttgcctctacagctaactttgttttgtacgttgctgaggaatcagatgagctctctcacctctttacacctacagattccccgtgcagattctctgccttccatcttgctgttgggagccaagtgtcatcattcatggccaggctcttcctttggttactggtttcccttctctttcctcttcacaaggatttcacttaaaatgagcccttctgcatcactgagtcttccttctatacttcatccttctcctcacacctgagtacttcccaccttcaaaacacatgtactctcagccgttgttctgttgttctgctcccctttctgatatgaattcttgaagtcgtctataatttgtttctgtctatcgctgctgccttctacccatgaaaactccattgaaaactgcttcaccagtgactccatgtggctaaatccactggtctcttagcattgctcgtcttagttgacctcttggcagcatttgatacagcctatggtccccacctccttggagcactttctttttttttttgagacggagtctcgctctgttgccaggctggagtgcagtggcgtgatctcggctcactgcaacctctgcctcctggattcaagtgattctcctgcctcggcctcccgagtagctgggactacaggcatgtgccaccatgctcagctaatttttgtatttttagtagagatagggtttcaccgtattggccaggatggtctcgatctcttgaccgcatgatccgaccaccttggcctcccaaagtgctgggattacaggcatgagccactgcgcctagcctggagcactttctttacttggtttctgggaaagcatacccccaggtttcctctgacctcatcagctattccttcttattccttaaactcttccccctgggcctggtctttaaatgttgaaatacctggttcagacctcagccccctctcttctctgtccatgctgtttcctttggtgagctcacctagtcctatgactctaaataccagctgtatgcttatgactcaaacgtttatttttctagccctgacctctcctcttgagcccagatgcacatactgaaatgcctacttgacatctttatttgcctgtctcacaggtatctcgtttcacaggtccaaaacaggacttttccttcctacctgttcttttccgccaccttgaaaacctgttctttcccacgtcttttgcatattagcaaatggcaacacgatcacccggttgcttaagatctaggaatcaggccaggtgcggtggctcacaccagtaaacacagcactttgagaggctgaggtgggcagatcactcgaggtcaggagttcgagaccagcctggccaacatggtgaaacccagtctctactaaaaatacaaaaattaccctgacatgatggcgcacacctgtaatcccagctactaggaggctgaggcaggagaattaattgtttgagcccgggaggcggaggttgcagtgagccactatactccagccttggtgacaaagcgagactccgtctcaaaaaaacaaaaacaaatatctaggaatcatccttcatctttattttccattctatctcccaccgttcccatcagcacatagctcaattctgtggacctcttgacctccactgccaactccccaggctaagcccattcttatctagcttagacttccgcagcagcctcctcagtgatctgttttcattcttgcctccttatttattctgcagatagtgaccagaagtcagatcaggccattctcctgcttcagactcttctgtgggtttccgttgtgcttgaatcagttctagagcccttgctgtgtccgtaggcccctccaggagccagccctcacttctctcgctgagctcctctcctatgccccatgtttgcccactgcactccagctgcagttgctttcttttttccgtttctcacacatgccaagctccttcctgatgcagccccagatgtttacactaaaactgaccccttgtcattttcttaaagaggatgttgcttccttaaagaggctttttttctgatcatatctaaagtgcttctgtccctaatcactattacatttccctattttttattttttaatttagttttttttttttttttttgagacagggtgttgctctgtcacccaggctggagtgtagtggtgccatgacttgctgcaggcttgacctccttggctcaagtgatcctcctgccttaacctcccaagtagttgcctggctaatttttaaattttttctagagatggggtctcgctatgttacccaagctgctctcgaactcctgggctcaggcagtcctcccaccttggcctcctaaagtgctgggattataggcatgagctaccgtgcccagcctctgttttgttttattcacagctcttattaccagccaaatgatcttacttgtatattgatgataatcttgctgtaagaattgggagcagaatactcccaaagcataaaatggagtcggatgtggtagtgggcattcaatgaagattaaatgaatgaacaaccaaacaaatgaacaatttgcgtaatttttttttttttggcatgaactctcgtccttttaaaagttcttatttatttgaattttcctacccattaggaaattagaaaattaccataataaagatcttcagcatagtgacatctgacaaatctcaggtcataacaaggttatggcagagtctcaagtcacatgggttcttggttttctgattcttcattcattgtgccttccttatttcattgcgaaaatttcttgaagattagattattttcaatctcttgaagactaattaaattgtaagatatgcttgtattcctgccatgtttgtcaacaaggagctaaaattacatccaagttttaataaattcaatttttttttttaaaaaataggtcacctggcggtagacccattcataagaggaaaagacagaattcacattgggatccagtttctttaatatctcatgcacttaaacagaaatttgcatttcaagaagatgattcttttgagaaagagaatagatcttgggaatcttccccattttctagtccagaaacttcaagggtaagctacactaatgtaaaattaatttttcagtttttctcagatgtgttgtttatgttacagctttgtgttcaagttctcttgaagtaattgtgcagaatgggctatataattgtttattgatgctgctaatgtttctggggtttttttgttgttaattttatatgctcattttcacttttagcctatcatgagctcttttgaaataaaatacttaatttgaaaaatatttgtgcatatgtttataatgacttatcttaggtgccaatttgatgttgccatctgcagtatgaactgggtgtctgacagtttgagagggccagggaagaatggtgcaatagattccccctaaccatatggaatgtgaatacgccaagatttttctctgtcaaatatacagactttggatattttgttgaatataatgttaactctgcatgtaaaaaagcaaatgggattatagttatctttagtgacagcacttactggatgcctaggatgacaaacactggattttaagcatttgagccttaagattactccttacttgaagtctcttttcttaaatttagaagtaattctaattttggggtggttttcacatgtcttaatttagttgaggtagtattaacacataagaataagccttgagaatgacaggagtgtggaagaggaacagcatctaaagtcagctagatagcactgaggaaggacagacgtcagcagaggaagagactggaaaactcagatgcattgagccctccaagagtgtaacagggccgggcgtggtcatcccagcactttgggaggctgaggtgggcagatcatgcatgaggtcaggagttcgagaccagcctgaccaacacggtgaaacctcgtctctactaaaaatacgaaaattagccgggtgtggtggcacgcatctgtaattaattccagctactcaggaggctgaggcaggagaattggttgaacccgggaggtggaggttgcagtgagccaagattgtgccactgcagtccagcctggcgacagagctagagtcagtctcaaaaaaaacaaaaaaagaaaaagagtgtaacagagtggagggacttgtcacacacacacattgccactccagtgtgtgcagcctctgtgctcaccattgtgtgtgtgtgtgtatatatctgatgtttagcatgttgacttagaaaattatattcttttaactatttaagaagacactttagaactattactataaaaatgcaagtgtgtctaaaataaatgtttaattttaacatttgtagagcagtttgtaacttgcaaagtaccttttttactcatctcactagatcttcacagcagcaatcccttttcccccgaaaatgtgagggaaatgatccctgtagtgcctataatcccatatctaaggggcagagcagagactagaacttggtttcttaaaatttgaggatgtttgaaaatttgaggatgcatttatgtaagaagttcccgtaggtggaacacactgtttcccagtgatagtggataaacgaagtgtttctaggttgtcatttactgcttgctattagttcagtgtctcttagcactttttccagccaattacaagtattttagataatcttctttttttttttttttttttttttacatagtttttagcacttaatttcaggctgggcacatagggactcaaattttagttgcctaagagctcagtctgtgccgctgagagtgtctcgttcacttttgtccttggctctgagcgtagtacctgatacatagccaaataactatgtattatagtaataaatacggtaaataaatattgtgaatgaaacctcagagggtcatctggcctttgtcttgccattcttttttttttttgacattagaataatttctgtgttaaatatttgctttatttcagtttggacatcacatttcacagtcagaaggacagcgaactaaagaagaaatggtcaacacaaaagctgttgaccaaggtatcagcaacacaagccttctaaactcaaggatttaaactcaacttaaggttgagctttaaacttccaaaacttcttcctggatgataaattattcttagaaactgatttggactgttaaaggctaaaagtagatgtatttaaagactcttcttgacacattttgcctacacttgctatgtaaatatgtatgcctgtcatttttgtttcctttgttcctttttacgtttatactctgttcttctgtacatagagcttaaaataaacattctttttgaacttgcttgtg

SEQ ID NO: 595 - DNA, 15841 bp, Homo sapiens
gtgcctgggcggaaactttgcgagagtagcgcgggagctgagaagttgcagggttgagttggtcccggcaagtccttgagcagtttgttcctctgtcttcccgcttcctggtgccccgactgcgtccccacgaacgccccgtccttaccgccggctgctgtggagtgcctcgctgtctcccaggtccccgagtgagcgtcgaatgggacctctgtggctagggcaggcctgtgtgggtggcactgagagggaggaggggagggggatgttcgcagtttccttgcgaccccagggactttctttgtccccgccatccacctccttaggcctttgggatcgccgactggtctaatgtcgccggcccttgtggctctgggaaattagcattgattaatcttcctaacaatttttgtttttatagagacaggatctccctatgttgcccaggctggtctcgaactcctgggctcaaggtatcttcctgcctcggcttcccaaagtgctgggattacaggcgtgagcccggccagctcctaataatgttaagtgcttgctaggagtcaagcgctgtgctgagcgcaggggcttcccacgtcattgcgtccccagtgcttagtgccaggcactgagcagaggcgcgattcgtatttgaactaaaacgaaccccgtccctgaggaacaagacctctactgggaagtcaaagaaatgaatagtgattgtatggtgtgatgggtgctcagctcttggtggacagaagtaagggggaggcttgtttgagaaacggatacctgacctaagccttggaggaagaggcagacactggaaaactagagtccctgcgttctctcaccacttgctaaagggcctctacaaccccaggaaacctcaataaacctttcctttctccagatagatgtctgttcttgcagataattagaaaacgcattgcagagtattggttctttccctctcattaggttcctggtttcagagaagatgaccgaagaagtggatttcctgggacaggactctgatgggggtagtgaggaagtggtcctaactcctgcagagctcattgaaagattggagcaggtaagcatcccagatcgaatccctttgctccagtcagcctttttatttagttcaactgtgaatatcagggatcacaagatgaggaaacggaatttggggcttactttagaacagggactggatcttaccatctacatggaaacgggaagcaagaaggacatcctctgttagagacctcatcatatcaaacacagcatccccaagtggggtcagtaagggacagctttgggcacattcagtgaacagttcacagagcaaggatccacgtgatattttcagggactgtagaggtccctgaacttctttaccttagtcccttgaacatctgctgtttccctggagaatgcctgtttagcaagaaaatgctgaaatgcctgtaagggaaaactggtcatatttttcctttttctcacatgttttttcttgagtcgtctgctctccatatgtccactgcttatctaaaatcctttctgaaatatttctcctttaagttgtaatagctatgacttactgcatatttcccatgtgccagtaactgtgttctttacacttatatctcatgatgctctggtaacaggagttcagactatctggatttaaatctgtctgtgacactcctctgttatgtgatcttgagcaagttagggagtttgtctcaagccgttgcttgcctataaaattgagacaatagggccgggcacggtggctcaagcctgtaatgccagcactttgggaggctgaggtgggcggatcacctgaggtccaggagttcgagaccagccttaccaacatggtaaaatcccgtctctactaaaaaacaaaaattagccggatgtggtggcgcatgcctgtaatcccagctactcgggaggctaaggccggaggatcacctgaacctgggaggcagaggttgtggtgagccaagatcctacccaccattgcactccagcctgggcaacaagagtgaaactccgtctcaaaaaaataataaaataaaattgagatgataatagtgtctatgtcctggagtttttgattaaatgtggtaattgtgtaaagcactcagcatgctatctgacacatgataagcactcactagatgtgagctgttcatagtaagtatccttatcctcttgctctaactgcccctttccagagctctctcatgtttgctactttagtattcttcattcttccctgccatacatgatatcacgaatgacaaaacggaactaaaatgatttttaaattataccttacatgataatccttactatttagcagtgattcttaatctgtttttatatcacagacctttttgagaaactggtagaaactgtggtctttcatcccacaataacgcacacatgcacccatgcagaattttgcatatgacttccaggggatcagagatcccctgaaatccacccacagacctagtttgtggaacagcattaagaattcctggttcgttaggaaagggttcattaaacaaaaatcaaaaggcacatagcataaaggaaaaaagggatacattcctggagtgcagtggtgtgatcttggttcacttgcagcctccacctcccaggttcaagcgattctcctgcatcagcctcctgagtagctgggcctacaggtgtgcaccaccacgcctggctactttttgtatttttagtagagatggggtttcaccatattgggtttcgctgtgttggccaggctggtcttgaactcctgaccttgtgatctgcctgccttagcctcccaaagtgctgggattacaggcatgagcctctgtgcccagcctgtttgtacttctggattagagtgaaaagacaggccaccaggctgggagaagatatttgcaaaatactaatatgtagctgacacaagatgattatccacagtacataaacagctctttcatactgcccagtacagactgatacctcagagaagaagaaaacaggatgaccaataagcatatgaaaaagatgttcaacctttttagtaatcaggaaaatgaaaatcatgagatatcatctcatatctatcagattggaagaactgaaaaacgtgagcaatataaagtatggcaagaatgtagagcagctgagcgcagtggctcatgcctgtagttctagcaactcaggaagcccaagtgggaggttcatttgaacccaggagtttgagaccatcctgaggatcatagcgagatcttatcccaaaaagagaaaattaagaatatagggcaggccgggtgcggtggctcacacctgtaatcccagcactttgggagaccgagaggggcggatcacctgaagtcaggagttcaagaccatcctggccaacatggcgaaaccccgtctctaccaaaaatacaaaaattagccaggcttgttggcatgcctgtaatcccagctactcaggaggttgaggcaggagaatctcttgaacccaggaggtggagattgcagagagccgagatcatgccactgcactccagcctgggcaacagagcaagactccatctcaaaaaaaaaaaaaaaaaaatgaagagcaatttgcacacttatatactgccgtgggatataaataggtataatcgctttggaaaataatttgttattgtctagtaaagatgaaggtgcacatacctgcggcccagtagttccacccccaggtacatacctagtgaaaacttccgcatgtactctaggagacatccacagtatgttcacacattgcttgcaatagttaaaaattaaaataacctagacaaccgtaaacaaatagcattgagaaaatataccatacacagtgggaataaaacagcagtgaaaatgagtaaaataactcctgaaacagcatgaataacaggaacttaatgtagaacaataacaaccataaaatatgagctgccaaagaaacactttatgtaaagttcaaacttgcaaaattattgttcaaggcagagccgccacccttgggtgatgtggcacactgctatgccacagatgcctctgtgtggacccctgcaccttccaggacagctggagccccaggctggttactttttcaagtgagcatcatcggggtccttgaaaggcagctagaggatggggcggcgggggttctgacagcacagctgcagcttgctggtgggtaagctgcagtaacatctcatgcctgatgctctagtgcagtgccctgagtgcagccaaggaagtgacccgccacctgcacggctgccacagccagatcctgtctcttatgctgtgtggcacagccaaagggacagcctgacagggctgctgatgagaacagctccaggagcatatataggataccctttaatgcctgtaaaaagtgatttaaaagttgttacctgtagtgcagatttgctcattttagtgattgttttagtttgctagggccacagagcgaagtcccaaagactgggtggcttaaatagaaatttattttcttaattctagaggctgaggtcaaagtgccagcatagttgtcttcttccgagtcctctgtcttgggtttgtaggtgaccatattctccctgtgtccttgcatggtcttccctctcgtgtgtgtctgtgttaaaattaccccttatcagggcaccagtcttactggattaggggccatcctaatgacctcattttaacttaatcacttctttaaagacctccatctccaaatacagtcacggtctgaggtcctggaagttaggtagatttttgaggggcggacacacttcagcccgtagcaataatgaacagattggcatttagaattttgatcaggggccaggcacagtggttcaagcctgtaatcccaacacttctggaggctaatgcagggggatgtcatgaggccaggatttcgaagaccactgtaggcaacatggtaaaaccccatctttattaaaaaaaatttaaaaattagccaggctttgtggtatgtacctttagtcccagctactctggaggctgaggcaggaggatcacttaagccttggaggtcaagaatgcagtgagccattatcatgccactgtgtgaccagaaaccagatgtagccatttcaagcataaaacctgagttaaaaaaaaaaaaaagattggatttagatacaagtttctcagtaaaaattttggaaagatttatatgaaagttttatactaatataaacttccacctaatgttttatactttattgtcataatttcataatgtaaatgaagtggtccccaatactaccccagtgtaccagacaagcactatcattttctttgaatatcctgtcatgaacaggttgagaggtgttctacagagatatgaacaaatgtagtgagaccataaagaaaattcaacatgaaattcaagctaatgattacctctgaggagggagggacacacagggtcttttttttttttgagatggagtcttgctctgttgccctggctggagggcagtggtgcaatcttggctcactgcaacctctgcctcccaggttcaagcagttctgcctcagcctcccaagtagctgggactacaggcgtgccacgcccggctaattttttgtatttttagtggagacggagtttcaccatgttagccaggatggtttgatctcctgacctcgtgatccgcctgcctcggcctcccaaagtgctgggattacaggcgtgagccactgcacccggcttgttcttgtagttttaaaaattattcagtatttggctgggctcggtggctcacgcctctaaccccagcactttgagaggccaaggcaggtggatcacttgaggtcaggagttcaagaccagcctgacgaatacggtgaaaccctgtctctaataaaaatacaaaaattagctgggcatagtggcacatgcctgtaattccagctactcggaaggctgaggcaggagaatcacttgaacccgagaggcagaggctgcagtgagctgggatcatgcctctgctttccagcctgggcaacagagtgagactgtgcctcaaaaataaataaaaattattcaatatttaataaaaatcaatcaaaaagaaatgctgctcctaataagccctccagaaaatatgatgttttcccatgcattatgcaggttttttttgtttgtttgtttcagtctgcaggactgttacagatgctcaggctctgcacaaatgcctatgactgtagccatacccagcatttggtaatgtgtcttgacggtgatcatggggagaagcagacactcaaggacgtcagaaaaaaataagttgagcctggtcagcatataattctgagctatgctaaaactacatttcctgtaattgaaagataagtgtagctttcctcagtcacttagggatatttcagttctctaagccttggaagtctctaaaatgaaccaaacagctgggcctgagtcataaattagagctttaacctctggctccaaaactccataatagatgagcgcctgtttctattatgatcctgtatactttggggccattagtaaattactcaatctgtattttttcaatcagatgaggataactatatccattttctctgagatatgatgatgatgaatgaaaaatatttgtgaagtgctctgagcttcaggaatgaagagctgtgtggattggtgggttattgctttctctctaaatagacatggggtggcgctgcctgggggaacagtgtgcccgggctgcctggcaaaggcactatttgaacaccaggtggtgtcactctcagcaccaagcgtcacactaactgaagtaagcaagggtttgtatgagtgtcagttgaatagaaggttgtgaacacagcctcccaactaaaacaagacacgagaaagcaatcgctaaacgtagtttgtcttcaaaacaccttcaatgtttccagttggtgggcagacagttttcttgcctgcgccatccctggttttcgttggacttgggctgactcactgggttgtttagctctgtggtgggtgatgcttgctttttctggcatttgtcttttaggcctggatgaatgaaaagtttgcccctgagctgctggagagcaagcctgagattgtagaatgtgtcatggaacagctggagcacatggtaagagtcgcttgtcttgggttgacaaaggaggagaaaggtaaaagcatttggtcagcacactgagagcttgtggtctggtagcaaatctgttttgtttggctccactcacagtccagttctttaaaacaacattgaattagttatctatgtttatcaatcttgagagtgcctgtaaatatctggatattggcttcccatgaaaagtctaaaatcctgcatttctgcatgagaacagttgaccagagcagtcccatgagagctgtccatccatgtactccctgctccccacagcccctgactacccacccttctcttgtagcctccccacctggcccctgcaaacatttgagtttgtggtccctggcctagatgatctgagcataaatcattgtcaacttcagagaagctgtaaaatgtggatatttcagtttctcagctggtgttttaatactgctttttagacccaatggaagtttcgtctgtgtgctgtactatctcccttacaatcagattggagttcttttggaagcctctggctgaacagattctattcaaatggtcattttctaaaagtaaatgactattgtttgtactttatacaatgataaaatgaaaactcacatgatatttttgttttccttggactgaaacatagtctgggtcctcaacgttgccggtgatgatggttgaacatcatgttttttataaaccttaatttctcatttaataggaagaaaatctcaggagagccaaaagggaggacctgaaggtcagcatccaccaaatggagatggagaggatccgctacgtcctcagcagctacttgcggtgtcgcctcatgaaggtttgacgtggagatacctggagggattgagacagcacagtctgtaatgcagactgaatgtcctggggaaaacttgggctggggcccaggagggtccaggacctgaagatgctgctaagagcccaatatccatgtagctaaactgtaaggagagcgagagattgctccacagaagcacagaggaacgtgtgtggcccactgcggggacaccgcacacatttttagtctgttcacctgccgagtgagtggttcccccttgcgttacagcatggcagtgctaaagggagagttgttggcattggtcaatagtgaatgctgactagaggagaacttgtttccaaaattattttgtctgtcagatggccaacgtcagtgtcaaatgaaccaggatgacttacattcacctacagctttgtggctatctaacttacaaaaatgaagttgcaggccaggcgtggtggctcacacctgtaatcccagcactttgggaggctaggcgggtggatcacctgaggtcaggagtttgagaccagcctgaccaacaaggtgaaaccccatttctactaaaaataaaaaaattagccaggcgtggcggcaggcgcctgtagtcccagctactcaggaggctgagacaggagaattgcttgaacccaggaggtggaggtttcagtgagccaagattgtaccactgcactccagcctgggcaacagagcgagactccgcctcaaaaaaaaaaaaaaaagaaattgcaaaacattcctagtttataactctgagaaattcttacttccttgacatttcatttggttctatgtgtctctttagttattacaaataagataaattatctcttctacatgagaatgcttcagctatctgaagactgcccacagtctcctcgaagtcttctctcaggcatacattttagccattcaaaccatttactctcctggtctcttctctaaaagggttcttgtttgtctctatccttcttaagttacactatcttaaactaaacacagtatcccagttgtagtttgaccaagtttgtgaaaaacagaatgatcatttctcttattctggttattaagctggtagtaatgccaaccacatcacattagcatatttatcacattagcatattgacaggtacgctgcctgagctcattcttcactcacgtggacactaaccccttttaagatgataattaccccatccagtcactgtcctctacttgtatggcttaggttttggctccttaagtgtagggcttgatacttatctctcttaagctttatcttattaaattgggccatttcccttgtctctggatgctgatcttgtcacctaatgtattagctgtctcttaatactttatgtcatcaaccccctttttttatttgtttggttgtgtttttttgttttttttgacagagtctcactctgttgctcaggctggagtgcagtggcgcgatctcagctcactgcaaccttcgccccccaggttgacgtgattctgttgcctcagccttccaagtagctgggattacatgcccctgccaccaggcccagctgatttttagaagagacagggtttcaccatgttggccaggctgatctcgaactcctgacctcaggtgatccacacccaccttggcctcccaaagtgcggggattacaggcatgagctactgtgcctggcccacataaggtttttgatggcatgcttaccaaagctggtgatgaccagttacaggctcacgcctataatcccagcactttgggaggccaaggcaggtggatcacctgaggtcaggagtttgagaccagcctggacaacatggtgaaatcctatctctactaaaaatacaaaaatcatctgggtgtggtggtgggtgcctgtaatcccagctacttgggaggctgaggccggagaatcacttgaacccgagagttggaggttgcagtgagctgagatcacaccactgcattccagcctggacaacacaatgagactccatctcaaaaaaaaaaaaaaaaaaaaaaaaccttatgtgattattaattggactgtggcaagggtctttcacaaaagacttccctacagtttgacatctacccattgagtcagcattcttttttcagccacttaggagtctcccaatccaagccgtcccctagccccaggtccatagcttgcctgcaagggtgtctcagagacgttgtcctgtgtcttatggtgtgtctctccacccaccctatcccacctccaggccacatgtccttcctcgggagggttgtgtaaaccctctttatgttaaccacatccttctctttgacttttgccaatgttttcatgaagattttgctttatcctcacagatagagaagtttttccctcatgtccttgagaaggaaaaaacacgtcctgagggggagccttccagcctctcgccggaagagttggcctttgccagagagtgagtgagtgagccgttggcgtggggcacctggctggttcagcatgaggcctgtcctagaggcctgtgcgctgctgcctgctaaccttggacgtccatcagctgtgtacaccacagcgatttgaatccatgtctttcaggttcatggcgaacacagagtcctatctgaaaaatgtcgccttgaagcacatgccccctaacttacagaaggtggacctctttcgggcaggtaaacaggacgttctccctgcaggtggcccacccatcctcaggtgtcccagggtaggatcctctcttcactgtttttacccaaatacaaaaaagtaagtatgtagataaacagaaagaagagcaaggattctagctaaaaaccaaaaaaatcacggaaagcagatccaatggtaggcatttgagcattgcttccttgttccctggggtgggctgagccccatgactgcactggtgcttgtagactcgggcatggagccgcgttcgccttcagtagccatctgctgagcctctgtgaggtgctggcagccccgagtaccagcactgcagagcctacaccaacattgcccctgcttagaggggctggccatctcttcgtcacaggtcccagaatgcacagggctcgcctagctggaggggagggctgaaacaggaggctagggagacctccagtgagtccctgtggcctcagaagagggagcaggttggagggtgtggagagaggagggaggggagccggggaaggggagcttggccggagcccctcctcgggcttcttcgcaccagcccctgagggctgccgagcaaggaaagggaggtataggcagagcccttaccgtcggatcaacccaccgggggccctggcttacaggataaagcccatgttcctcagtgtttcacagtgcgccagatccaagcaagacctcctcaggcaaaattgccataccaaatcaaacgagctccagtacacccgagccctggaaattcatctctgcccagcctgtgctggggctggggaccacacagccacccctgcggtggtggaacagggtcttagtccctttgggctgctcacagttatggagactgggaagtccaggatccaggcccccacagactcagtgtctgccaagagcctgttcctcatagatggcgccttccatatgtcctcacagagaagggaaggggcaagcagactctcaggctacttttataagatcactaatcctagtctctgtgtgtcctagtcccctccctcccccccaccttttgatttttgttttttgtttgctttttattttttgagacaaggtcttgctcagttgccccagctggagtagattgacgctgtcatagctcactgcagccttgaactcctgggctcaagcgatcctcccacctcagcttcccaagtagctggaactacaggcatgtgccaccatgcttggctattatttttaaaatttttttgtggagacagaatcttgccatgttgcgtaggctggtgtcaaactcctggcctcaattgatcctccagcctcagcctctcaaaatgctgagatcacaggcataagccactgtgcctggcctattctcttcttataagacaccagtcagattggattagggcccacactacttggcctcgctttcacttaattgcctctttaaaagccctgtttccgaatacaatcccacgctgaaatactgggggttagggcttcagcgtatgaattgtgcagggacacagtgtagcccataacaccaggagcaagtcagacccataccagacttgtggaaccctgaattggtcattttgctgaggctgcctgaggaaaacaaaaggcccaatgcgtgtccggtttcctccctggtcagccactctgtctgcatctttgaagagtaggaatgggctgggctcctatctaaaccctgagtgtgccataccattcttcccagcaacttttactttgttgactttgttggccgaggatttcctaatcacattgttgttttcctggcagttcccaaaccagatctagattcttacgtgtttctgagagtgagagaacgacaagaaaacatactggtagaaccagacacagatgagcagaggtgagtggcgtgcatctttcacagtgggcacattcctcccgatggagggccagccgagctctgcaggcaaatgtgtttccctctttttcagggactacgtgattgacctggagaagggctcacagcacttgatccgatacaaaaccattgcacctctggttgcatctggagctgtccagctaatttaaaactaggcataaacagccaggcatggtgactcaagcctgtaatcccagcactttgggaggccgaggcgggcggatcatgaggtcaggagttcgagaccaaccgaccaacatggtgaaaccccatctttactaaaaatacaaaataattagccgggtgttggtggtgtgcacctgtaatcccagctactcaggaggccggggcaggagaatcgcttgaacctgggagcaggaggttgcagtgagccgaggtcgtgccattgcactccagcctgggtgacagtgagactttgtctcaaaaaaaaaaacaaaaaacaaaaaaaaaacaaactaggcataaactcatgaggtcaggagatcaagaccatcctggctactaaaccccatctctactaaacccatctctactaaaaatacaaaaaattagccaggcatggtggcgggcccatctactcaggaggctgaggcaggagaatggtgtgaacccgggaggtggagcttgcagtgagccaagatcgtgccattgcactctagcctgggcgacagagcgagactccatttccaaaaaaaacacactaggcgtaaacaagaatgaagacctggaaccgtagagaaaatactagaaacccctcgtatcacgttgtgcctgaggacaataataaagtagtttactaggcatcagacattcctcagcagtgctgtgggtcacgggcgtgaagcggagctcgaggcaggattgcttgtgttgctgcatgtcctgtctgctgttttagcccgtgtcagtagatggggccattgtactgtttgttctgcacacttggcggagcagcagaggctctcagcacgccttttccctttgtagtattttctgagctaaggaaagtcaggcagaagtagttcataagaaggcatcactgcctgtgatcggggctgcatttagccctgacctgataatggtaggagagttcatttagcctttctgctgcgaagattgtaaatagattaaagaaaacagctgtggccttctcccgtcatacatcattagactgtgtaaactaacattttagaacctctaatattggacttaaaaccaatttctgtcgtgcttaattgaaaatcacaactaaaccaataaaccattattaaatttccattctgcagcagaaggcacctctggacggctcccggcttgtagtttaatgaagtatgtgctccctgctgttaacccgcagccctccccaactctccagcagctttgccaagtcagcctccgggccatctggctgtccttggccaaggcactgttaacggagtgacgttaaccatcttgtattgtgacctgtggccgcttttctggtttaagtccttcactttttcaagaggaatggatgaaattaatgtgcatgcagagtctcacagtgatgccggaaggaaggatgtataggcagtgaatgaatgatctttccttgaaatgctataaaaagcaacctgcattccagtcttttcttcctggttgaagttggcagatttccatttgcagggtatgggctgcgagagtaatcagggtaacattgctgtcatttccaagagaaatcagtaggggaaagcaagggaggtcttttttttttttcttttttgagacggagtttccctcttgttacccaggctggagtggcagtggtgtgaacacggctcactgcagcctccacctcctgggttcaagagattctcctgccccagcctcccgagtagctggtattataggtgcacaccaccacacccaactaattttttgtatttttagtagagatggggtttcatgatgttggccaagctggtctcgagctcctgaccccaggtgatccacccacctcggcctcccaaagtgctggaattataggcgtgagccactgcgcacggcctggggaggttttatttcttgacaaaggtatttgatactcgtgcagtccctggagggtctcactggagagacaacatttaggctgagatctgattaacaggaggcagctgcagtgcagaggtcaaaagggagggtgttccaggcagagaaaacagcctgtgcaaaggccctgaggcagaaacaaactctacttgaggtcagcctggttagaaagcccaactcaaaatagaaagtattacatgataaggtctgaggcaggctggacccagatcttacaggaccttgttaataaggatcccatttggtcccccacagtcctgagaagcgggcagggctgtgggaaacagcagatatttagtggtaagcctgagatcagaacccaagtctgcacttcctagtcacgttctccctgtagtgctaagcccagagacctgagctgttaacctagaacagtgtgcttcctaagccttaatgtgcatacccatcgcctggagctcgccttaagatgtaggttctgcctgaagcccaagttcatttagtatgtcatggttaattcagagtaaaatcaagagttagtacttgatttatgcttgttatataaagaaagagacaacttcactgtatgatcattttgtcacttttcaaaagcatttaattcccattcaattgaaaatgtttcaagaacaaacctgtttggtcattttattgatattgcacatttgtatatgaataaatttttgcaaattaaaaaaaaaaaagatgtaggttctgaaacagggtgaggtccaggatcctgcctttctaaggagctcccatgttgtgcagttgctgctggcccggggaccacattgaatgacggctctacgtcctcatgcctccagctgctgccctgtacatgtccaactgcacggagcactttacatcctctaaaaccacagtaaattgctccatttcctaaattacctcttcaagagaagactggttttgatgtcatttttaaataaaggagaagttgaatttcaaaaccaagtggaacaggaa

SEQ ID NO: 596 - DNA, 43629 bp, Homo sapiens
ggcaccgcccaccggcttgaatcccggcgcctcagaggactatgaggcgggcgccaactgcttgggccgcagggcgggaggcagcgcgggagtggggcgttgaggggccggcctagcttggggctctggccttgcgtcttccgaccgaatcaccgctcctgagcccggtgcggggctgccgctatcgcctggccgtgggtgccggagcggccgggttgcgactcagcgttcttgggtgggcgcgggcggcgtctccgcggcgggcatcccccgaggccgccctcgggccatgatcgactccgtgaagctgcgccgcgacagcgcggcggacttcttctcccactacgagtacctgtgcgcgctgcagaactcggtgccgctgcccgccgtgcgcgcctgtctccgggagggcgtgctggatttcaacgccgaccgcctccgcggggtggactgggcgcctctgctgagcaccctcaagatcaataaagacctgcccttggtctccatcaagagcttcttccagccctggctgggggacacaggtttgtagttcccgcctccagggcccctcagtcggtgcggcgaagtgggtttttaggtgagtggtgtccattgtcggggtatgtgtgcaatagaaggggtgtgcggcctggacactcacgagctaggtgagtggcttaaggtctctagggcttcagtgtgctcatccgtaacatgggcttaataacgagacccaggttatgtgcgccttcgcaaggattccctgcgctgctgatgcctgcagagctcttagcacagtttgggacatcattaaacatttgacagatgttacctattttattgaatgactttgatttgcctgatagagaactaagcaggtaggaaattaatacatgtcagcctttgtctttttttttttttttttttttttttttttgagacactgtttcactctgtcgcccaggctggaatgcagtggcaagatctcggctcactgcaacctccgcctcccgggttcaagtgattctcctgcctcaacctcccgagtagctgggattacaggcgcgcgccaccatgcccggctaatttttgtatttttagtagagatggggtttcaccatgttagccaggctggtctcgaactcctgacctcaggtgatccgcccgcttcggccttccaaagtgctgggattacaggcatgagccaccgcgcccggcctgtcttcattttttaaggtgtatataagaagtttgtaaagtgctttacaaatacaagccatttgtaaatgtatagtggtataattagggatccagactctctgattattcggaaaatatgttaggtcaactatgatatatgacaaaatgctgttattcctttgagcacttagcattttctacataatggaggcagcttcctatagacgctagctaggtaacaggaaggaacagtttgtgcaaaagttttggaaataggagagagtatgcaagctgagttacaggactggaatttaggtttgagaaagagcagagagagttgaggctggaaaccttgtgggggccaaacagggagggtcctcgtttgtcctgtcatagagttggatgtttatcctgaaggttttgggaaaccgctgtaggatgatgagatggaatttccgtaggagctcagtctagcctccatatggaagacaaattaaaattggaaggatggtgaattgtaatctaatggcccaaactaaggtatagaaaagaagggctggggccgggcaccgtggcttatgcctgtaatcccagcactttgggaggccaaggcgggggggtgtggatcacctgaggtcaggagttcgagaccaggctcaccaacatggtgaaaccccatctgtactaaaaatacaaaaaaaaaaaaaaaaaaaattagccgggcgtggtggcgggcacctgtaatcccagctacttgggaggctgaggcacgagagttgcttgaacccagaaggtggaggtcgcagtgagctgagattgcaccgttgcactccagcctgggcaacaagagcaaaactctgtctcaaaaaaaaaaaaaaagaagggtaggatttcagatatctaagagaatggatgggcgtggtgactagttagaagaggggggcagcaagtatgggtgacagtttacagcagcgtctgtaagtgaaacacagcagcgtctttccatgacacagccgagttaactcgaatgagattgggggtgggaggaggatctcagtttgtctttaatgttttaagaggggcctgtggggcatccaaatgtgtctgctaggcagatctgggcccaagatttaggctttgtgggaggacaggtatttgaaggcatgggagggacctagattacccacaaagaagatccagataattgtaggtctgaaaggtgttttttaagtggatatggacgtgaacatgtttataagctgagagaaagagggagggtgtgcgatctgggagaggaaatgattattgatgtatttaaaaacaacctgaccacttgtcgtgtgcccggcccttttctaggctctggggttagcaccatctcttctgcaaggacagttcaacacatctgcttctgaaaataagtcagattattctctacatctcattcaggtgcaggaactgttctgtacctctgaatggactttagttaaccaaaataatatcaggaaccaggccaggtgcggtggctcacactggtaatcctaacactttgggaggccaggagtttgtgactggcctgggcaacatagtgagactcctgtctctacaaaaagtaaaaaatattagctgggcttggtggatctcttgagcccgggaggttgaggctgcagtgagccatgattttgccactgtactccagcctgggtgacagagcaagaccctgtccatgaccctccccctacaaaaaataaaaaaaccaggaaccaaaataaattaaagatgggagggacctcagagtcaaggctagcctactagatcttgcctaatattttgcactgaatgtaagaaaaatgtattacagaccattctcgtcagatattcttcactgaaccttctttatctcttgcatctagtgggtctaggttgtagattttaacctcctacatattgcttgtccatccttaattacattttgcctggactattgcagacgctcctagctagttttgctgccgttgagcttggtttttctcagttcatctgcctactttggttcaagtgatctttcaaaaaggaaaagacatgcttaaagtggcatgcccacgcaggaccagtgtgtattggttgcttgtgttctgcacagaggcactgaaatctcagctgtgttctgttaagcctcctggggttagttggtcttgaggaaggggagctttttctcatttcctttatctctttgatactccaacagtgaggcacatttttctaacctgctaggggtatccttaatgtgtcagtggtagccctgatcctcatcacctgtgaggtaaaagtgaactctcctaggcttgcttctccctgcctctttgtaaatttctgactcttccggctacggctctgggctttagtcggatccacctgcagttttccagtgcccggcaggtgtcaggcttagatgcctttgctctcgctgctccctctggttaatgcatcacccactctcaccccatgttgtcattctcatctttctagattcagcttcaggattatcttgaagccatcctttcagtgcaacttctttgcttccataagaacctctatgtacatagtttggtatatcccatgtggcttgagtttacatgtgtctgtgcttaagaggactttaaaggacatggctcatttctatgtcttagcacagagcagatgtttttgaatgatacattgtatgattgaagtcactaactttcttttatctttgttttaggttctgacatgaataaattttgcagaagtcgtgttcctgcgataagatacaaagatgtgaccttccagttgtgtaaagctcttaaaggctgtttaagtatatcaagtgtgctaaagaacctggagctaaatggactaattctgagagagagggatttaactattctagcaaaggtaagctttgtctcatttggcttgtagacatttgatagttgcttttagaggaaaaaaaacctcaataacatttttaacttttccccctcattaaagggattgaataaatcggcttctttggtgcacctgtctcttgcaaattgtccaattggagatggaggtttagaaagtgagtttaaatctcatttaactcttgtcctatcaggctggtttcatgtttccctacatgccatgttaattcctgtctgtaccttttttcttactactgcctcatatgcttgttcaaaccttggtccagtctcaagtctaccatgaaagcttggcatgctgaatgtaatctgaactaactttacttaagtttgtgttaaaccacagaccacacaaatatataccatctggtattctctgttttttgtgtttgttcatcttttagagtttttcttcaagaaatatttatgggaaggaaatagcaaaatgtaaagaggccgggcgtggtggctcacgcctgtgatcccagcaatttgggaggccgacgtgggcggatcatgaggtcaggagattgagactgtcctggctaacatggtgaaaccccatctctactaaaaaaatacaaaaaaactcaccaggcatggtggcgggtgcctatagtcccagccactcaggaggctgaggcaggagaatggtgtgaacctgggaggcagaggttgcagtgagccaagatcacaccactgcactctagcctgggcgatagagcaagactccgtctcaaaaaaaaaaaaatcatcattactttaaataattaaaacatatatacaatcaattttaatgcactgtggtatgttccaaaataggaaatataagcaaagtgctgtataggagcatataaaaggctgacagacttggggggaaagggttgggatcatggaaatagtcacagaaggtgactgttcgttgggatcctgaagtcttgtgttcgttgtgtgaaatagtggtctggaggggtaaggaaacctgcatttcaatttgagggagcagagagttaaaaggcctctgtcttctattgttctagtacattaggtgctctagtataacacctaataaaattctgggtttatagttgacactgaattgttggttaataacagattgaggtctgctcttggaaatgaaaataggaagagttttattttttttatgtttttctttcagatgtctcaaaaagtatatagaactttactgtggtctggagtaaggttgcaatattcagtctattcaattttggcatctaaatagaattgaactattgcaataaactggagtaactctttgttactgacttattttagaatgtaccaatcagttgcttaggtagattgtaaatagtgattttaagaatacaactataaaatagaaaagatataagaagagcaaataaatcaagactgactaggttgtatatgctcttcatcttattgtatgtggtttttttttccattttagttatttgtcaaggtataaagagctctatcactcttaagacagtcaacttcacaggatgtaatctgacatggcagggagcagatcacatggccaagatcttaaaggtaactttatgttccaactttcatgaaaatgtgttatatgattgccacacgttaatattttgatacaagacagcagttatttttgtcttttgatacatatgggcattgcagttttagttttgtttaaagaatgtgaccaattttcagcctggggttctaccatttattaaaggtagtatgcttaatcttagaaatagaagacctaaaatataataattagatttttctgtaaatacagtttgtaaaacagtaattttaaaggtgccttaacaactttatagtggttattactactgtatttaggataaaattacataataatgtgacatgaagcctttttagtaatttgatggtgtagatcggggtagtcaaactatggcctgtggaccaaatctagcctatcacctatttttgtaaataaagttttgaaacatagtcatgcccatttgtttacatattaactattgctacaccctacactaggagagttgagtagttgcaaaagaaactatatgacccacaaagctgaaaatgtttattttggggcctttacagcgtaagcccactctccgtgggatagataatggttactcatgtggattctgaagccagatggcctaggctaaaacccgagctctctcccatttaataacttgtgaccatgggcaaattagttaaccgctctgttcctcagttttcttatccataaaatgtgtataataagaaaacctactgtgtctgtcattgttaggatttaatgaactaatgtgtataaaatagtgcctggctatctaagtgtttgctgttatttcctcttattgcttttatacagttattatgaatagcaaatgacactgacagttttcatttgacggagtcataggagctttgaatcttttgtttcagaatgtaatgagatttttttttctcttaaaatcagtgtttcctgttaccgaaatttactttatggataaagagaagtgattatgtctgtaagataatacctgtggttaaaactcaaaccaccaatttccgaaggcatatcaaccttgctttgtatattctaggcctctaaatttggtgtgcataccctaagaaatatgtgagatcccttgggttaggagaagaaaatattaacctctatatttttgtatcatttaaaaaatacctattgtttctgtttgatttgtaatatacataaaatatgtatatagaaattcctgtatatagtttattaataaataacttacatgttaaatgtttacttgtgggatgtccagtcaagtgtttagagaccactggaggacagaatgatatgatttagaggctcagcaatgatagaatttagaaccagtaccttcacttggcatataaagaaaataaaattcttagaagttaactaagttgtcagtttacataaagcaatcagtaacaggtcattagtggttagggtcacatagctagtcagtgacagactagtatctgggtcactggactccttactcaaaatctactatttaatcagtctgtcagattaacccacctggcatatgtacctggtgtgtgtgtaaagctctgatgtaatcagctgtacttagttccttttagtgttcctatctctttatccaagtgtattaatttcatcttattaaatctttgaagtatcagaccatgagaaggcatgaagaaacctgggctgagagtcttcgctataggagacctgatcttgactgtatggctggcttaagacgtatcacactgaattgcaacacacttattggtgacctaggtgcatgtgcttttgcagactctctcagtgaggatttatggctgagaggtaagttaaatgaacttgtaaggtggaaaatattgaattttttgatattaaatatgcttaactcttggcacagtaatgttgtccgaaggttttttaaaaagcctcttttttctaataggttttattttgtttttaagcctttataaaagttatatatattctttatagaaaataccaagtaacaaaaaaaaaaaaagtacatataatctcaatgcctagagataaactgttcattttggtgtatacactttcagtattgttttttcctgcagatacatttgtgtgcttagagttacaagaacagaactatagtgcacttaccattttgtaaccctgctttttttatttaatgatgtatcatgtagtactctattatattgaggcataatagtttaattccctactatttgatatttaggcagtttgtgcttttcccctgttataaacaactctgtagtaaactccttatgtatacatctctgtgtccattgaagttactttttttttttttttttttttttgagacagggtctttctctgttgcccaggctggagtgcaatggtgtaatcataccgcgctgtagccttaaactcctggctcaagtatcctcccactataccctccgagtagctggcactacaggtgcacaccaccatgccaggctaatttttgtggagacagggtcttgctgtgttgcccaggctagtttcaaactcctgggcccaaacagttctcttgccttggcctcccaaagtgctgggattccaggcatgagccactgtgcccagcctgaagttactcctgtaggataaattactaaagttgagtaactcagtataatgtatttcttaaagacttttgatgcatgtcaccaaattgcctttcagaaatgctgtgccatattatagtctcataaatgctggattgtgtctattttaaaaccttaaactttacaaaaatgagaactcccctgctttttcttttttgatgcaaatgggattggtctctgaattttacagcttttttcactcagtctagcatatcttaaatcagtaagtttacatttaccatgtcatttttagtgactcttcagggttccattatgttaatatgcaatagtacacttggcttatccgttcctattagatatataagctatttccagtttttcattgttataaacagtactttgatacgtgttgttgcccgtgtctcttataatttccttctggtaaattcttagaaggagagttgctgtgttaacagagtctgcacattttaaaggtttttttaaaatgtgaccttcgccaatctgatagaagcataatcacatttaattgttttagtttatattcatttgatttactagtgagatttactggctatttttattaatttggctaggtggataattacatcctatgctcattcttctgcagcaagagtttgtaaaggttttaccatattctatcagatccatatatctgacttatttctgtgtgtcttgtggtgtcttagtcagttagggcttcatagaatattctatattatatatagtatatattatataactccattatagaagcatataacagaattatattctgggtggcttaaagagaagacattcatttctcacagttctggagtccgagaagcccaagatccagatgccagtagataggtgtcaggtgagggcattctccctagcttatggaaggcttttatatccttaaatggtggcgagagagaactctagtctcttttttttcttgtaaggacactaatcccatgatggctccactctcaagacctcaactaaacctaattacctctcaaaggccccaattcctaatactactaccctgttgtggattagggtttcaatatacatttttggggaatacagacatgtagtccataaaatgagattctgaaagacttcagttattttaatgtaatggtatacacgtgcttttgctctgatgtaatctttttttatgcctgtacttttgtgataatccttttgagttgaaatgagtagattgttcagcctcagtattactagtattcatgagcatttgtttagttctttgaccttttacttgagagagagttcttgaccattattttttcatgataggtttttagtatataatctctataatctctattcacacattctttggattcattatttctatctccttagagttctttctttgtcatttttattctaaaactaacagtttacatttttgtattttcttttcacttttttaatgtaattttttgagagtcacttggaatttgaatttgaatttgatgatgaatctagtgcaatttctgagctccacccagtttttgcctgtgatgtttacactgccactagcatccttgttaattatgaacaaatattcattctgtgatgttttatgtagagttatttttcaactctgtaattgtaaaatatgttgggtaatttattggtactaaagggagggtaatcatgacacatctatgaagagggtttcttttttgtattatgtgtgtgcatatggttttctatttttattttttcaatacccaagattaaaaactggccatgagtagtcttgggcaggagtcttccaggcatgaataagtgggagttgtctgtatgttaaatctgtatagaattggccgggcgaggtggctcacgcctgtaatcccagcactttgggaggccgaggtgggcagatcacaaggtcaggagatccagaccatcctggctaacacggtgaaaccctgtctctactaaaaatacaaaaaaattagccatgcgtggtggcgggcgcctgtagtcccagctactcaggtggctgaggcaggagaatggcgtgaacctgggaggcagagcttgcagtgagcggagatagtgccactgcactccagcctgggtgacagagtgagactccgtctcaaaaaaacaaacaaacaaacaaaaaatctgtatagaattagcaagtgaccctttgtctttcatcgaaagctcttgacctgcaacagtgcggcctcaccaatgaaggagcaaaggctttgctagaggcccttgaaaccaatacaactctggtcgttctggatataagaaaaaatccactcattggtatgtcgctacaatattttttattgactaacaaatagcaaaagaaaaagaatttctcatgtattgacagttttgaaaacttaatgtgtttccttccctaatcttacacttttgtaatcttgcactttcttatgtttttagtagataatttactgatgaaaagagttgtacttaaattgctcttggctgctactctgaataggagtgaacctagataataaatctgcttccaccaagtgcattattttcttcttgtggaacttctgaattcttggaaatagtatttcattcatttgttgatttgacaagtaatttttgaatacttctatctgctagatactggtttaagcactaaacatacagcagtaaaccagctagacaaattcttggtctcatagagcttacattctagttggggagttatacgtaatgtaatttagatagtaggaagtgcaaaaataccgtaaggtaagaagacagatgggggcaggtgggactatattagataggttttttaggggacagcttcactgaaaaagggacatttgaacagagacctgattaggaggggaacaagccgtggaagatgcagataaagtaccttccaggatgaggaagcaatgaatatgtagttacataggtggcagggtggatggagtatttaaggaaaagcaagaaggccaatatggttggggcactgagtgatgaagagactggtatgctacaaagtcagacaactagccaggggcctgatcttgtaaggtttgaaggtcacggtaaggacttagataattctaaatgagctgaaaaccatgggaggattttgagctggtaagggttatattccaagtagtaattcaatcagatgacttggtgtggagaatacacttgtagggggctataaaagggaaagagggaggccagttaggagactcacactggttcaagttagagatggctatggcttcacttagggtggaaggttggaggtggtaaaaagtggttgaaacaaggtgtagctaacaagacttgtggggtataaaggaaatagtaatttttttaaaaagtcctaggtgattttgcatacaactgggtggtactgtttatagagaaaaggaggctgtggagaagagcagctttgggggcgcatcatgactttgatttgggtatattaggtgccttttaagcatctaagtatctggacagtgtttaggcttttgatttcctatttagaggtatctaaagctactttagttccaaagtgtttacatttgatctttgctgctgccaaaatagtagccatcagggacaatatgtgtgtaggaatactttgtttttgaggaagaagttagaatactcaaagggggaaaaggtatttaattacattatgtggaattcatattcaatttcatgggaaaaagcaataattggttggcttttgtttttaaatgggaatagccactcattgggaaataattactataatttcaatttttattttactttagatcattctatgatgaaagcagttatcaaaaaagtcctccagaatggaaggagtgccaaatcagaggtatatcatgttttatttctccagaaagaattcttatttaattgcttttcttctgggatctcactgtactgcccagcctggcctcaaacttctgagctccagtgatcttcccccttcccagcttcctaggtagctaggactgtaggtatatatcgttgtgcccagcttttcgtctgtttttaataaaatgaaactattaaggcacttttctgccatcttaaatttacagtcaaatcaaatgtcttttctgtttttgtaaataccgtatgattctttaattttgggtcccagaactgctgattgcaaaccttttattaacatagagtatcttaacaatttccatttaagatgtagccctcataaatgatctgtaactgaaatatagtgtttattctgtctcttttagtaccagtggataacttctccatcagtgaaggaaccatccaaaactgctaaacagaaaaggagaactataattctaggaagtggtcacaaaggaaaagctactattagaattggtaaccttttctgtcttggctttttaatgctactagtgttctagtgtgttaaaattaaaatctcttctcattgtatgatattgacagtaacaaccaatattgactccgtgcatattatgaggtctgtaattgttctgataagattatgagaatttatggaatgtagaaatagtaaatgaatcattaggaaagggatgctagtgcttccatttaaaaaattacccttatttgtttttcatacaatattcatcattttggatatgttttctgattcatgattacttttgatactttgcaattgaaatttgggatgcactttgatgacagttttagcagtgcttttgtatgattttgttgttaatgaagaattatcctttcatacgatagaaaacaaaatttcttcccagttccattttttttcccttgtttcctcctccttccttgcaaattcttacccaaagttgttgaattaggtagcaccttgcttctttcaatgatgaaataaccttaaaatatatgtaatccttataaaacaatactgcaggtaagtttattacccagagatggaacattttagacaaacattccctaaatgtttgctatttatggtttatttaatctgccaaataatagtctagaattttgaaattgtctataattttgtgaccaagaataatgaaaaaagactttataaactgtttatcagctaatggcataaattttacattctcctgaatacataaatttggtataatctagttctactgatattttctttttttttttaaagagtctttaacttttgtagaacacattatctttagtcataagtagcctttttttactgataagaatgagtgacagtggaataagttaagccaaatctaatgtgaaagtgaccttttcttgtaagtaactttgaattttgaaacagtaaaaccatgaagactactacagagaaaaaaattaatgtttttatgtttataatctgccagtttcccagaaaaaggtttgtggtgactttagttcataccctgtacattaagatcaccaaacaattaacaccagataatcttttatttggatgctactttaaatttttgaaggatatcacttgacttaatatcactgaactgtacacttaaaaatggctaagatataaaacaatttaacataaaatataaaacattagaaattctataattttagtagctagtggtatataattggacatcattgaatgagaataaaaaacaaaaatcttttttcttagcatgattaaagaaattggaaatgtgactgaagtttacaagctcactgagctattttaagagtaactttatttcttgggctttttttgtatttgcctcagtaatttggagacacagaggtaagccaaatcagtgtctggctttatatttaatagttaggtgtcagtgagtataggggttatataatttatgtaaattatgtcacattcatattgcaattacgtgtgcagacagaagataggaaactttataatttttttcatctaacaagataagtaaattagtttggttttaattaaaatttatatttgcggccgggcacggtggctcacgcctgtaatcccagcactttgggaggccgaggcgggtggattgcctgagctcaggagttggagaccagcctgggcaacacagtaaaaccctgtctctactaaaatacaaaaaattagccgggcgtggcggcgtgcacctgtaatccaagctcctcgaaaggctaaggcagaagaattgcttggacctgggaggcggaggttgcagtgagctaagattgtgccactgcactccagcctgggcgacagagcgagactcttgtctccaaagaaaaaaaaaatttatatttgcattactttctacacatactacaaacaatacacagtaacttttttttaggataattaaaaacagcacacaatgaactgagctcctatatatttataagacgtgtataaatttgtccagagaaattgcacagcacaatgtggtaattatcaataagttacaccacgggaaatatttgtcctgtattaccaaatacatgttcttgtagatgctgtcctaaagctgctaaagtagatcttacgtagtaaaatagattggaaggataaatataaccgttttaataaagttatattatttgttctcagtgatatcagaaacaattatatatttaagtgtgaattttattaatattaataggtaggtctagcttttactaccaaatatttctttaaaaaaacttgactctttaaactgaaatgtaggataagactttatacttcgttctattatccagtaggtttcatttgttttctttgtgttctgtaaaagcaaatgaacactgaaggtggacagacttataggcggcaacattggctcacctactacccagctaccttcagtcttacaacttggatagtttttacatgataaaattaatccagctacctttagtcttacaacttgaataccttttacatgataaaattaatctcaaattgaaatttttttccaattcagaaggttctgtttggtaggagtcatgggtgtatctatgttctgtccttgagattcaggaatgccaaaaatattctgagatttaataacttaaaatttctgcataatgcataatgaaatgtatcacgtataatctttcattctttgggttacatgttttatttacctttgcgtgctctgcatgtctcatatattcaacttatattttagttaaagtgataacttgttactctagacaacttatatttttatatatttattacttatatttaagtatattaaaaatatatttattcttatatttattactggcctgtgtaaaaaggtatttacaaattgatcctgatttaatggacttggtgtcattgtcaggtgcccatttgtattcttttaagagtatgcacatgtgcctattcatctgtagacctttagtgcatcttgattctttctttttaacacttctcaagtaggattggctacaaagaaacctgtaagtagtggcagaaaacactcccttggtaaagaatattatgcgcccgcacctcttccacctggtgtgtctggtttcttgccgtggcgtactgcagaacgtgcaaaaagacacaggtagggtatttttatttcctatcttttaggataaaaatgggattcaaaattctttattttggagcttctattatgtgagagttctctgcttatgtctgtagggtaaaaatgactcatgtggcttctgcctcatgaatcctttaaggaagaaaaacaaaaaataatcctaagtagggtttcaagttattaagtgtcacagcaagctgtatccctgtgggagtccagaggaaactgaaattatctccaattgtgcaggtgagaaaaggtttcatttaaagtatgtgcagttaaaccaagtcctatagggcagaaataggaatttggatatttaagactggggaaagggcattgtaaagcataggaaattgttcaatgcaaaatgataggaagtgttgattagacttaatctaactcagccaactggcctaactcattttagtgaatcaaaccagatataactagttttagccagttacctaggtgatagctattcatagtaatttttgtcagaaaagtcttttaaaaatgttgtactataattttatgcttaataaatgaattagattactataaattattttcgaatgactgacttttagtattcaagaaattggagattaacaattgcttaagaaaacaaagaggattgaatttaaataggactggaaataggtgctatgtaaaatatctgttcaattgctcagattaaattgaatatgtataatctttgttaggcaactgatgactatacttatttcacaactggtaatgtgaattattattgcataaactatagtgctgaggccccagtctttacacttccatttaataacttcacagtttcatatcttcttgagatacttactaatttcaagtcccatcttggtcacaaggagttgtgaattagagaacaattaatatcaccagttaaagaagttagattagaaatctgaaccatcctaaacataagaagtacctgcatcttcagagtcttatcccaaagccgttctgctaaattgttcaattttctccatagcagagctttccaggcccttatttggaagtgatttatctctatgcacagttatgtatggatagtatacataatactagcaagtgttattacctagtgttaactggtggtgtatttacatcaaaatataacttaatttatcgatatctttttaggggtttcccattaatcaaaacacgtgatatatgtaatcagttgcaggtacgtagttaccatgtttataatatgtaggggattggaatgggaagggtggaagatcattctctgtgctctttaaattgaatagagtcgtaagaaacatttccctccctgaagtaaattctttaaaaattttctgggttctcccggtgccacagtataggcgtgtggatatgtcacacaatggaggccttgtggtttcatctgtgtagacaggaagtcatttctctgggtccacaaatcagctgttgcctccagcaaaacaaatttgaccaccatttctcacccgacacatggagctatcatagtcaagaatgtccttaagtttaaaagaaatgttcttgggggatacatattttatatgtatatatatatttccagattctaaagctaaaacaaagcaaccagtcctaaagcctctgctttctcagagcttttctttctcccttgtcaggatcaaacacattccctgtcattctgcatcatggtattagagcaagtgaattctgtcagagtatcagattttccttttcagttgtttttagagaccgtaatttctctgtaaaagatagcactactgagatgaaggagcacctgtgtgtccgtactgcccctcgcatagccaaaagtaggggcgtgcatctcattctaccgtctaggattttcaggtactgcaggatttatgcttgtagttgatactgcattctcatgacttctcttctgtacagttatgtatcccggcacttttctttttgatctgtggactttttatgggattgtgacacagtcaattttgaaatatttggaaacgtattggacaacattccagtggcattgaaacttgacaggagaattgcgttgttattacagtagttttggcttaagaatgaggaaaagatgaggtttttgatgtctcagttttagttgtgtgcatgtatttggttaattttttttttaattctagtttttattttgtagagacagggtcttgctatgttgctcaggctggtctcgaacttctgaccttaagcagtactcctgccttggcctcccatagtgctgggattacaggccattctagtgtttattattcacaatttaaattattcttccaattctttgtgaggcctccacggatgaattttttctcctaaaaatcgtcctgtctttaagactctgtgtgtgatggtagagaataaatttctcatctgcagttgatctgagaaaaaatgtttatcctgcctccttgcttggtttatgtgaaaaaagtgtaataaaataatatgggttattttcggaaagattttatgtaaaaaagaaaaaaaaaatatgggcgattccagtattaattataaaccttatatgagagaattatttcagtgacatagcaagaataagttagtgtctttttactttgttattgattgtgttagactaaggagtagtgatagacatttatagagaatgacttaacacttcagaaagatcactttgattagatgtcctttagtatttggtattcggtttatattattatacaatcttgtcctctttttttaagcaaccaggttttcctgtgactgtgacagtagagagtccttcatcctctgaagttgaagaggttgatgattcttcagagagtgttcatgaagtgcctgagaaaactagtatagaacaagaagcattacaggtacaaagctatcactttaaagatatggagaagatcatttcaaactctagttagtttttggtgaaagcttgattatgaactggacagcttgcatgggaattctgttttcgccttccttctatctcatatcccttgaatggttctttatcttagaacaaggtaaaagggaggacgtctgcactctaagaaataaaaattgaaacatgtcatcagtaatatattttcctttccttagaatcatagaatattaattagatttagggaaggccttaataatcataagataaactcaaagaaattaagcactgaatgaatgtaaccagctgattcagggctctttgggaggccttatctttttgtgtgtgctaggaagtccacaattaatttttaaaaattaatacaattttcttttatatgaaacttacaaatatagaagtaattatcctttttttatatacttacatgtagcttataaacaacaggaatgtatgtctcacagttctggaggcaggagagtccaagatcaaggctcaggcagatttggtgtctggcgagggcctgctttctggttcatagatggcttttcaccatgtcctcacatggtggaagggcagttatcttatttttatgtgactatggaaatcactttttgattttcaaaaaatgaagcctgattttcattttttaaattaaaattagtgatatttatatagagaaattttaagataattacaaaaatgatagaatattagagggaaaaatctatagataatgtagaattgtccctattataaatgagcaccttttgtttgtagcacctaagtggtttattactaagttccagaggaaaaacaaaatcctagaatgtctgattcatgttcattattgttttaaatgtgttgtatttattttcttcaccaggggattaggaaattttattctaaaagtgattatagccattggggagaccaagaaggttaggaaatacaacttgggaatttctgattcaagatgcactgagaattctcttagctcttttctattttaagaactccataaaacgatattatcaaaatttctaacatacgtaagcctacaataatcaagataattgaagagatttcaacatatttttgaaatagagatgacagatggaaatgagtatgaaaccgatgcagtagaacagaggaaaaccatcgcctagaatatacacaggggaagcctacagctcagagggtatctaatctaactccagaaacagctccatacacagatatgcatataggaaaaaggaagggagctagaaatgtgactaacatggagggagctccttgacagtttgtatatggaagagttgactcctagccttaccttcactctcctgaaatgagatcatttggctttgaaaaacagtaaagtaactggggagaactagggtagatagtgtggattttgcaccctagaaaagggtagctgagaatatcctgccatactggctacccacttcttcatgcataacagaagctagtcatcagctcccagtgatcctctgctcccttattttttttttttttttttttttttttgagatggagtctcgctctgtcgcccaggctggaatgcagtggcgggatctcggctcactgcaagctccgccttccgggttcacgccattctcctgcctcagcctcccaagtagccttattcttaaatagaaaataaccatggttcacctgagagttgagtaaaactcacaacttgacagggaaaataaaagatgaaaaatatgtcctgataggaccagagctgattaaaagaacaaaaatactttaagaaaaaaactctacttaacatccttaggtttgttaagcacaagtacaaaagaaagatacagtgcctgtaaaaaagaaatagggtgttgtttaaaaaggaatagcagaaagcaagggtggtctcttggaaattataatggttgaaataaattcagtaggaattaaggaaatttctcagtagatagaacagaaaggcaggaatggaaaatacaacagaaatcatatgctagtgaggttgcatctaggaggtctaacatgttactgtaagaaatctcagaggacagaaaaaaatggatggaaggaaattacaaaaaaaaaaactataagaaagtttaccttagatagacacatgtaagtagacagtcttcactgtaaaatttcaagatactgaggaaagaaagaaatcccaagagaaaaataccggtcacttaaaaaccataaaaaccagactttattatacttctcatcagctaccatggatcctggaattagaaagatacctccaaagttttaaaataattgacaacctggagattcccatccagccaaactgtcaatctaagtgggggctgaataggacattttggacctcctgcgctatactttttcttgttatttgaaaacatagtcccgcaaaatgagggtataaaccaagaaggaagataataggatatcagggatcagtggtttcagtgtggagagcagcgggtctggatttgagaggcttccattggttgtgtgactgagagcttaaaaaatccttgaagcatgttactatgtattaggcactgttagaatgagggagggggaaagagagaggagaaaagagggaaggagggaatcaaactccagaggagaaagttctgttggcatgaacataaaacaaattaaactatggcagatttttgagctaccactgatgtacaaaagggaaaaaaatccacttgagcttgtccgcccttttcagtggcacagcagtcggtgaccacctatctaatttgttgtacaaaccagaacacttttcaatagtgtaagcaggtgctgttaacactaacatcaagacaagggttgtaaactggaacagtccagggcaacttaagataggcggtcactctatacaagggctgtggcactgaaactgtatagaaggcggtgtaacctgtatatacacaagagttacaatataactctgcagtaggcagtattaatttaatcgtagtaatggaaatactgccgtggtctgtagctttgattatcaatttgcatgtgatagcaaaaataactagcttgtatcagatttagcacgtattggacactgttctaagtgttttgcttatattaattcatttgatcctcagaataacctgtggtaggtgttactattagtcctacttttcagaaaagaagctaaatttaagtaagcccaagctgtacttaaatttagagttggatcagggatttgagcttaagctttctgcctgttctcttaaacactgatctatctgtctctcaaaaaacaaacagctctgcatatagaacagaatataaatattaactttaacagtgtaaaagctaagtttggaaggtggacacaggtggaaagaagggacaaaagtatacatgtccctattttacaaagcagggcattgagagaatttagagttgataaacaatttaaatttttaagtaatgtatatcactagaagttgaagagatcatgaccaatggaaaaactaatggtgataacaactttattgagaggagtggctataagtaagtaaataagtaagaatgaaccaaactcttacttagtaaagcaggaagttagtaaataatgtctaaaatccggtcatgtagttacctaatacgttatttagaactagagaaggattaaaaagaagaatggttgacttaaacctcacacacaaaaaaatccaagtagcccataagtatggaaaagtgttcagccatataggtaatcagagaaaaatgaactgaaatcagtatgagatgcaactacactcctatcagattggcaaaaaataaaattttatagtggcaggtattgtagatctggagtgtaataagaatcttccaccctgcttacaccggaagtataagtgagcacacctactttggaaagcgtttagcattgtctatcaatggaaagtatataaatacgttgggacccaacaagtcatctgagggtatatgcaccagaaaaacaggtgcaaaagggtccacgtgcattatttgtaatagtccaacctgaaaacaacccgatgtccattaagaattaaaaattagattgcatttgtacactgagaaaactataaaagtaataaaattgaatgaacaagagctacaggcaacaacagatgaattgtaagaacaatgttgaaagaaagaagatgcagaagtgtgcattcactatgattccctttgcataaagttagaagtaggcaaaactagattgttagggatgcatgcatataaaggaaatgatcattaggaaaatgaggacggtgtttaattctgggagaaggagaggggcttgtgatgagtagaagatatgggggatttcagagatgctagctagttgtacttgcaaacttgggtatatggttacatgagtattccctgatagtgtgttttatgcacttttcagtatgtatagcatattttgtgatttaaaaaacctgcttaaagaaatggttgcctctgggaagctggatgtgtgagtgaggaggagattaactttcattttaagctcttctctactaattctgttcgtatgtttattcattttgcgttgatcatattttgtacaccaggcactcttctcagttttatatgtgtgttaatttactcctttcaagagccctatgatacatgaatttatctccattttatagatgaggaaattaagacctagagttactgaacttgcccaaggttatacagctgatgggtagggccagaactttgcctcagagaatctgaatttccaaaaaataacctaaaagagaaatttaagtactaattagtaagcaaagaaatgcacatttaaggaagacagtgcacatttaaggaagacagtaaccttttatctattagagaaaaacacacattctgtctttaacacacacataaatcttatattggcagggattttctttattcagcaattatttattggttgtctgctttgtggtacacataaatgctggggataaacacttaataaaatatacttccttctcttgaatatcttgcactttaagtgggaaggtaagtcaacagagtagaggtgatatatccaagtgatagactgtttcattgccagtagcagtataaaatcttagaaatcttttggaaagcaatttggatgtaagtattgcagagccttaaaaatgtttatttgctttgacctaaaattccttttttatttattgcaagaaaattattctaaatatgggagaacaaaaccttcatgcttaaaagtggttattttatcttataatgttgaaagttggaaacagtcttgttagccataaaggaatgattacatgaaccagtaagctggctcagtagaatattttatttagcccactaaaaaagtcaaagttggccaggtgcggtggctcacgcctgtaatcccagcactttgggaggccaaggcaggtggatcatgagttcaggagatcgagaccatcctggctaacatggtgaaaccctgtctctactaaaaatacaaaaaattagctgtgcgtggtggcggacacctgtagtcccagctactcaggaggctgaagcaggagaatggtgtgaacctgggaggtggagcttgcagtgagccgagatcaggccactgtactccagcctaggcgacagagcgagactccatctcaaaaaaaaaaaaaaaaaaagtcagagttatgagttctctgattcagtgttaaatggaagaatgtctaacataaaattggatatacagtcttccctcagcatactcgggttattccatgaccccatcctccagcatatacccaaatccatgcaggcatgctcaggccccacagttgacctgtggaaccagggtatataaaaagtcagtcctccttatgaacttttgcgttggagaatacttgtttttgtttgtttgtttgttttgagatggagtctcgctctgttgccaggctggagtgcagtggcgcaatctcagctcactgcaacctctgcctcccgggttcaagtgattctcctgcctccgcctcccgagtagctgggattacaggtgcgcaccaccacacccagctaatttttatatttttagtagagacggggtttcaccatgttggcctcaatttcctgaccttgtgatctgcctgcctcggcctcccaaagtgctgggattacaggcatgagccaccgtgctcagccagaatactgtatttttgatctgcatttggttgaaaaaaatctgcatataatgggcctgcatacttcaagcccttgatattcaagggttgttgtacaggataacatttgatatttctggggttgtgttccagaaaaaatataaacttttccatgggtagaagggagaaaggggagcagctgtcagggaggaaaattactacaacactttatcattagtcgtttttaagtagtggaatgttaagtgattttactttctaattgtttcatttcatatttccttattttctttaaggagcatgaattactctttaaaggagtaatgaggagggaactttcataaatatgtaacattatgttctcacttcctccactagagggagaaacaatttcatgtaattgtgctttgatgtgatttttagaactagttaggaatggaggattttattcttctttctccaattgtgataagttttttgcttatttccatgtttggttagaagttctttgataacagttctaaatattaaaaccattatataaataataagtagaggaattttgcaatttctttttcctttttcccataaaaacttggttggctttaactgataatgaaacattaaagaatttgtagttattagggcatttactgatttttcaaatgtgttctgagtataaaaatatatgccctttgagaaaatttttgaaaatcgtgaaaaacattgagggaaataaaaaccacctctgcatggtacacacacctggatattttgtaatttgcccttttatcttaaaaagatatcaaaatattttgtcacatcattgaatgctcttccacatcagagaatcttacttagcttatggaccatctcccaagaaaaacgaccattcattaactctggttaagacccatatcattgtttttagtggctccatagagcatttcatcatagggatgtgctatttttttttttttttttaccaatcacaatttggaggcttttagttgtaaacagtcctgtgacattatgttggtagataaatctttgtccacatgtttggtgatttccttaaggtaaattcccagacattgaattggtagtatttactaaagattactccagaaagtggcaccaatttccttttctaatgtaagtgtatggtagagttccttccctcaacactctggaggaattggagaatctccatcatgtctaattccttttgtatttcaatctttaccagaaagagccctgtcccttttaattggttacttgacttttaatttgctgttacataattcaggtgtgttaagtgtgttaatagggcttcctattataagggatccacaaataagaatagaatttctttttcatagccttaatttttatttgactcaataaatatatgtgtatgccttctatggtgagctgtcataaatttattttggaaagagtggaaataaatctgtaatgtgcgaatctgatgtttttggtaattaatttccctagcatggtatgatattatacaagcagtaggctataatcctgatatctgagttcacttctggctctgtccctaaacacttggtgagctcaacagctggaagagttttggggatcatattgggaattaattataatatttactttattacttaatactaggaaaaactggaggagtgcctaaagcagttaaaggaagaaagagtgataaggcttaaggttgataaacgagtcagtgaggtaaataaaagttttcttaccttttgagagttttttgttttggttttggtttaactttaagtcatacatacacacactttataaactttaaaatgagaaaatatagtgtattgcaaatggtcacagtatgttaatgtttgtatttacttatatttggtgaccgtgtgatctgtattccaaaaagcatgttttttaaaaatgtaaaaattgtagtttgttttcttttcctctgtttttatatgactggagcttattttctgttcatgatgcatcaattcaagaatgcatttattaggcttatactgtatatacaattgcgtaaaagatggggatgagactatctactgaaggggaattaggaaaatgaataaataaggtaaaagataatggaaaaccggtaagaatgcaatgaaagataaaaatctataccatgaggactaaattaggtgaatgtgcataagagcagggcataaactagaaagttctacataactataatttattattacaaagcaagtttaaggaggaatttttgaaagtatatgcattggtttgaaagacagttaatcattcaataaaggttgagcacctgattgtataaggcaaaaggtgctttgtgaacacagtggcctttctgagaaatactagagttagacttatgtgtagtattagataaatagatttggtgtacaggagagtacatattttcaagaagcaaaggggcaatattggtaattgtacagttagtaaattgggtatgatttaggacttttaaatttatatattaagtattttactggcaaaaattagtccttaacagccaaattgtaaaatgcttactctttatttcattgtctaatttaagggaaaccttaaacagctaatttttaaatatagaatgatccaggtatgtatttaagctgttagaaatgtgatctttttgaaagataattaatgaaatactatttatattatttatgtaggaggttttgtcagttatctccaggttttgattgttatttaatatggtctgtctttactggtagagagttagattaactgcaaattaattacatttttaaaatgttttattttagtttcataaaaactattttggtgataatgagagaaaatcatgtcacacattttcaatcttcttttatagctggaacatgaaaatgcccagttaagaaatataaatttctctttgtctgaagcccttcatgcacagtcattgacaaatatgatcctggatgatgaaggtgttttgggcagcattgagaattcttttcagaagtttcatgctttcttggatctccttaaagatgctgggttagttactttctccctatgacattcgtccctccatgactttaatggtgttttgctgaggaacttgagcaatttttatagctttctgaagtcatatttactgtgtaattataagtaatacacttgattttttaaatgtggaattaattttaaaagaaatgcaaaatgacaaacctgccttggttgagggcccaatatgaaagagtaaacttatctggcttggtggtttgcacctgtaatcccagctacttgggaggctgaggcaggaggatcacttgagcccagaaattcaaggttagcctgagcaacatagcaagagcccatctcttaaaaaaaaaaaaaaaaaaaagagtaacttgtagatagagtaattggtagctgtgattcttgttaaagaccaaattgaaggtagttttaattgaaagtattcaggaatgtataggaatttttcttttattcactttgcttgttaaataagtttgaattaaaattaagtttgagatattaaaattgttattaatctgcagggtagatatagatatagatatggatcagtggtcctcaaccaagaatgattttgctgaacgaatatactgaaagaaagagttggagatagataattgatagagttatgttttgtaggtgaacggtttggtgaggaaaggaacaaacatattcttgaggactggaggaaaggtggtatagatgtgtggggatgaaggtgagaggcagtaggtgtgtggtagaaattgcagcttctactgagacagtatataaaatacggaataagtaaggaaatgaagtcaagaggtatctaatacattgttgggggaagagacagtgcttaaaggattggatgatatgatatggtttgtctcagagaataaatgtgggaaggtctgagaaattgggagggatgggggtgtagtctggagtaggataatgggttttaagattttagaagtatttaatgattgtaggtttggggaaatgtaagctgttcttatgtgcttctagtaatccttgccttttcctccttttcttctctcgaccaggcttgggcagcttgccacaatggctgggatagatcagtcagattttcaattactaggtcatccccagatgacttctactgttagtaatccacctaaagaagaaaagaaggcgcttgaagatgaaaaaccagaaccgaagcagaatgccctagggcaaatgcaaaatatccaggtaaatgaatagaacagaacttagtgattctacaagtgattagcaaaaaagggaattactaagtcagagagaaaagaataatgatctgtgcacatgctcagggaccagaagcatctttggggtcctttccaagactgagattagtaagtttgtgcccatttccttatattgtattgttgtaaataaaaaataagaaagttcttttgaaactttatgatttaaagtagactatcctcagtgaagaaatgaaagattagagaaatgattttcaattttcaattttataaatgtctattctattcatattccatctaggtttctatttgtatgcagtcagcttacaatgaaggaacactaatgaaggtacaagtactgatatagataatttttcagaataagtaattcatatataacaggcagtatattataggcatcatctagttatgggaatgggaggggcaaacctgtctgccacaggagtcccctgctgcttttcctctggccttacttggagcccccatctgccatctcagccagtctcagactggtcttggcaactgacgacttgaaaactcagtctacttataaattggatactgcttacatgtgcatagaggataggaaagatactaattttcttatagaataaggttcttttttttttaatgagggagacataaattagtaataattacagaaaacacagaagtctgaaaatgtgctggacctactcctggctatagctaagttaagttggcaatcacttggcaagatataattagggcaaaaatgacctggaaatcttctaagatcacagaataacattgacgttttgaactcgatttttaaatggatggctttgtttgtcactaaatttttgttttgtttttccttctagtttcagaaaattacaggtgatgctagaattcctttgcctctcgactcctttcctgtcccagtttctactccagagggcttaggaacttccagcaacaacctaggagtcccagctactgagcagcggcaggagtcttttgaaggattcattgctagaatgtgttctccttcaccagatgcgacttctggaactggaagtcaaagaaaagaagaggagttgtccagaaatagcagatcttcttcagagaaaaagaccaaaacaggtgaatataccaaaaaacactctgataagcaacaccctggaaaggacctgcattcctgatctgactgtcctgaaaaccagaaaagcaaagaaactagggaaactagttctttggttaatgaaccaattaaaagtaggtctttgaaaaaatacgtttctgtcaagaaagaaaatagaatagtgactgtttcatccaagacaaataaaagtaaatccagtccactagaacattctgaaagtgatactcttggatgtgattttgaatttcaagaaagcatccattctctatcacacctttcatatgactaaatcttttgaaactatgtttttacctttaaattttaataaattttcttatgtttttattatggcatatggtgtcttaaaatataggattggaagccactaaaggaagatttctctatactttttattatagtgaaatttttggtctgtttttccctttgatagtttacaacattgattcagcaattgtttactgaggggctagtatgtataatatcattctgggtgctatggctttcagcagtgaacaaaacaaagcctttaatctcaaggaactaacattctgtggagggagaaaacagaacaacaaagcagagtacgatgaatagaaagggatgggagtgaataaatggaataattttaccatttggttaaatttggaaataaatatatatcacatggccagaagccattgacatattctaatatataaccagagcagcaaacatgtctagatgcttaagcatgttcatggattatagcaaccctataagatagggaactattaatattattatgtccattttatagatgaggtgtctaaggagacagattatgtgaattgcccaaagttgcacggctgtaaataggtggtagggctgggatctcaaccagaacccatactttaatgagctatcctgtttcactgttaagagaggaaccacttaaggaagattctgagaaaaaagccaatgaacactataagtagaaaagagtggggctatcagaaagcacacctgggttgaatttttcaaaggcagagttagtaagagtatggatataaatctttggagtaaatacccctccctggtaaaatatgcatagataagtcctttcctacaaccagactatgacttgagagatgagatgagagaaaagctggagcgtcagatttcttctggatggtcttgcctgattgttatcaaaagggctactacaatactactgagttcattaatcatggattgacttatgggaatgaaacaatgaacaagatgtaatcttggctttttaacagttgagtgaaggggagatacacaagcagatgtcgtaataccgtatattacattctatggtggaaatgctgagggagtttagtcagtgtggggaaaaaggaggagagcagtggggccaagaaaggccaactaaagagaccaaaggtcatgttaatttctaagctaagtcttaaaagtaatgagttacaggctggtgaataagaaggtgaaggggaaggatactcagggcagagggaatagcatgagcagaagtacagagccgtgagtgtgagtatgtgcgtttgaggaaccacaaacacaagtagttgagagttaccgaaatgtcatcaggcactagcagatgtcgctcaaggaggcagctaggggaacaagatcgagtcttataatccacgttgcatggagctggttctttttcttcagtaaataatgagctagtaaagaatggaagttatatgctcaggcttgcattttagatcattagctttaggctgatacattaaagaagtgtggagatcagttttccacacttttctgaagagcatttgtctttgatttttaaatgggacttatcctcccaattcctctcctactgaaataatttttagacaaacataaaggagaccctcgcataaatagaattaagcaggtttcttttcttttttttttttttttttttgagatggagtcttgctctgtcgcccaggctggagtgcagtggtgcgatctcggctcactgcaagctccgcctcagcctccccagtagctgggactagaggtgcccgccaccatgccctgctaattttttgtatttttcgtagagacggggtttcaccgtgttagccaggatgatcttgatctcctgacctcgtgatccacccaccttggcctcccaaagtgctgggattacaggcgtgagctaccatgcctggccgcaggtttctttacagtagtacttctcaagggtgctagaggctaatgttcattctgagtcttcaagacaggcatatggtatgcagcccttctcaaatatacttgtttatagaatccttttttaataggagtgcctaacaactggtgccacgaaatgccaatttagtaacttacgacttagcaagaagagaaagggatctaaaataaggtatagatgaagggagggagtaagttttaatcttattttggcaattaaataagatttggttatgggaagtaaggaaaaaagaggcagtgggtggacttgtgtttctgtgactaaggttgggtggtggtatcattgaggctgagaatatgggataaagaactgctttggaaagaagagtttagtttggagcaggttgaacacatcacctgcagatttcaggaggaaatgactggtagatgattggatgtacatatgaagacatggaaataaagaatttgaaagtcatcagcacatataagcagtagttaaaatcataaagttgatgagaacacagaattgtggggactgtcaaggtttaagtgataagcaaagaaaggattctgagagagacaagtgataagagtgtcaagaaggaagaagtagaatacagtgtcacatggcagagaataagtgtccacgggattttgacagttaggtcccaggtgaccttaatgagagcaattcactgaattggttgatgaaaatgccagattgcagtaaattgaggggcaggaatgccctgagggggcaatgaaaactaggtataggactactctttgaaggagtttggatgataagaggaaatggagttagctgaagaggaattttttagactaaggacttaaatgtttgtaaggtgaaaggaaagaaccaagtaaagaaggagaggctcatttatgcagcaggatctcagacaagcagggacatgagatactttaatgttcttaagactaaaagaaacagatctgaacagatggggatgtacatatttgaattcttgatgaacttgagatgactcccatacatgtagtgcaaaatggttagataagtaacttagagaatctgggaaagaaatatggattagaaaataaaatcagggatggggtcacattgtaaaatatgtaaaagttattgtagagttgggggatcctgggaagtgtggacagagacaaaaatgggaagagttagaagttaaatgagtttatacctgataaccccagttttctttaaccatggatttttacaagacctacacacaatcacataattatagttttaaaattcttccatattttacatatattttatcaaacatttaaaaccgtaacattaagagttataaatgtggatattttgctgcttaatatatacaattttagccctgcaagtaattgttaaactttcaatatacctgaaataatatcatttaattttgaaatatggtattttcatttggtttagagaaaggtacaagtgtgttcctttactgagaaattactatgcacctttactgagtacttaccagcacatatacaatctgtatgcaaacaggacccttttcagaaaacattcagatgtgatactgtagcaaagagcttgtcatcctgtcttaaattcacacataattactagtggtcaaaaatcatcactcttgcttgcccatccagttctatatccaataatgagttcgtccaatttcaaatgggtatttacagaatctctaatctcaagacagtaacacttgattttcagaggatcggcatgataggagatgattggttttttgaaaaattctgattataaactacatgctggaacattaacatggatgactgaacacattcttttatgcttctagaatcccattgaaatgactggagaaatattaaaataaaaataatagcagagttggaaaaccagaaatttgaacagtgaaatttctggaagataagaagcagatgatttaagtaccagttaattaaaggatggaacagctaagccattccactcatctttggagcatctgattctggagtttgccaccaggctaagaaagcagctatctgaagtgggagctctgacccaagaaatgctgggatcggagaataagggaattatccaaaatggctccgaagaggaactgaagttaagctgcccacatgatctctctaactatgatgacctgccacttccgtttataatcaccatataagtgcctgtaatcatttgtgttcattaaaagtgaaccagaattcccatttggatgaaaaaataacacttccaactttaatcttaggccctcatttataaatatggacaaccaagaatcatcaaatttgaagaaaaccagtaacataaaaggaggcatgaaattaaaattaacctgttcaagaagatagttactaggagaaacatgaaatttttaaattaatgaatcaaaatcttcagcaattcataaagatactgtgttcataaagaataggatgccatgaaaaaaatatttagagtttctggaaattaaaaatttgattatgaaactgaaacactcagaagatggactacacagcagaatggattcatttgaagcttaaattcatgaaatggaaggtattaattggtcttagacgtttcatcagcaacttaattacttagaaaaaatctttctcagagtaactaagcaaaatgaacaatgaacccattaacgtgtggttttgttttttgggttttttttttttgagtcaaggtctcactcatgtcacccaggctggggtgtagtgatgggatcacagcttattgtaaccatgaaccattgggcttaaattatcttcccacctcagcctcccaagtagctgcaatgtaccaccatgccgaagttttaaaaaattattgtagagttgggttctttctttcttttctttttttctttttttcttttttttttgagacggagtctcgctctattgcccaggctggagtgcagtggtacaatctcagctcactgcaacctcctcgatctcagctcactgcaaccgtgaagtgatcttcctgcctcagcccccctagtaactgggattacaggcacacaccaccatgcctggctaatttttgtatttttagtaaagacggggtttcaccatgttggccaggctggtctcgaactcctaacctcaggtgattcacccacctcggcctcccaaagtgctgggattacaggcatgagccactgcatccggccaagatgggttctttcttaggctggtcttgaactcctggcctcaaatgatcctcccaccttggcctcccaaagtgctgagactacagacctgagccactgtgcccagccccatgaaagatgtttagatcaaataaactgataaagatattgataaagatatgagacaaactacttcagctttgtgacctgcaaatccccttttataatcaccagaggtgcctgtagtcagaaaaagtctaaataaatactaatgacatatgaaaacaaagtccaaccaaagttctaggtttgaacatgaatggaggcatggcaggacacagaaagtgaaagcttgtcctagatattgtcttattcatgggaaggatacaggtagtgtttgattctaggtattgattgaaaaaatatattaaaatatatataaagttaagggtatgttagtaaggataggttaggtgatgttgcattaacagctcccaaattttaattactttcaacaacataggtttatttgtgcccatgcagtttgcctttggcagattggctagaggcccctattcaacatcaacctcaatctggaagcgaggctggtggaacgtcactatttggaacattgctggttgcagtgtccaaggaaagacagtatgatgcagcatatattgtgacttaaagcttctgtctagatgtgacatatgtcacttctgttcacatttctttggccaaagaaagtcacatggttatgcctgagttcagcagaccagggaagtgcagaattgccatttgccatgagaagagagggaagcaaatgtatgtcaacaactttaatagctacaaaactacctggaaagagggaatggaatttttaggtccaacaagacgggaaagaaaaagaaacaagctacatagaaataaaaaatccacaatatagcaagatcaagttttttactcataataaacatgaacaggttaaattctggaatccttaggcttgagtaaaaacatgaaatcccactgtgtgctatttgcaaaatctaaaacgctgtcatagattataaagagatgaacaaaaatataccaggcagatgctaaagagtaaatgtggctgtgttagctgcagactaaatagaacccaaggtgaaaattggtaaaggggacaaaagcttcttttggctgataagtacagtgttgcagaagattttttaaaaaaatatatctgcaatttaaaaacttgatgttaggccgggcgcagcggctcacgcctgtaatcctagcactttgggaggccgaggtgggtggatcacctgaggtcagaagttcaagaccagcctggccaacatggcaaaactccgtctctactaaaaatacaaaaaaaaaaaaaaaaaattagctgggtgtcatggcgcatgcctgtaatcccagctactcgggaggctgaggcaggagaatcgcttgaacctgggaggcggagtttgcagtgagctgagatggcaccgctgcactccagcctgggccatagaggagactccgtctcaaacaaacaaaaaccttcatcttaaaattatagggtaagaatttagaaatacaaggaaaaatggccagccagttataacaagaagctttaagacatctcttttcagaatcagtggatcgactgctgcacacacactagaatggctaacattttgaaatgctgataaatatgcagagcaactggagttcctcacagctggtaggaatgcaaaatgactcagtcactcaaaacagtttggcagattctttaaatgctaacatacacataccatatgaccaagcagtcccactcctgggtatttagagagatgaaaacttagttcacacaaaacctgtgcgtggatatttatagcagctccattcatagtgaccaagatgtcttccaacaggtgaatggatagcgatgtatccatatggtggcaaacatgccacaattcggatgaatctcaacatcatatgctgagtgaaaaagccagtctcggaaggctacattctgtatgattccatttatatggcattcttgaaaagacaaaactatagtgacagaacagattggagattgccaggtgttggggttgggaggagttgattacaaagaggctgtacaagggagtttgtttgtttgtttgttttggtgatgaacagttctgtatcctgattgcggtggtggtaacgtgagtctatacatatgttaaaatttatagaactgcatactctcaaaaaaattagttttactctataataatattagagcttaaaaaattcatccctcttgcccatcagtagatcaggatatgaaggataccattgaacataaatattttgtatccatgatgaatacaaagtatattctcctggaaaaccaatagaacattcatataaatgattcctatgaaggtaaaaaacttacaaaattcaaagatcatacagatcatgtgctctgtataatgtaataatagtaacaaaaggcctgtccacttggaaatttttaaatgatcttctaaataactcatttaaaggagaaatcaaaataaattgcaaattatttagaattaataaaaacttctctaaagctgaggaattctaccaaagaggtgttagaggaaattgtatagattttgatttactttccaggaagaaagaagacaaaagagatgaattaaacatttaaagctaagaaagagataaaccaaaagaaaggtgaggaattggtaaaagcagaaatgaataaaatagcaaattttgatcagtgaaacacaggtttttaaaaatgaaagataaacctttgtaaaatatgataaagaaaaaaaagcaagaagtaattaacaaaaattgccagcattaggaataattttagaaggatacctacaactagaagagatatttttaattatgagcacttttataatttactataaataattgtgtagtgttaaaccaataaatttgaaagactagatgaaatgtgactgtttaaaaatatggattgtaaaaattgataaaaaatagaaaatgtaaataaacgaaacatcttaggagaaattgaaaaaataggacaagaacttatttttaaaaagaggccaggtgcggtggcccatgcctgtaataccagtactttgggaggccgaggtgggcggatcacctgagatgaggagttcaagaccagcctggccaacatggtgaaaccccgtctctactaaaaatacaaaaattagccgggcttggtggcgggcacttgtaatcccaactactcaggagtctgaggcatgagtgtcgcttgaacctgggaggcagaggttgcagtgagctgaggtcacaccgttgcactctagcctgggagacaagagggaaactctgtctccaaaaaaaaaaaaaaaaaaatacagttagaaaaactttaaaggggccaggtgtggtggctcatgtctgtaatcccagcactttgggacaccaaagtgggaacattgctgagaccagcagtttgagaccagcctgggcaagacctcatctctacaaaaattaaaaaacaaaacaaaacaaaaaaacccaaaacttagccaggcatggtggtgcgtgcatgtagtcccagccactcaggaggctgaagtgggaggatcgcttgaggccgggattcgaggctgcagtgagctgtgatcatgccaccactgctctctagcctgggcaagagtgagactccgactcaagaagagaaaaagaaaaaccttccaggggcacatttatttgtaaaccattccagaggatagaaaagagatgtaaggctccctaattcattccatacggttagcgtaatccttatagcaaactgcacaaataaaacacaaggaaaactaaaccaaattcaattaatgtaggtgcaaaaaatccaaaataaaactagcagtttgaattcagcattgtagcaaaagatatatcattttcaaggaagatttgtaccaaaacatgcaagattgagtgaagagtaactcactgtagctcactaaattaacagattaaagaagtatagtcatcttcacaagctgaaagagtatgtgataaattcaacatcctctggtattcttaacaatctcgaaatagaaggaaacttccttagcttagcttcttggcttcattaaatatacctaacagaaatccacaggaaacaaacttggtgaaaagtttttgctaagataaaaacggtactaaaaagtacacattttgggaaatgagacaaggctctcgttatttgtaaatatggggtctttttttttttggacaaaaaaccccctgtgatgatctactggcatgctattacagctaataaagctgaataaggaggctgtgcacaacaccaacacaccggtatgaaaagtgtgtacaccagcaataaccaattagaaaatgtatgaggaaatagactctcatccacaatagctgcgagaagtaaatattatctagaaataagattaacaagagaaatgtaaggcctatataaataaaaggataaatctatgctagagggtataaaagaaacacaaaaatagaggtatgccatgtataagacccaacataataaatagttctaccaaattaatttataaattcaaagcaatttcatataaccacagtaaagctttttaaatggatgtaataacctgattataacattaatctgaaagtcatcaggcataaagcaattttgattacatctcaaaacaatccatggagttagggtaaatgtgctgttcacacaggaataatcacaggtatagaaccgagaacctaggaacagagcaatgtatatatatatgtatttaaaaaatggcatcacaagtcagtagagaagggtttgaactattcagtaaatgatgttgaggttatttactactttttcttatttcatatcatggatgaaaaaaatcaagatgaattaaacatggaaattaaaaataactagaagaaaatactggaaaaaaattgtaataaatgtgtaagaaaggcattcccaaccaagacacaaaacccagtagccatgaaaaaaaagatagatttgactacatttttaaaaagtaaaacctttcactttttacaaaactttgataaaattagatttcataaataaaggagtgggaaaatacatgtaatagaacagaagatttaagataatataaagagcacctacaaacaacaaaaattggacaaaggctataaaaatattttataaataagaaatacagactataaacataaactttcaacctcgtaagcaatcaggaaaattaaagttaaaatgagatactatttttcaatacattgaaatggcagattattaaagattggtgatagtgctggagataatgtgaggaaaggagtattctcagtcattgtagaaattgatacagcttttggatggacagtttgacagtgtgtatcaacatgtgaaatgtctccagcctttgatctaatgactaattttaggcatccagcctgaagaaatattcacacaagtgcccaaagagtcagatacaagactgtgtgaagtgttttttgagataataaaaaactagaaacagcataaatgtacagaaatgcagaaattgttgaattagtacataccaatttctgacatataacactctgcagcagataaagacaatagctctctagtgtggacatgaaaatatttctaagacattgacaggacgaagaagttgcacagtaaccacgcactcctgtttacatttgtatagttaaaacttgtttacctatacgtagcatatatgcgtgtgtgcaccctagaaaagagtctgtgataacacatatcaagctattgacagcggttttgtctgctgaaggaggaaaaaaggggggcttctcacattttactccatttaattctaggttgtttggtttaaaaaaaaagtttttatgtacaacagacaatttttaaaattccttttcatcatagaaaatgaaaatgtgtactctgttatcctttacgctctgtccatttttttcttcaaaaatgtgtctgacctattatcaatgtgaatgaaaatgagctttgctacataacctcttttcagagctttgtattcctgaagtgttggagtcgcctacatggcatagtcaaatgtttttaacttaaccacaacccacagtaaaaatgaagctttctgcaaagttaaaagtagtagtcctggccccaccttccttgtgtgcacgtataattaatggaaaattgcatcaaacaactctgattgtacttctagtgactaattcatgttctgttctattccttgcctttaaagaaaattatgttggcaactcacgaagtatgtttcacaatccactaatgggtaatgtcctactgtttggaaacactggctagagtgtttcaaacatctgctctgtttacccctgacaaaactgctactcgtggggcaatgcaagtctttcccacatttgttttattttatggctaaaagtcatttctgcatttgcaaattacttccaaagcctaccttccttgagctctttaactctctatagtcttctggtaattttctttagatttcccttttcagaacccttttgtgacactgaaaacctgagttttcaaactgatacatctacctgagaattttcacatataatttggtcaaaaagttaaaaaataagaagactttgccctgtgactgaggtgctcagaaggtatggctggctgctcacaaaggcacatagtgagtgataggggctgaaagggctcagagaatgcccgagttctcttagtacagtttgtacattttaaaccactgtgaactgaaaaaaaaaaaaaaggcaaccttggtagtttagaaatagataaggacccacttatagattaaataataattagcttgttccagagagaccagtgaagattagttggtttatttaatgtgttagaaagatggtcctcaaagtccttgaaatgtgaaggcggcttttatctccttaagaaaacaagaaaactccacaaaatcttgaaagctagataatcctagcttaaatgataaaatttgagtagagtttgaaaacactaaaatcagtttgccaaataaccagctctaatttctttataccaaagccaaacttcacctaaatcttacctaagaattgagttccttattgtaaccagataggagacacttttgtatattattccaaatattgcaaacctacaaggagtaaaaggtgttattattttaaagaagaaggaatgaggcctgagaggtattgattcacttggttgagggcttcaagtagcacaaggcaaaagcaggatttgttgacttccaaacctgttttcttccttcaccatgtggcctttgcatctttcccacacaaatattattccacaaatatttattgtcaccaactataataaaagaacagaactatgtatca

SEQ ID NO: 597 - DNA, 15743 bp, Homo sapiens
aaagggagggctggggctgatgagctgggaggtggtgtgcgcccttctcctgcctccagctcctctctggacccctgtcctggcacctcttcggtccctggttcggtctgcccctttcccaccgcggcccgtcttaggccaggatgtgctccctgccctgcggactctggagcagggcccggccactccccggagcctgtatgacgggaaccgccccgcgccctctcccctacgcggggcaggccagccctggggcgccttaaaaaccggagctggcgcttggcatcgccactctgggcaggatccaacgtcgctccagctgctcttgacgactccacagataccccgaagccatggcaagcaagggcttgcaggacctgaagcaacaggtggaggggaccgcccaggaagccggtgaggatagcgcgcgacctagggctcaggcaggggcacctgcgtggatgcgcaggcagaagcagcgggtcggcgcggtccgcaagttcctggaccggcagcttggctcggaaggctcggtcctccactgagacgcagggggcaggcagaacgcccaccccggcgagcagacagatggtgcccgcagggaggcagcggaacagaggctccggaggagccggagctgcgctgcgggcactgcgggagcccctccaaggaggccatgctggcgctgggcggcccgcccaggccctcaggagagggtgaaggtccaggacagggatcgggcgcggcccgccaccacttaaacccgcgcgcgccaccagaggctgccccagacctcaaagggctttgtttccatcccacccccatcgccgaaaagtaatcgtcgccttacctttaagtccccacctggcaaagaaggtccttagttcctccacctccagctctctcctccgtattctggaggtgacccagctgcggtgggggcgtgggagatgtcaggagaccactgggttggttcttcctgcacctagcccaggcttcgttaggactccagctccctgtcagtcctgcccatatcccagtcaggagacaatatccaaaccaaccccttacttcaccagtgctccaggggaggcccacagttcttcccttgagactgaaatgctaccaaggaagcctccgtgtcaggtcccttccttctgggcttcacttttccatctgagagctgggtgcaaaggatgggctgctttctgatgggttaatcgagacgaggttcccaggggcctctcagcacacttgcctgactaaccctttccggaggatgggatctgggtaaggcaggccctttcctgttcagcagcagggatgagttacagctctgtaggcgggagccacctgtcagcccccccggggctggtgactccattcccagcaggccgaaactctggtccagaggagatagtccggccttggaagttttgcctccttccttcatttgtctcctaatgtcttaagctgcctgtccacagaggcactggctttgcttgtgtgcccctccgggcaggccacaggagggaggaggcagtaaggacctggcaaaactgcaagccccagggctaagtgcatgaaaggtgggaattcaggcatctgggccaggcttctaggggagaagctgtaaaagggggcaagggtcttctgcgccatcaccagcattagccaacagtccagatgctagctgcagcctggccctgccctgccttccttcctctgtccaacattttctcagtagccctggagatggaaagggaagctcctcccccacagagaaggagctcagagttagaaataaacaaaaacatcccagaggcatggaaaggtctcctgcccctcgggctggggggccctgggccagggactttatctccatggcatccatcccttggacctgtaccaccgaatactctggaggacacagaggcatggcaatggtggggcacctgtagtcggtggtgcctcaacaggggctaaaagccacatctctctgttccagtgtcagcggccggagcggcagctcagcaagtggtggaccaggccacagaggcggggcagaaaggtctggtggggctggagggaggcgggcaaccccagcacacctcccactccccgccccatcccggctggggcccaggcacatcctctcctctgcagagccctctgtccacaatgccccaagcaggtcccccgggagacccaggccaggctaagcctacaggcactgtggttcccgggccctgcctgacctgccctctctcccgcccttccccagccatggaccagctggccaagaccacccaggaaaccatcgacaagactgctaaccaggcctctgacaccttctctgggattgggaaaaaattcggcctcctgaaatgacagcagggagacttgggtcggcctcctgaaatgacagcagggagacttgggtgaccccccttccaggcgccatctagcacagcctggccctgatctccgggcagccaccacctcctcggtctgccccctcattaaaattcacgttcccaccctgtgtccacttcatgattcctcgcaagctgggcccagtcctctcatcccaagagcagagccaccgtagccggagtcctagcctcccaaattcggaaatccaatccaacggtctcaggaatgttttccatcccgccacgcgcctcccgaagctcccagaccggaggctcagcccccatctcggttagtgcccctctcccgcccgactttagagccagcccctgccccttattccctgccccaggatcccggcccctcctgggagctgggctggactcggtcctcagatcctcggaaggctcagctctgggcggggcaagggaccttgcaagtcgggggggcctcgggaacttctctccgccagctgcgactggaggctgggaacaggggagacgacccagggccacggcccctcaggacttcaggcggccggaggttgtggggacgaagcggagtcgggagccgggcttccggccctcactaccccgtctcggcccgcgggttgcctgcgtgcccgccccacccagcggtgagtcatggggcagggcccgcgggaagctttgttgagtggggcgctgccgcccggcggggtcccgccccgccactccccggggaggggcttcggggcacggggccgtgcacgtgagaacgaagcacggttgtggggggggcatgcacgtgcgcgctcgcgtgcgggagacccctcccttccacaccacttcctttcgggacaaaccggtaacctccggccctggaaggttttgtctagtgggttccggatggactggtgttcccagcacccccccggcacgtgtccacgcgtgtggccccggtacggtgtatgccttgccagtaggtgactcaacgtggcactggttgagcgccggatgaggcctggccctggcgcggggcgtgggctgctgcggccctttcctccccgcgcccctcacgccccagcgggcccctagcggttcccgtccacccgctccatgtctttaccccggtactacctccacctgcagtcgcctcctcctgcgcgccagtggcctctgcgtttctgttgaaaggtaccgactacgcggtgcttcccagttctgaggcgatttagtcagcggactcaaggcgcgctccctgccttccccggcctcccagcaggggacgaagtccccaacctggctgccagtccagatgctgcagtacaggtctgcctaggaggccgttcccttctccagtctgagatctccctcgcggggcacgtgtctaccacccttaacccagggctgccctggttccactatcggttacatgttgctgactgtccccaaaaggtttctttgtagaatgtgggaaagtccttgaagagacacccggagcagtgtcaggggcgcttccaggagcccctgcctccaggagcaggtcctagggtctggagagccggcctcagggccactccaggaggctggtggggctggactggcagagcccagcatccttctggtgtgcatcattcccctatgactcagggatgaatcccaagggacttttcacttgttctccttgtgagtgatcgccttaagtgcgacccaggtgcggccaaggagagagatcaggcctgaggccaggagtcttctagaaaaggcttttcttgtcttgaaggcggggcatggtggctcagcctgtaatcccagcactttgggaggctgaggcgggagaatgacttgagaccgggaggtcgaggaccgctgcactcagtctgggcaacagagtgagaccctgtctcagaaaaaaaaaaaaaagccgcccttcatcttcctctggacaccttgtggctggaaaggaaccctagaaccagccacttggaaccacaggaggaacaagtctgaggaacaagtctaaggaaaagcccacctgctgatgagggcagagcctcccagacctccagcctgttcccacaacaccccctcccttccatctcagccaccttgaccttcccatcatgctcctgctgcctcggtatcttcacacctgcggcattttctgcctggcatactctccataaatcacccttgcctattgctcttccaaacgtcaggtctcagcggccttgggtgtgccgacacacacacacacacacacacacacacacaatatgcatcaggcccctggtgacacattctcacaccccctgtacctcctttttagagtcacaatgagccttcatgtgtgcttctccatagtggtggttcatggggctgtaaccagtccctttttagtgcatgctctgtgtcttctgcggtgctcaggcagcactggctaaatgattgcatggaggaccatccttttgttctcctgatggatgacagtgagttctcattttcaggtttaccatggaaccatctctgcaatgcagccccttccacattgccccagccccatggagctggtgctccggtggcgctgtgcaattgcctgttcctgtgtgcctctgctcccccgacactaggagccctggagggcagggccaggtgggacttgccttttgaaccatgtctgggacacagagggcacagagccagtgtctctgtaataggtcccttgcctgatggcagggcaagtccatacacccgaaacaccgggttgcagcagaagaaagaggtttagtcgcagggctgccagacaagatgggagaaaacctcaaatctctctccgagaagtttggggttagggttcttaagagttttagagcaggccaaagtgtggagattgttgatttgttgaagagtgcggagtgaagtcatggggccagggagatgaaaaaactgtattctcatgctgattatgttcttctgggctgttcaaactggttggggtcacttgtttcactggaatttggaatctgaaaaacattttaggctggatgcggtggctcattcctgttttcccagtactctgaaggccaaggtgggcggatcatctgacgttaggagttcgagaccagcctggccacatagtgaaaccctgtctctactaaaaatacaaaaattagtcgggtttggtggcgtgcgcctgtaatcccagttacttgggaggctgaggcaggagaattgcttgaacctgggaggtggaggttgctgagccaagatggtgccgctgcactccagcctgggcgacagagtgagactctgtctcggaaaaaaaaaaactgaaaaaacaaacgaaaaaaacgttttaaggaattcctaaacaaaagcctatgattctaacatcagaaagccgaactgtgggaacagtggggatgcagatggtcagtatacagtgccacgggaagttctatagaaggaatttagttaaagcacagcctcattaatgcttaattataactgttaatttttaattataactgttaatgcttaattataactatatttctgtgtagaatgcttgttaaccctgtgaggacagcttcaccagaggagcccttgggagcttatactgcccaggcctgtctccaccaggttcatggagcaagtacagcccagactggctgaggaggaaggattgtggccacactacacctattgggtgtcagtcagtcctccagagatcaattcttccattagcaatgccacacataattcctaattctccaaattccagttccccatctagccaaacacacagtcactaacattacattgtggttccacttacaaatgactgcattttcaggtggaggtgttcccttaaaccattttctctggatggcgttccttcctccctcttcttcttcatccccattttcagtccgtaggatgagcttctttgtatgtaatctcccaaacgtctaccgctggagttctcagctttgacccccatcagactacacatgaggcagggtgcagattcttccactttcacctcctctccccttctctccctccgccgcctttttaaaaaatgttacttgtcccatttctacattgtgaaaacacgtagagttgcattccattcctcagccctgaaccacacctttgtttttgtcttggatctgcaattgaagatattaaaagctgtttgccattccttctgctgaatattttctgctatctcttggttggttagaattagtcctgcagagtcttctctctctctctctctctctcttttttttttgagacagagtatcactcctgttacccaggcaggagtgcagtggcacagtgtccgctcactgcaacctccacctcccaggttcaagcagttcttctgcctcagcttccggaatagctgggattacaggtgcctgccaccacgcctggctaatttttgtatttttagtagagatggggtttcaccattttggccaggctggtctcaaatacctgatcttaggtgatccatcagccttggcctcccaaagtgctggaagtacaggtgtgagccaccgcacccagcccagagtcttctcaagaatgaaatagttaaagatgataaatgtttacagagataagacatctgatatctgagttaataatttctataactgggtaatgggtccatgagggttcattttatttatatatatatatatatttatttatttatttatttatttttttgagacagagtcttcctctgttgcccaggctggagtgcactggcatgatgtcggctcactgcagcctccgtctcctgggttcaggcgattctcctgtctcagcctcctgtctcagctcatgcctgtagctgggattgcaggcatgtgccaccatgcctggctaatttttgtatttttagtacagacagggtttcactatgttggccagactggtctcgaactcctgacctcaggtgatcctcccacctcagcctcctgaagtgctgggattacagtcgggagccaccgtgcccggcccattatattctatttttgtgtatgacattttctatttttaaaacggtaaaaaagttaaaataaaaattttataaaaagaagggcttatgtgaacagtattctgatttttaaatgtttggttggtattgttagtctgtagcctttagactttatccctggctgggtttgaggtttgtggctccctcttcagcttcagtgtcttctaggtgtggctgcaactgccttctggcacagaaggttgagcagaccctacatgtctgatgcacactgaaatttctttttttatttttaattttaatttattatttattttgagatgggggtctcactatgttccccaggctggtctcaaactcttggcctcaagcagtcctcccaccttggcctaacaaagggctgggattacaggtgtgagccgctgcaccagctccctactggaatttttttttgtagagacagggagggtctggctctgtcacccagattggagtgcagtggcctgatcatggctccctgcagcctcaaactcctggcctcaagcaatcctcctacctcagcctcccaagtagctgggattacaggtgtgtgccaccatgctcagctaattaaaacaaatttttttttgtagaggtggagtctcactatgttgtccaggctgatgtcaaactcctgagctcaagtgatcctcccacctcagcctccccacagcactgggattacgggtgtgagccactgtgtccagactcctgcaggaatttctaataagcaacatgatatttctggcttgttttctttctttaagtttaaagtacaataatttttctagagtttgtctcaatgattatggctctggttcattgttgcctggtgtgcagtttgccctttgaatactaattcaaggctgggcgtggtagctcaggcctgtaatcccagcactttgggaggctgaggtgggaggatagcttgagctcgggagttttagatcagactgggtgacagtgataccccatctctacaaaaaataggaaaagtatccaggtgtggtggtgcacgcctgtagtcccagctacttaagaaggctgaagtgggaggatcccttgagcccaggagttgaaggctgcagtgagccatgattgcgctactgcactccagcctgagtggcagagtgagatcctatctcaaaaaaaaaaaaaaagtatatatgtatgtgtgtgtgtgtgtatatatgtgtgtgtatatatatgtgtgtgtatatatatgtgtgtgtgtatatatatgtgtgtgtgtgtgtgtgtgtgtatgtacctgtgtatgtgtggtgtatgtatacatatacatatatacccagaagacagattgttggatcataagttagctctatatttaattttttgaggaatccccatagtgtttttctttctttctttccttctttctttttttagaccaggtcttgcactgttgcccaggctggagtgcaatggcacgatctcagcccactgcaacctctgcctcctgggttcacgcaattctcctgcctcagcctcccgagtagccgggatgacaggcacacaccaccacacccgctaatttttttttttttttttagtagagatggggtttcactatgttggccagactggtcttgaactcctgacctcgtgatctgcccgtctcggcctcccaaagtgctgagattacagatgtgagccaccacgcctggccttccatggtgtttttcataatggctatatcaatttgcattcccactaatagtgtacaagggttcccttttctccacattctcaccaacacttatcttttgtcttttttttttttttagagatgaggtctccctgtgttgcccaggcaggagtgcagtggctgttcacaggtgtgaacatagcacactatggcctcgaactcctgggctcaagtgatcctcctgcctcaacctctggagtagctaggactataggcatgcaccactgtgcccagctcctgcataattgtattttaaaatatttgctctgttccattgctcagctttcttctttgggaattccaagtgtgagtatgaagttcttttcttcctactttccatatctactgttgtctcccaaatactgtgtatctttttcattcctttttttctttactttttccatttctgttctataggcatctacggtggtatctaccttcttgtgcttcttatctgccatggtttgtttagtcttttttcttctattcatttctgagatatatttctcttctgcctgctcttgctgtctggccatctcctctcagagttctggcaactgctttacagtcttccttcataacagctgttgtttattaagtgtcttcttttcttcctaaaattcatgttggaatgttgactattctttttccatatttaaaaatagtatgtttttactcttaactagaaaaaagggaaggggagaagtatatatctatggtatgctgtctttctgtaagaaagagaggatgggccgggcacagcggcttatgcctgtaatcccagcactttcggaggccgaggcaggcagatcacgaagtcaggagttggagaccagcctggtcaacatggtgaaactccatctctactaaaaatacaaaaattagccgggcgtgatggcacacacctgttgtcccagctacttgggaggctgaggcaggagaatcgcttgaacccaggaggcggaggttgcagtgagctgagaccgtgccactgcactccagcctgggtgacagagtgagaatccatctccaaagaaaaaaaaaaaggattaaagaaaatacaatgtctctgtttatttgtagaaagtgcaggaaggccagtcacagtggctaatgcctgtaatcctagcacttgctgaggtgggcgggtcacttgaggccaggagtttcagaccagcctggccaacataacaaaatactgtctctactaaaaatacaaaaataagccaggtgtggtggcacgtgcctataatcccagctactcaggaggctaaggcatgagaatcgcttgaacctaggagggagaggttgcagtgagtcaagattgtgtcactgcactgcagcctaggtgacagagcaagactctgccttaaaaaaaaaaagtgcaagaaggataaactaggaaataaagggattgggggattggttacctatagggggcaggtggcaaaggggtggaaagagggagcgaatgggaacaggctaacagggataagaagagagtgacacttatctgaatatatctttttttgtggttctcagaaccatagtaatgttcttatactcaaaatatagacaaagcaattaaaaccaaccagaatataggggagggaagtacccaaaatggaatacaaacactaaaaagtgaacctaactctactacaaatgaaaataaccacactcaaaagaaaaaattcaagtaaccttgaaaatcagtatgttgactggattctgtagggttaaatgcagcaaacactctccatacattctgtaatctagtcagtaaatgtatactttctcataggattgtgggtaagcaattctgagacaactttatatagtagaattgaatgcataagtaagtgtatcataaataataagaactgggtttgtcactattggataaagaaattaaaataaaaaccagggaaccctcttccagtaccccatgtggtgttgtattggaatctgaggtatcaatataaactcaggatttttaatttttgtactaataaatgcagaaatatagctgggcacagtgactcatgcctataatcccagcactttgggaagcctgaagtgggcggatcacttgagctcaagaattgaagaccagcttgggcaatatggtgaaaccccatctccacaggagtggaggaaaaaccaggcagagggacccccaggacattgaggggctctggccgctgtatgggacacgcttctggaaacttgcccctaatagggcatcaaagccaggcaggcaggggctcctctgtcagaggttggaagccaggactgcatcttcccatcttacttttgggatgcaggtcagctgttttccctcagatgagaggttccaattttttgtttgtttagtttttgagacagagtctcgctctgtcacctaggctagagtgcaatggcgctatcttggcttagtgcaacctctgactcccgggttcaagcaattctcctgcctcagtctcccgggtagctgggattacaggcacacaccaccatgccaggctaatttttgtatttttagtagagatgggatttcaccatgttggtcaggctgggaggttccaattttataagatgagaagaagggctgaggtcatgcccattctgccactttgctgagtccagagctatgatgaagtgaagaagaaggcacagggcaggacaaagaagggagctcagggacccgggagttttccttggcagaagtcaacttgccccacccctgagaaaactctgaccttctcagctgccagggaggaacgcagggactggggaggaggggacagggaggggaacagtctgctgctctgtgccctgggagagaagtctgatgacggcagtaactcaggaagggttaagaatattcctaaaatagccaagccacagtctaagccagtccatgagcagagagcagatctgtagcaggaaaagtcagcctgatctttgccccactgcctgctgcctagccctggctgctaattaagcctcctaccctgtccccttcaccaattcctcttgtcctagtggggatggggtaggagtagtcagaggagccaaatcaccccaatcaacagggaactacagctgggaccaggagcactgggcccagtggccccccaatccacactcctggtctgagagtcaggtagggggacatagggagaaagacaggcaaagtgcaggctttgtgcatgggatggaggctgccaagagagagcagccaaattctcccacccacacacatgcatcgccagccatgatcaggtgggacctccaagatcatcatcagataccgccttctcctagctctgtgttcccctacacttagggcatcttggagtgagacaggcagggaggggttgagggagcccctacatgaacaaaccatatctttgtttcaggggcaggaccaggtatataatttgcaggacccaatgcgaactgaaaatgtggagtctgtcattcaaaaattgttaagaatttcaaggcagtgacaacagagcattaaaccaagttcaggtcccctctgagtgtggggcttttgccactgcacaggtggcacctttatgaagccatccttgtgcagggatttggtttaatgaacatttactaagcgcccactactcagctcttctggctctgtaacatggtctggctctgtgtccgcactcaaatgtcattttgaattgtaatccccatgtgttgggggagggacctgtgggacgtgattacatcatgggagtggttcccacatgctgttctcgtgatagtgagtgagttctcctgagatctgatggttttatagggggccttttccctcttcattctgcacttctctctcctgctgccatgtgaaggacgtgtttgcttccccttccaccatgattgtaagtttcctgaggcctccccagccatgtggaactgtgaatcaattaaacgtctttcctttgattaacttctaatctataactaaggtctgagtcctgaagaccttcctctggagcctcagtaaatttattttatctagatgggtccaggtgctgcaggtgattacccttatcttgtctcctgcaaaatcatggaggtttggggaattctttagacttcctctcgtgtggaggtttgttttcttcttttttctttcctgcaaggacaaagtgaattctgtgatggtttatgtatcatttttgagtttattgccaaaaattgaggctcaagtttgtagactacatttttaaataaaataaaactttctagacacagaaatgtaggtgaagctgttcctttgataccattttccgaatttacacagaggtgatagcaaatttttctctttatctttccttgaattgtatatatgcatataaatgctcttaaattcttagtgcaacagggtggattgtcattacagagaacgttcttagcatagagtacaaatcttcccactgctgactaggctctggtcacatagcaccccgagctggccttcaacttccacttctcggttcttttgcttaccttctctatttctagaatggctttgtcatttcacttgtctgtctggtaatatcctactcctgtaagaatcagtgagttcttggtacatactgatctaaatttgcctccggtttgaacctttttccagttttccaggtaaagttgatttatctgtcttctatgtttccataacaatctttccaagcataatacagtaaaaagagagctgattcatcatgtcctgtccatttccctctggagactttggagccgacgtgagggtacaggtgtgcccctgtataagatctttggtcgcctttgtcaagtttagcgcagttctcagtgtgtaattgttatcaggtgccattaaactggacctgaataattgaaggattcaaagtgttcaggaatcacccaggatgcttcaatacttcatcctaattagggatatggggaaagtttgcatgagaaagaagtttttttttttttttgaactttaaggataagttaaaattcagtaggcagaatgacaatcttgataattttttattttttatttttatttatttatgtttttttttgagacagagtctcgctctgtcgcccaggctggagtgcagtggtgccatcttggctcactgcaacctctgcctcctgggttcaagtgattcttttgcgtcagcctcccgagtagctgagactgcaggcatccgccaccacacccggctaatttttgtatttttagtagagatggtgtttcaccatattagccaggctggtctcaagctgctgacctcatgatccgcctgccttggcctcccaaagtgctgggattacaggcatgagccaccacgcccagccattttttattttaaaatgttcattttttactattttgatacaataactattttttaagaaaaggcagaaatcactgtttattagaaggcagattttactgatttttatacccctagatttgttgcatgtcaaacctatataaaacatctataaatcaaatcgttaattgcccctagtgtaataattctatatatggatgtaatgtttgaatcttcaggagctttgataacttgaaggccttttgattgctttaaaattaattctcattgtatttgtttatattgtatcgttaagcaaaagtacagagtaagcaattagtgtgattaattcctcttctataatacagtaaagcactgcctccctagaccaattctctgggatccctggaagacatctggcatccagcaagtcttgacccctctttagaaagccatggagaaactggaggcaattctgttaagtattcgctctctagaggcaattccattaattaccctccctcacctatccatgacacaatttctccagttacatgtagaaggctgttatgtgtctcttggccagaccctttatttcatagatgtggaaattgaggccctgaaggatgaggtgagtgttcagagtccacatgactagttaatgcccagaacctggcctggacttctttcttgttccggggcattgagttctctccctcttctttagcacgtatggccagaggtaacataatctgcgcatcacatttgcatttggagtgcatctgttttgcattcatttaatcttgttgagatggtttgcttgttgacctactcagtcagttatcttttcacctttgtgagttgagagctttgtgtattaagtctgtaaaactttgcatcttggaaagtgacataatctgtagcagacccatgctgttttcagatgcatcttaattgtgatagtgatagtgatccaggagatacacatgtttttctgtgctatttcagaatacgccttcttaatccaagtcaagatggagtcaaaaacaacagactactacatttttgtttattttatttaggtaaaatacctgttttctgacaagactaggactcttacatagactgccatgaactacaagaagtatagcattgctcaaata

SEQ ID NO: 598 - DNA, 73186 bp, Homo sapiens
gactcggcgggcccggggctccccggcagcggctcctctgctaggggttaacagcagcccccgcggccgggcgggcgcggacgcttcctctccacccgcccgggaacgtggataccgcgcccgcaggatgttcgccggctgggaccggcagtcaggaaacatgagaaggcctcgctattcctgttcccgggcggcgcgcgccgggctgggtaaataaagccgagacgacggcggtggcggtggtgagcgcgctggagcccgcgtggagaacatgcggcggggatgggagtgcgcctagtctcgaggcgggagagccagccgccctgcagccggccgtcggccccgcagccacaggtacagcccccgcgtcgccgagtctcagccggctgcggcggaacgccaggctcgctctggcccctgcgccctgggcgccggtgctctcccgcccttcccccaacttccctccaaggtctggtggagaggcgctcgggtagcggccaaggctggcccaagggtctgcgcggagcttgggagcccacctggccgcgcctcctttgctttaaaattattcgccggcgttgggggagggggacacttctgcagggagtgacctccccggccacagtctggagtgaatcggggtaagtgatttgagaagaggcgcgggtggccgcgcgcgggagtcctgggagggtcagcaagtgtggttcacacgcccccggaccccttgcgacaggacagcgctcggacctttgccatcgcttgcctctgagcctgctgcctgcagacctacagcgcgccgggtgtctgtgtctgcgatctctgcgtgggcttggggctgccggggaagtgtccgaggtggctaacctcgtgatgacttcgctaggaaaaacacgtcgtcgcatctaggaggacgcgctggggtggctcggagaaggccgggccggggaagggtgtcttgtacaaataaagcagcatgaacacacatccctaagggcatgattttaaaagaaaacaccaacgcgagtcttgactgtagaacaggggctgcaagcacgaaaattctctttgacacttatcaccgaggctatgtgcacaccccaggcacgtacctgtctgcgcgggaggacgcagtcctaggggacacacgacatccagcagaggtctgacttcacttccctacgaacacagaccgtagccgtcgtttgatcgcggtggtcacgcgtggtcctaaatgtcacgcgtggcctctgctgcggtggccgaagggcggggcgggggcgttggcgagtgtgggcgcttggcgaggcaaagggtgtgtgtgtgtgtgtgtgtgtgtgtgtgtgtgtatgcgcgcgcgcgtgtgttagtggagtagcagcccatgccgcggctggacgggcaaagggggcgctggcagcgaagctgaggccgctcggaggaaacgggagctgtcccgaggcgcgaggcgaggagatggggcgggcgaagtccgccgcgcgccttggggctgtaactctgcggctccgcggccgcgcggacttgctcctgacgccggtgcgcggcaggcagaggctcagggcctccgcgaccccagaggtgagctgctggctctccccgacagtggcagcagtggcccgggaggtgcgccgaccaagctgcctcctgccttgggcttctgacacctttacagcctctgaaagggtccccggagaccccagagagaggcgggtgtcgaggggctacgagctcgcggctgacacccgcgctgcggaagagaatggcactgattgagggctctggggacctgggtcctggcgccttggaccttaggaccatgcacttcccggggcgcgttgggggatgataggaagattctgggagagaagggggagaagtggtgctttcgtcctgacgccacttaactttttcctgtccttgaacccaacctcaccccgggggaccttggcggacagaagatgcgggggtttcaaccaaaccatccacgatctagaaaacacgaaaatcccccaaatcccggtatggcctgggactcatgagctggggggtcttgtggatacggttggcacattaccccaaatcttcccttccatccaacccctcctgacgccccgagttggggttcctagaggctttagtcttctgctgtgattgaagaaccacgcgcggcctcacgccggtcgcgctccgcagtccggagtatgcctctcccagattcaaactgaaacccagaggctcgtttgggaattcgtttcctttgcctctgcgggtgaatgattcccggttgtagttctggggagtgaagggattggggggatcgatcgcccaggcaaggaagagggcaggtacctgtccggggaacctgcaggggcgggggcgtgtagccaactggggagagccgcagggtccctgccagttgcggcggcgccgctcctcccctcggctccgcagcccggcgacccggccaagttcaaggccctgaacctgcaggggtctgagcactctcagccagtaagtaacgagatgcaccttcctctcctagaagccgagccccgctgcggagctcccggcggcccagccccgaggctctgcggccgcgccgcgcgtccctaccaaccgacaccatgaacaccatcgtcttcaacaagctcagcggtgcggtgctgtttgaggacggaggcgcctcggagcgggagcggggtggccggccctacagcggtgtcctggacagtcctcacgcccgccccgaggtgggcattcccgacggcccgcccctcaaggacaacctcggcctgagacaccggaggaccgggtatgcgcactcccctgggggccctgcccgcctgcggcccggaggggtgggggtggtgagctgtgacggggtcccgtggcaacgcgggcgggtggacgggaaagggcccggagttccctgggagtgcaggtctgcccctccagggctcgcgcattctcatgttaaggggctcctatcttaaaacatgagggatcaattcgtcggggcagctccaaagagcttggtggagactaagggcgccaggagctgcccctcggccctccgctgcctggacctcggagttgggggttatttgcccctctccggactgtgggtgccggtgcgcggctgagggcgaggaaaaaggactgagctcggtgcagagaaacaggcgaagccgagcagtcggggagtccaggctcaggctccgcggacttctcttcggtcactcgagcccctcgccagagccccgcggctcgcctggcccaaggagtcgggaaggtcgcctcccgccagggagtcccgggcgtgagcgcggctcggctgggcccgcggcgaacccggagggggaggccccgggcctgcggggccgggtttgagtttagcggggtgaggggtatgctggggggggcggtagcttgcgggtgggccagctgctcagactgccggtgagtggagggcaggctctgcctggcccgatccggcggctccccgggcgccccgccggggaggggcggccgtcctagccgcctccacctgaacgattgcatcagctgcttgttctgcggcgtcgctgcttagtaaaacagagattcggtttcgtcaaaatgttactaccagtcgtttcgggtggaattgcatttcaaagtgtttaaagaggcagaaacccaggaggctccggcgcaggcgcgcaagcctcggggagcggctgggctcgctggcggccgcgcgcgacacctcccggacccgtgagggagcgcagcgccccaggccacgctccaggctcctggctgcctctgcctcctccccctttgaatgtgcttttcctgaggtctttttaccttacatgatgggacagagcttgccgtacttttaaccctcccttagtcgggaaacggcccgacggtgtttttgggttctgcagctttcctccacaaaccaccaactcctttagaaagtttcccccttttcctaaaagatcaaaggaaatagcttaaagagagccggggcggcaatgctcctttgctttattccctatgtccagtcggcgacctttcccctgaccacaagcgacggaaagcctctgggagcagacaagagatccccgagggaagtttcgagagccagccgcataccctgccaggcctgccaggccagggccactcgagggtgcggcgccagcgggtgagggaagggtagcagttagccccgctgcccagatacgcgactggaatagcagtattcttcaaatcacttgaccttcgtcttctaaacctctaaccttggggtattgggttcaaggtatccccctattcaagataaacctatcgaaatgatctccccatccagaaactgtgtggctcccacttcctgcctctcccaaacactctgggcgcgcgcaaagcaggggcgcaaggcaggaatgcgcagtttggatgcggggcccgggcttggccggggcgtggagcgtccgggcgggcaaacgcgtcgctcaccagggccgcctcctctccccatgtcccagcgcccggcagaatggcgggaaggtgaggcacaagcggcaggccctgcaagacatggcgcgacccctcaagcagtggctttacaagcaccgtgacaacccgtaccccaccaagaccgagaagatactcttggccctcggctcgcagatgacgctagtgcaggtaatcaggacccattaacaccctgatccgttttcccgcgaggggctgaagagcgggaacgcttagagttcgtgtggctctccacgtggcgcttctacctggagagggatggagccgagctgtgggagtttctgaattacctctcaccctcatccctcagttcagtgcagatgctccgtgcaggaaagaatgcaggatgcgctgtcaggtagggaagtgaaaagtaaactgcagacttacgagaaggttcaacattagtgagcatcagaatcgcctggagagcttaaaacacgaatcgctaggccccacctccgagtttcggattcagcaggtctggggtgagaccatcatttgcatctcttacaaggccccaggtgttactgaagcagaggctagggaggaaccccactttgagaaccacgcagtgtgacgctccatattaaggcccagtattaaagctcaggtacagagtaactttcaaaattaccattactgacagctaggagtaggggatagaaagacaagaaatgatgtttggatcaacaaccccccacacacacttatttattattattttttaataggaagcatcctaaacattagctgcaatccacagcattttgctcctgatgcttttctgctgggcttaaggagaggaggcagatttcagatggttgggttactttgccaagtgtagagaaatggtgcaaagtttgtgtgttctctggtgaacaacgttactttacatttgactagcttttcaaaactgaatcttactgttcacaaaaccacgatgttgtaggcagttactatcagaattttacacttgacataatcaagacttggggcagttgtgtcagtaaaagacaggcctggaaataaataattccagaccaaatgctcttcccgtcatgtcacaattttttaaaataaatacggtggcttgaacttttttacatgcaaataggcaaatttattcagaaagaagaggaggaggggctacatcaggtgaaaagttttgcacattgcggtagcattacctgattgtgaaaatttggccattccgctaaatttacagtaagcaggaactccaaaaaggaaaaaggaactagtggataaaataaagattgctttccagagtatttaaaatttccctttaggaattactggaaagtttgacaaggcatgaaagttgacttattgtcaggctatcaatactagaatacgtaatttctgcttattttcagaatataattatatacaaaaacatctgttttctttcatattatcaggcaatggtattaatagtgatttgctgcagcagtggaggggaaaattaatttagtgttcttggcttaatatctgtttaacataaaactatgaatcttttagcaatgtaccaaagtagttttgaaataaattattccagtcagaaaaacctgacttatgaaaataaataacctatgttaaaatttcagtttaaataagtatgctacttatttttaaaatacactaatttatagagttatctgaatatttcacagtgatgtcagcaatgaaacactaggttattttggctgattatagagcttcatatttaatagagactattctttcatacagaaaacaaaagaacattgatgacatattttaggacatttttaaattatgaagtagcatttgtcattaggagagccatttaaactttcttatgtagtggtttttgttgagctgcaatacaagtagttataattttaaattatttgccacctgtaatgatagttcaaatacaaataaaaatgctttttacatttagatcttggtaaggctattacatttttaaaatatgctttacatgaaattttcattcaaaacactttttttctcttacactagtgctcagaaaataaaaatgcacagaaatatgtaattttaagtggggtaagataatttttataataataaatgacaactgtataatgatttcaaattttattattaatgaagctagtttctgaaactttaaagtgataaatggaaaaaataaaaatgtatagaattaccaacggatcttatggctgatcctatggctgatcattgttcaaatgctatagaaatacactctgtactctcaaaatataaacagctttattgtggaatagtataaaatggtatgtgattggggtttgtattattgcaggatatggaacttatcaaggagtaatgagtagatgttaatgcttcctcctctaataatgaaagtctcatattcctgtgatatgtccacatacgatttgttaaaactgctatgttcctagattctgtctcctctgttgacataactctgtttttgcttggtattgagtgtgcctgctgatatatatatgccattatcagctacaaggcttatagtaacgttaaatattcaacaaaatctcagatcagtccttattcattattccaagtgttatattacatggtgtggaaatgaagtgctcaatatttcagttgaatagctcagaagttcgttaattcagtgtgttcaaacatggacagatgccagtttatccctttgggtgtactataacaattgctctgtcaacatgatgaatgtaaacacctttgttaaagtaggatgaatattatttagttttccctcccagcttctagatgtttggccttctaatctttcactataaaatatgggagatagatagatagatactgatataaatcataattatataaattagtcatatctaactatctcccatattttatagtgaaagcttagaggcccaaacatctatacgtatatacacatatagcattcagtttgacattaaaattctgttccagaacctatccttggttaaggagacctgtttcatgtaaaatacaatttgaagagaatatgaacgacaacccgaaggaatccatagtagattaaaagtggaaaatttgaaccgatatttttaccttcagtgaaacagatggaatttgcattaattcatccagaaagaaatgcaaaacaagtatatgcaaatttgttaactaactatttgctgtttgcaggacctactgcaaatacacattaaagaccttggagtgtatctagctgttaagttgtactgaaaaaacaaaagaacaaaaaaccccagcagaatatatatattaccagattgggtggtggtcaatttatgaaatcagttttgaaacagtctataatagacatcagcaaacctttctggaaaatcacctaatgtgtaactattataatatggttaaaaaaaagactatgagtatataaaacttaaaagagatatgactcctatacatgaaaagttagttaatcccctgtgacatttaaatcatttaaatgttcccccatttttatctgttagaagggtagtgtattacttttttaaaaaattagaaggccattgcattttcattataagaagagtttcataagaattggattttacactgtactatgtgtggttgctgtgtgaagatttaaggttagttaagatttaaggttagtctgaattatatcccattgagtaaagaaagttacaaaaatgttttggagttggattctagtaaatatgaatgatctaggggaagttgcaggctgtactctgtgtgtgaaaggagcaaagaaggacaaaaacactcttgctggagacagtactggtcaacagagggaggttagtacctagtataaaggaaattaacattgctgtaggggaacttgggatgtattcacccatcttaatttttagagctagcaaggatattaggaaccatcaaatccattttagagatgaaggattcaaagttcagaaaagttgaataatttatccaaattcacacagcatgtttttggcaaattcagaacaggaagccaggccctcttccactgtatggtgattatgggataacaggacatttatgaggatttgaagaagtgaagtgactaaatcaaaatggtgcatcaattcttgaatttgatgatacttgctaagatccatttaagagaacagaatggaagacagggaagttagaaagagaaatgttttcaaattcccagctagtagtatggctggataaagtagtcggatgaagattttggcagtgagttgaagaatccaagggagtttgagaaatttcatgaagaaagggatcaggctccttgtgcttccacagctaatgttcaccagtgtatcccagttaattatgtgtagttcttttccgctagtccttctgggagtgcagaagacaaagcttattcattcctaggacttaacaccatggctaaagtacaatagtcactcaataattttgttgtctgtctgtagagaatgggaaggactgagaatttgaagtcagactgaatcttagtaatagtaacatagcttagcaggaagaagcattggtgaagactgacttctgaaatgccacagtgagataatatgtcattgcatataaatttgaaaggataactatcattgcttcaggtacaaagaagacaatattaactatattgaatattaaatacatatgggaaacccaccgtgtgtttacccatgaggacagggagaaaaagtataatttgagatttttttttaagtagaataataaggacttgagtaatgcacaaaaaatgtgtatttatagtataaatctagaaaaaaaaaagtagaaatttccagtgcaaacattgccacacaaaccattatagtaatctggcctttcttcaaagcctagcttaaattcctcagtttggtcatgttctggaccaaactggcagaaagatttaattctcttcccatgtttcattcttttaaaggcaagtattgcccttttgagtttctaaaaatctatgcactgatgataacctggtattttagaagaaatttcaagtatcaaatccagtaacatctttaaaaaaaaaagaatggaagtagcttttctttgtcttgacatatttctttctttgccttcacctatttgtctaagaaacatttgacttttggcttaaagtgaggagttctttggtttattttccccctcttcacccatggttctacctctgttttgctaacgcctcttttggaagcgaacagatcccacttttttcatctctaatggtttccaaagcttggcccttgaccctgctttcactctctctactcttgcaactttgactattacctctgtgccttttcctcttgaatttgctcatcccctcccttcaatctcagataccacttttattttcttaccagacatgtcaccagtattagcacctcaaactagacattgcccaagccaaacacatcattttatcctcagaaagtttcatctccttccccaaatgcactacccttctcttggttccacaggtttgatgactcaaggtcatctttaactcttccctcttcttcaacccctacaatttctgtggaatttcacttctatttgttcctgtgtcctctttattgggaatgcacttcccttccctcttgacctgacctattctggactttcttcaaaggctcacttaacttcctcaaaaaggctggagtcatatatgaaagtaacccctctttcctttggactcgtatcattttaatgtcttgtatgccattcatcacattctttcttatactagttatttgtataccctcctacttctcttactggacttttctcttattaaattttttgatgtcaaggccttttcatttttccttattccacaaatacactaaatgctcagtgtctgtagtaagcaacatgtttgtcaaatgaatgaatggatgcgaatgtccggtattcttatgtcctgagaatatttaatgatcagaggtgctgagagaggcttagctcctttatgagaaaataatcgcaccatggataatgtttttaagttttgttaattgaaaaataatactgttttaggtgtcaaattggtttgctaatgcaagacgtcggcttaagaataccgttcgacagccagatttaagctgggctttgagaataaagttatacaacaagtatgttcaaggcaatgctgaacggcttagcgtaagcagtgatgactcatgttctgaaggtttgttaatatttttattttgctttctttgttttgcctctattagcaagttcaccataattgctatttttaaggttgctctcacaaaatatgatggtgccttaacggttcttttttattgcatgaagtaacttcatttttataatactataaatgaccaaaggaatgatggccatttcctcttgtttatagatataccatgtgtcagaataacatattcagtgaaattcattaaaattaaaataccataagcgagagatgacataaatatttgctttcattgcctaaaaattgatcttgactatcaaagataattttatatactttaaatatatttcctttatatatttttaaggattaaatataagagttgggtggctgggggaaagtatgcataccaccctacttagtgatactgttccactttagatggagaaaatcctccaagaacccacatgaacgaagggggctataataccccagttcaccatcctgtgattaaaagtgagaattcggtcatcaaagcgggagtgaggccagagtcacgggccagtgaggactacgtggcaccccccaaatacaagagcagcttgttgaaccgttaccttaatgactctttgagacatgtcatggccacgaacactaccatgatgggaaaaacaaggcaaagaaaccactcgggatcttttagctccaatgaatttgaggaagaattagtgtctccatcgtcatcagaaactgaaggcaactttgtctatcgcacaggtaagtccgtgctttctgtagtaattcctgcgatacctgtttaaagcacaattaaaactgcatcagagggatttattttaacaggtataaagacatcagattattcacatattgcccataattcagttttaaagctttcgttttgtttagaattgccaatggatacatttgttagtagattatggtcttactgagaaattttcagttttcatattaaagacaggaagttttattctttttatattttttaattttaattttttaatattttcattttgtttttatacaaaaattaactcaagatggaagaattttcattctttataataattttaatcttcagaataacaatgtttaggggggtgtatactggcttttatgaataatttataatagaggatagtgccggattgtggccagtcctgcaaatactttgtattttatcttttctgttaaatgctttgattgctaaatagtgatggtaaatgaaaacaaattaatagggtgtcaagcttttgtgaaagaaaggtataggtctggcttccattgctctggaaattttactctcattcctgaaaagcataagcagggatgaaaaatagcttttaaaattttactttccttccagaaataaaggatcgattcctacctgtccaaaactttcagatggagtagtaggtttggtaaaaatttctatcttgacttcagttcccagagaggtttgctcttaagaagtgtatgaggtgactttggaacaaggaatatgcatgaccaacatctggtgtagacagagtctgggtcctgaaaatgtcagcaaatgagatttagaatattagagctggaaataacctcagaaaacatctagaccaggcacattacatcacagataagaaaacccagaccaagaacacatagtaggtactctcctccagatctctgaatctgcacaagagataggaagaacatcactactataatcactattattatccctactactaccaatcatgtatagagtagttatggtatactaggccctatgatataaactatacacattttactacatcttttcttcataatatcaagaagcttggtccatgaacagtagggctttattaagaaatctaaagttgctctgttaatgtaccctttagatcatttcaccagcaatctgattttcaaacgtttacaaatatatatgagacaaatgatctacaaagattcagagaaaatatcaatacatttctaaagacttaaatcaacctcattttctctttgcatcaccaactccaacaataaaaacaaactccaaacactcaaaattacagaaattgtcttgtaaataataattgggtctaggaagaagaaaaaataaaagaaaatttggccaataatgaaaatgaagctgggcaaggtggctcacaactgtaatcccaacactttgggaggcagaggcaagaggattccttgaacccaggagtttgagacaagcctgggcaatatggtgagacccccattgctacaaattttttttttaattacccatgcatggtggtgcatacctgcagtcccatctacttgggaggctgaggtgggaggaccgcttgagcccaggagatcaaggctgcagtgagccgtgatcatgccactgcacaccagcctgaggaacagagggagaccctgttgcaaaagaaaatgaagacactacatattaacatctgactgttgtgaccagagaagagcttgaaagtaattcagagttttatgaatgtttatttttagagacagggaaagaaatcacattgttcaaacagataattgaaaaataaaataaaataaaaaaaggtcaaatgggaagctgaaaaataaataagagttgactcttttaaaacaataataaattaaacaagcaaaaatcgacgcaaattaaaattggaaattacaaaggaaagaaacaacaatcaataaacagttattaaacaaaaaaggttttaaaaaattatgatgaagtactatgcacagttgtttggcaatatactatatgtaaatgtgtatttaaataaattggcattctccacacaaattaaaagttcataaacaagaaaagttttaaatggccaataactagggaaaaattaagatttttagtcaatccaattcccaaaacacatgacttaatacatccatttcttttcaaactttgaagaagtaattaatgctcgtgttttatacatttttctggaacatataaaaagtatcaattttaaaaaaaatgtaaacgttatcctactctcaaatcagattaagactgcataaaagtcaagatctttctttataatactgatactatgaaaatacttgagaaatatttataatgtaatattgaaaaacaattcaaaattgtggaaacactataatacagttatgacagtacaaatgtgcataggcaaataaaaaaaaatgacaaatacattaattttaatgagacagagtaattggtaatcttttattttaaaatatttttcttataaaatttttaacattgcctggtaaaaacatagattagatgcctacgcaattttcccagtgtggtgagtcttctgaaaatgcatgttcttttcaaaagtgacaaaatataaagccagagtgaatagcatgcctgtagagttgattcttttcaaagttaaatatctcggtggcttgtttttattaaagcattccaaaggcacttggtccatagtatggactattcatttgccaaattctatttttaaataaaagcctattttttttttttagttatgcaagcaatgagaaagcaacctagacatgtaaacttctggttttacatgcgtgtgcaccaacttaaaaagggcagactaaatgatttgtttttatggttggagaattaagaaaggctggtggcctaagactgatctgctaggtttcaggtcaaaacaatcaatggctgtctttggtgggaattgagtgacagtgttgctgcaatcgtagctgggttaccaggcatgtataaatagtaaaacaggggatttcaagaaatactttctgagcaactgctatggttttctctggcatataaccttcttctgaattctttcaattccatctggttatatctttctttcctcacctaaatagaaattttctaagtctgtattaacaccccctcccccagtgctacagtagtacaaagattttgaactttcaaattttttaaaagaacactttacaatttatttgtttttgttacaatttattgctgaggaacttttcttttttcctttttttttttttttttgagatggagtcttgctctgtcgctcaggctggagtgcagtggcacgatctcggttcactgcaacctccacctcccaagttcaagcaattctcctgcctcagcctcctgagtagttgggattacaggtgcgtgccaccacattgggctaattttttgtatttttagtagagacggggtttcaccgtgttagccaggatggtctcgatctcctgacctagtgatctgccaggctcagcctcccaaagtgctgggattacaggcgtgagccaccgcgcccggctgccaaggaactttatccaattattcatccatttttgttagagtagctgtcttgtgatgagttttattaaatatatggaatcaaatagccaattgaggccgggcatggtgactcacacctgtaatccctgcactttgggaggccgaggcaggcagatcacctgaaattaggagttcgagaccagcctggccaatatggtgaaacaccgtctccactaataatacaaaaattagctgagcgtggtgggaggcgcctctaatcccagctactcgggaggctgaggtacgagaatcgcttgaacccaggaggcagaggttgcagtgagccgagattgtaccactgcactccagcctgggtgacagagtgaaattgtgtctcaaaaaaaaaaaaaaaagccagttgaaagttggtgtgagaaaggataatgtatcactgaattttacttcacttatttttattaaattctagggggcagaatcttgtagattataaagtagtaatcctaattgaagatattactagaaacatcaaagcaaatgcaaacatatttttattgattttacatagacattatttctctgtaatccacagtctttggcttcatgccagggtcatagcaggctctcactacaaatgggttgaaacatttttgacagcagtaattttaccattgcaattgatcagagttattaaggtcattgcatctaaatgtaattaatactcaaaggaaatttagtcactcagtgtcatctgttgaattaagtcatctaaattaaaattataatttgtttttatcatgtgagcttagcgaatggtaattttcagatgtttgactgagtgaatttccttacaaactgatgtccaagcctctagcccccaggtggtctgctctctctgctctctgtggtgccaggataaggacccccggtgtaatatccacctccattcctgttgaaccagggctcagattctccagatggaaccgtttttgccgccttacagagtgggttctcactggaaccttttctaacttgaattagactttgactttaccctcagaaccaagcctatggaatttctttctctactgaaggaggaaagaggattctaagaaagagtaaatcaggcaagtcttgaaataaaacctgtggagttcccctcttgttttgctcgacttgaggacaagcccttgttgcatttttccctttcacagatcacagatgatcagtttataaaggcctagtgcaggccaggagcggtggctcatgcctgtaatcccagcactttgggaagccgaggccagtggatcatcagaggtcaggagttcgagaccagtctagtcaatacagtgaaaccccatctctaccaaaaataaaaaaaaattaactaggcatggtggagcgcgcctgtgatcccagctactacggggagagaggcagggggatcacttgaacctgggaggtggtggaggttgcactgagccgagatcacgagatcatgccactgcactccagtctgggcaatagaatgagactctgtctcaaaaaaaaaaaaaaaaaaaggcctagtgcattagaatggttgctctatgagccccatggctctgtcagcatatactttataaatttatcctgctcccaagagtttgaatgtttaaacttcattttgttacactctctaaaatccctcttaattagacacatctggtataaagcaaagcatctaggcagataggagtgttttctatgttagtatgaattaatcgggctaacttcccatctgcttgatggaggtgaatatccctgggaagaaatgaagattttgattgagagaaaaaagaagtcgtttattggtgcatgggacactctgggaggtagtatccatttggatgtcctgctgcggttggagacatggaacaaaacgagagaacaagccattttggttactggggaaagaggaacaaggatgtagaaagtttgggaggataacaagtccaactgccatctccaaaccatttttcttggctcataatgaccctcaggggagaaaatgttcttttttctttttctctctcttcctgcacactgtgtgccttaaaatttaagctggtatcagtagtaaaatctagatatgctcatgagttcaataaaccattggatctgcgtgggcttcaagcttaatttatgacatagtttctttggagaaaggtattctgttctaaacaaccaatgtaacaagcttctgggacacagtccattggtatatgaggtgctgctcctatgtgcattcattccacatgcaaaaatgacaattaagagccactccatgaaagctctggcttagactcactggagccctgtgtttggtgctggtcactctatccatgaaaccatatttaaacgaaccagaagaaaggtttaaaaagatgccttggcagatctttttgagcagtgaatattccccctgacaatatctgtttccttcatttcagctttcgttttggggggtagcttaaaaaagtcttacggcggcatcaagagccatctgtgttaagggccctgtgtgagtgcctcggtgcacacgcacggtttctcttttgggcttttgttgaccagtaagtctacctcggatacttattttcttattttatttccctttctgtgctgtcactttcttggttttagtgaaagaattaagctttgccttttttggattattccagacattcttttcctggcatgcaaatgactgttgatgtactccagcagagaataataaaagcctctatcaccagtccagcgagtgacatttaaaggatatttgaaaggttgtccaattccttgtcttgtaccttacctaacaaaggccatctgggaatgaggtatttcacataagtccagtttccagatagcagaaatctaaggaccaatttaaaaaatagagaattttcttctcttctaaacttacactattcagcacagctttggagaggtactttaataatctttctattctctaaatgtcctcttccttgtatttcttatatactgttccaccctttcaaatcagtaacctcagggttaatcacaatcggaaacttgcccctcactcctttgaataaagagccttgtcttcctgacagcctttttaaaagagaacttttctaattacttatttctaagcagaatcttttaaaatgagatttatacaaatgctgaccctttgaatatgcatgggattgctatagaattataaaaacttaagcactattcggaataccatagattcttagtaaacatttatgagtgatgattgtagcaaaacacattgacatggattctttctgaagttcaaattaatttgatgtttgaaaattacatttctttctggcttcacttgcaaaaattcaaatgcaattgtaccagggtttcacccattgtgaagaactgagagattaatggaagacaagaaaagaaaaaagaaatattggcaacatgagctgtgtgctggctccttcaggggtggctttccattcacttttctctgttatttggtatcacgtgagagcccgaaaaatcctacgtgtagatagatgctgagactcgcactatcatactatatagcttataaacaaatcgaaagtatgaggcagtttagcctagaaactgtacagatattttagggttgtgtttgcttctgacatttttgtccttttatgttgtggtacctaaaaaatgtagcaacactgatttcatatttggctgaatgtgggcaaattgttttccgaaatgcagtcgcatcctatctctttcatttggtactggctctcactgccttgtatatatatattaaaagttcctggaggccctgaaatggtgctgtattaatttttataattcccctagtgcttattaccgtgtctttcacgtatttactctataaatgtttcttcagtgaatgaattcgtgttttgatgatttagtgtgtctgctccttaaatcataaaaaacatttaaatttacttaagtatatgttgatctgtgtctgtgaacagaacaagaggaagggtcctgaataagtttgaattggtttaaaaaaagttttaaaaagaggaaaaatgtaaagtaaaaaaaaaaaaattaaacaatgaagctgaaaacaatgaaatgtttaagagagtcaaaagaaaaacatagaaagagtaaaatgaaactaaatcgattttcaagtaaaggagtgacttccagagaaatgcaaggatgaaaaatggaaaaatttagagagtttaaaaaaaatccaccaaagaataaaaagcacagccgatagacaaataaaaacaaatggagcttttacaaatttgacttcactaagtaatgggatttattgtttacctagtagcatactactactttggaggtgagacttaagaaataaagcacagatctaaacccactcatttaaaccctgcggcatgccacctttactgtcagggttgacaagaaccctaagtcaaagttgtgactttttaagaatgactatttttagctgcatatgagaataggagaaagtccatacagaaattttatactttctctctcctccatgtgcaagagcaaagatcccatacatttctgatattttcctgttaagaacaagtttaccaacgttaagttttgatcttacaaaggcattctctgtattttggcattatggttctactgatatttatcagcaaattgatcataattgactttctgatactcaatgcatttcagacttgcttcagtggtcagtcacatcccggggcagcttcacagaagtgcttgttcatgtcactatatttaagactgtgtcagtatttccattaagagactttctcattccctagggcttctaaataagtcgtaaaaaatcaagccaaactcaaagctggcataaaggggtccttttctttcttctcctatgtataaggaatataagcacgtaactcccattaattctatatttagttaggtttgtaaatgctttatacactgacgagaccaaatatgatccattgatgcttctgtggcctaagattaaaaagaatttcaagaagtttttactgtctatgaaaataacaagacattctaattaatgaatatggaagtggtttcttttctcccttcttttttttttttgttagttgcagttagttttttcctttctgcctccctactttgtttctaaaattaagaaggtatttttctgtgttaaaatttgtcttgttgatgtaacagaatttttacacagggtaaatatgtgctttcttccagtccagagttttggtacttttaattttggaagcctggtttcttgttttccattataaatgatatcatttataattgtgagttttgaggaagtgaaaaaatataataataaatgtgttcactttgcccaatttccttcacaaaatttgaatatttttctcagttttcagtttaaatgaagggtggtgtgtttaaataacagctgcgtaatgaactttttctctctttcctctttgacagcttccgttacccaatttctctgtttcattgtactaaagaagtaaatagacagggatttttgtaaatccagcaatcagcttttaaaggatcttccagatcaatcccttatttttcaggttaggaaattgctttaacctctatacaagtccctgaaaatgttcacttttggctatgagtttctctgttgcttggagatgtgatcctgatcctttgtacagtaagtctaacggtttttggcagcttcaggtacttaaatgacttttacttaaaaaatacttaaatcattagtgttgaacttttgagaacttggagtatgtgtgtgtgcatttctaaaagtttctctcttttaatagctagagtggaaaggtttttacacaagttgatattataaattgtgggttgtaatagccatacagtacctacggatcatctttggttattatgggaaatagaaatggtttgcagaagatcccacaccattaatactggtggccaaaggtttctgcggggtgtgtgtgtgtgtgtgtgtgtgtgtgtgtgtgtgtaggtagtagtagcagtaatagaaatcgaacatagttggaaaaacaaggtcgcttttgaagacgatcggtggcatctcccctctgccttgtacataacactggagacattgaagttattaccaggaagtggccagaaacaatttgagggatgacaacccagtttgaaagtggttttgaggagatagattagtctcagtttgaagcagcaacaccactctaattttaacagtttggagtcttccccaaagtgagtcagtaactgtttttccaagcccagtaggaggtgctacagggtgaaattcacttttagcatttgctcaggtcacacaaccaaacaaagcaaagttgaagtttagacttcacaggctcatggttttgggcagcaccttagcagtggccatgattctcttaagcacttttttcatgtcttccggaactgctggactgcagataggggtaaaaactgccacttgcccactgacttcagtacttttgagtatctttgacacagtgatgaagatgtacatcttttacacactgtgttcactttttggtcctattacacacacatacacacaattttatttttttgtgtgtgtgttgtttttgttttaaatgaaaattttgatcagttttcatttaaataaagagaacattttttacaatgtgatttagagaggaatattttagtaatacaaaattaaaatggaaaaacagaactcaaatgaaaatgaaaccttttaaaatgctgaaaggtggtcagagacaaccattcataaagtgatatttccaagaaacagcttgctccttaagttttcacatagttgcctgtgtattaagaactgatagtcctttcagctgagccagtctcaggtgatggtgaacaaatctcccagtatggcagagacatttcaagtaagaatgccctgttctgccaagacagtcatgatactaaaatgtacccttttgctaagggccaaaattcagagtctctcctcccagtttctacactgatgtagacaacagatgcacaaaaaggcaaagtggtatgtcacatggcttcagagcaagaggatggctatctggcaagggagagaattccttaaatgttactggggcttacatttctaaacataaaattcctagccagaagctatttggtgccaagtgtctttgctgtgatgcctgagcctagcaggaagctggatggttgcaatattgtggctggctgttggaatccacacagcctttgctaatttgcaaccaagattgagtgatatgattgttttccatttttttcttattgttgttctggttgcatctgatcttgccatattttcttctcctagaattctcttctgagctgctaaatctatccagatgggtcaaggagtttcttcataaccttgtcactagtgcaactggtcttgttttagttttgacggtgtctcctgggttcatttattttagacctttttagaaatatggcactaattcatatttatgcagcaacccatggggactctagcttatctaactgtgcactttttttctttcaactgtgtacttttttctttcagaaaattttgtatgtatatttttttcttaaaatgtgcttggaaaagtataagcataaatcatctggaatagtaattctcaactatcttgaaaggtgtgcgaggactatttcatggttactatgattgaagcagtaaaatttagtttatagttacaataactttcctctcattaggaaaatataaaaaagctcaactttatgatttcacgacatattaccaacccttaaattccattctaatccccaccccctaacacacacagactcagtgaaatgctcacaggaagctcagagaagaaccgtagaggcatatgacccatctgtgctatgtttgacctcacgttgtctctcagatgctttcattaaaatgacagcataaaggtctgggtagaggctgggttgaaggaatacacatcaaatgtatattttgattatagtaaagtccccactccttcaactgtgatttggaaaatgactttgtagggccccagttttctctccaaccaacctccttacctacacgaaattatccacttgtagatgagaccacaggaagctataatgtggacagagcagagagcaatgccttagaaatcagcagctctgtgtattggccagatctgttagcaactgggtgtgtgttttaaggcaagtccctttattaatcatggctttcgttcctttagctgtaaaacgaagatgtatgacaagataatccataagtaccttacatctctgacagcatgcaattctgtgcaatgcacagagagacaaggaagcccacagtttatagaaagtcatagctaaatgcacaccgcaatgtctctattagaacagaacttgggctctgagccacaagacagggacattgcaaaggagcattggggagcatggcaccagtaaacctccctggtgacaggtaaaggactctgcccagtgggggtgttgggctctgaccatggggtaggaggccaagagggtagatgtcacgtgtttacatctggcaatgcttgccttatgtcgtgtgtcatttttaggagatctctcccaagattatagaagtatgctatattttaacttttctgataatttttatcagaagtatattttctgacatttttattattttaagtacatgttatatacttataatctacctacaatttatttttgtaaattatatgagatcatgatcagactacttttttctccaccaaatgaacagccaattgtcccaacacattttactgaatatttctacctttccttattgatttgaaatactacccccattatatactgacttcctttatatgtatgcctatttctggactctattgtattctatcaaacttaaacatatattaatagcatgacatttgatttcctttttattttaagttctgggatacatgtgcaggatgtgaagatttgttacataggttaacgtgtgccgtggtggtttgctgcacctgtcaacccctcacctaggtattaagcccaacatgctttagctatttttcctgatgctttccctccccttgatctccccatgacaggccctagtgtgtgttgttaccctccctatgtccacatgttctcattattcagctcccacttataagagagaacatgctgtgtttggttttctgttcctgcattagtttgccaaggctaatggcttccagctccatgcgtgtccctgcaaaggacattatcgcatttctttttatgggtgcatagtattccatggtgtatatgtaccacatttcctttatccagtctatcattgatgggcatttgggttggttccatgtgtttcctattgtgaacagaatagcgtaccattttcatgagtgtagttttattgtccattttgatgtatgacagggtatgtctacttccatttttttttttcaaaatattctcatctaggtccttgaatttattgttctagtagaactttaagtttgataattctattttaaaaactcttgttagaagttaatttgggatttcattgactttaaatgttagtttggagaatatttttgtccatgatatttatatcaaatcttcccactgagggcatggcagatttctccatttattctggtcatctttttagtttttacagttttccttacgtagggttgggatatttctcattaggttaatttctggatttttatttgttgttcttattgtttctattgcagatgagttcttttcaataatagctataatggatatacgggaaagctgttgcattttgtatatttttcttatatctagttccattgttcaagtacacaagtatctcatcttcagatagtaagttttgtgtatttactctccttctctttcccttccttcctctctccatttattgcatcatgttggccaggtcctacaaaacatcattgactcacagcagtaataacacacattaatgagaatttgtctcatattttaccatagagtataatgtttgcagaaggtttctggtgtaatcactttattgagttaaggcattctctttccattcctagattatttaataagatatctccccaaccacacacttaactgaataggtcattgcatttacaacaaactgctgtatctatagtttttaagattgtcatctagttgtcctcttttaatctatttaagttatttacagtagtacatttcctaatgcttaatcatccttgaattcttgggaaagtttttattccatatcaatataatattcttttaatatatttctggattcactttattaacattatttaataattttgcatcaaaattcttaactgagatttgtctttagctttctttttttttttcctaatggtctccttgcacagttttagtattagagttatgttaggcttattgaatgagctggaatgtattttatctttttctatgctaggaaattttaaataaagttagcattaactcttcctgatgccttgaaagtttaaaagaattcacttgtgaaaggatcttagcctgagattccttggttctctacttttcctcttatgtttctcatctttctcctccattttctgaacagttttagctttatcttctagattattattaataatttggtctttaacttttcccccattcatactttaatcaactttttctctctctctctctttttttttttttttttgagactctgttgcccaggctggagtgcagtggcacaatcatagctcacatcagcctcaaactcctgggctcaaacaatcctcctaccttgggcctcgagagtagctgggattacaggcatgtgccaccatgcccagctaattttaaaattttttttgttgagatgggagtcttactatgttgcccaggctgctctcaaactcatggcctcaagcagtcctgctaccttggtcttccaaagttctgagattgacagatgggagccaacatgcctggccctataaatcaattttcctactgcagtttttcttttaagtttggtgtcttatttttattctccaagaacatcttttttttcttatcactactttgtcatagcagctatgatccctgtagagatcagaagttactagaatctctactctgtacctcttaatggccttaaagccttttctaggaaccccccttagacaggtcccctaacctatttaaagagcatttgtagcagctttatgctgcggttagatgacccagaaagctctctgtggactcagagaggaagaagaggtatgccctagctcttctgacagctgtctcgtaactgataattttcttgattcccctggtaggctacttattctttgtgaactgtgcacttggaacatctgtgccctgttgggagaagcagctcacactctccacggtcttgccctccacctgttttgagttgtggttcccagtttggatttccccaccaacttgatgccatatgtattttcctttccatgaatttctcaacttttctgacttggcaatggtaccttttattgtttttgagccccattaagcatgtatttgttttcaaatttacattttgcaatttaatgagatttcgagagagaaattaataaagcttattcagtaccccctcttaaagggtaattctataacacagacttttagcaaatgattttatggtaaaagatgttttccttacttctgagagtttttatggagaatttgcacacattcaaagttaagcatagattctgaatatcaacgaataataaatacagagtaactgtgcacacaatggagcagtgggaattgttgcaacattcctggtaggtttcatgtacaaaaacatgatgcattgtgataggtaagacttcctgaactatggtgcttgaataaagagataaatataatttagttaaataaaaaaagccataattataataatatgatatattattacttggcagttgtgcacctaatctgtactgtacttttgaaatgtgactggagtccaagtggatactattttactatgtcgttaagcttgtagcacactagacctgacttttctttttgtctttccagtggaaaacttaggttctttgagtgaggactcctgggattttttaaagtaaaaacaaggagctaagaattccactccttcttgccaatatttccttcaagcaaaattattgattaatggaaaattaaatatcatatgcttcatattgcttttttacccttttgtacttgggttattttaataattttcgctagcgctacaaatgtaattgactaaaattatacatcaaaataaaacaaaaccatgggagggaaaagattatcatattttgaaaacatatcaataaagtacatatttaaatttgcatatttggcttattgtgaaaatgtcaaaatagttttgctttcctctaataccttcattattatttcttctttttcttcttcttcttcttagtaataatacagtgtattgtctttgcttagcgctttagattcttcgttggtttgtttgactgtgaatgagatgactgagtatttcaccatacttctatgtccctgagcagtggtgaactgaccacagaatatttttctgtgagttttctttcttccttcaggaataaggttgattgttcatctgtcaccaggaggaaactatgatgcttacacagtaacgaatttaaaataagccactgttcccaagatctttccaagagcagcaagctttcagtggagtaactaatatttctagagtcctttgtttgcagggcacttatcatcattgtgttaggcagtccctgttatgctgcatgggtctttccctgaattatagagctagttctctggttcatcctttaaggtgctaaaatcacgctgatgaggtcgagttttacatgttatcactagttgatctcgccactgggcaaaaatcataaacagcaaatatccagacctaatttctagctaacaattgcagcatactcctccaccaggctttccctgggaataggggaatttgaagggttttcttttccaatgtttctgtatatcctgttggagatgctgatgggcaatgtcatctccacacacatattctacgaacatattaagtgaaacctctgcagctaagaagggcaagagaaatgccagacgtccagcctgagatcatggtacctacatggccaggaacagacagcttgcatgcagcagtcaggaatgtagtatgtggtttctgaattcattaacaatgtcaagttgaaaactgatgactacagttataaatcagagaacagtttttaatgcatatgtattagttttctcttgctgcataacaaatcatcacaaattttgtagctttaaacagcacccatttatgagcccaaagttctggaagtcggaagtctggcatggcatagctaggttctctgctcagggtctcaccaggatgacatcaaggtgtcattctgggctctaagagagaacccacgtacaagcttatccaggccaatgacacagctcatttccctgtggctataggactgagacccacatttccttgcctctcaatttctagaggctgcccaactcccttccttgtggcctcctggcactttcaaaccaacacccacatgttgagtctttctcaggcttgaacctctctgacttctccccctgccttcccccaggaaaaagctctgcatttaagggttcatgtaattacctcaagcccatccagataatcttcctatttaaggtcaactgattgatcatcttaattacatctgtatagttccttttaacatggaacgtaacatattcacagatgtaataccaggttgaaaagtcatgagggcaaaattcttcctaccccagcatagatcatgtggcagcgggatttgggtaaggtttggcccgtacaaccacaaatgtttagacaattaacattatgatgagtgtgagcttataaagtacaaaaaaatgtaccgctttaaatgcttttggtatggctaatctataaatggagtaatcaaatcctgtctaagtaagttagttgaaatttacataattatttacatatgagcacagaaaacacgtgttctctttatccattcagtcaatcttgctttccttaaggttacttgtattttatctcataacataaagtaggcattttcacatgcaggccagcatcaggcaattgacagtgtgcttttttttttttttgcttttttttttttgagacagagtctgactctgtcacccaggctgaagtgcagtggcatgatcatgactgactgcagcctcatcctcccgggcttaggtgatcctcccacctcagcctccctagtagcctgacaatgtgcttctaaggtagctggctagattattccccatggcatgatgaatgtttatcacacataataatggctgctatttatcaagcatttcctatgtgcctggcattgtgctatgtgctacacttgcatgtattattttagttagtccttacaataactctgtgatgtacatattactatccttattttaaggatgagggaacagacttaaatagcagaatgtgcccatataagctgagatgttgcagaaccatgattcgaattcatatctgtttgactctaaaaccttcttcagcactatcttttactttttcccaatcctgggaaaagatggcagtttatttttgagagatccttagacctgcttttatgtcttcctctacctttttttcccactatgcccagagcaacctatgtctttatgctatgcccagcccccagcccatcccataggtcctctgtctgcccttcgatcttctggagtaagtggttttccatctgtcaatcgagaatggcaggctctcatctcaggcagctgacgtcagtaaagtatgaaaggagcaccatcaaaatagcttataccagggcataataatgacaaaaatagctagggatccctgtgccaggcactgcactaagtgccctacatgtattttcttactcaagcctcataataccccatgaagtaggtaccttattatcctcatttcccacagggtattttgaaggcagaatttctaaatctctgaggggattaacagtgtgagagagtttgcagggagagtccttggcttctccaggccatcctaatcctttcctcattctagaagattaggatcagccacgtagcaccctcatcttcagtaacaactttcagtctaaaatttatttcatccctccttcgtcttacttcagatcctttctcccggagtgccactgtgagcatttgaggctggagagaatgccattaggaccaagccttctctgtagcacaggccggtggcattttggtcttagaatcccaggagagaacactgaacatctctgtagagaggagagggactccagcaacataacacagtgtccagggcaaagcaagcgtctgcctgcagcaattctcctgagagccatggaggccaaaactatgataaaggaaagtacagcaattgcatggaacaagggttacaggctccttattagtggggagagctgctcctttgaaagggacagcaagtctgttaagaaaacaagactgcagtcaagttccttcctatggcctaaagatctgagtggcctcagaatgccaaaggcaggaaaggaagagagaccctgcctggggtctagggtccaggccctcagtcactgcccctgcctgtagattcgacttacaccctttacttcacatcactctgtaaatccacagaaaataaagttgcaccttgattttcagaatagatacattccaaaaacaaaaggtttacatctaatcaaggtttaaggacagagcagacacttggtgttttaaactaatcttgccataaatcgttttgttatatgtacagcataagtcaacttctgtttcataagtttaggttctaagatactgagtttttcttacatttcatgttaaccagaaatatcagcttcctttggttgagtctgtcattgtgtcggcagtaacggctattaaaatattgcatcctggttgtaaaatataactgaaatcactggaaaatataatactaagtgggcaaactgtgactaccatagtttcgaaaccacaaaaatgttgtcttgatgagggagtacatactctgtttttgatcaccttgtattaatgaagattgttactttaagagaataattaattttaaaaaatgtcaagcgctttctctaacaatgggactcaatgacattcctttaaaacaactttcacttttaatctatcattaaagccaaaggtttttttaaattttaaaagcttgtccttgaactaaaataacatggaacattttaaaacatggctccaagctgctctacatacattttatttaaaccacagagactgcagttagatttctcagtgccagacagactacaaattataactgtagcagaagcgactgtgaatttctggatgttgtagtaccagcgagcctggttgctttttggagctgttcctccctttgggctccactcatgaatgacttaatccctgtgtcagatcaaatgtcatgcctgttgccatgcagagaaaaagcaagcaaagcctcttttttttttttttttttttggtctttgcacaaatttgctgtactcgcctacagaggagcaggtgagaagtaagaaaagtcacaaaatagaagttgtaaagtgaggctagaacacagtgaaactccaaatgttgaatgtatgatgaaaatatcatctaaagcagaacgccattgtttatcatggcaagaagagggcaataacatccatggtatccacggttgaattgtaaaaatatttttactaaggtcatttttgtacttactattctggtattagattagcaaatctaatgccagattagatctaataataccgtatattgtgttgcactgtgtactgtagaaagtacctgaacatctgttattttatttgatcctcattataactctatgaggtaaaaataaggataattattcctgctttcatgcagggtgggagggagtgatcatctcttgcacagctacttaatggcagagccagaaagaaaatttaagtctctaagctcctggttcaggctctttccacttgattttactgtgttttccatcctggttaagtcaactcaaaataaaaaaatcatttacggaatagaactctctaaagcagtcactcttaacttccttttgtacatggactgctttaaaaattgggtaaaaagccttgcatccttcttcagaaaaatgcacatccacccccttaaacccacacaaacacatagacactgttgtgtagcccagatggcaacaagggtatctctgatccttttgatctaaatagcaatcccttaaatacttgattgcacactatggaaggtcagacacttctgaagatttctagagatgcccaagggctccatcttctaagcatatggtatatttggtgcttgggtcgtgttgccattccacatatgtgctccctgttcctcatcgcgtggattcagatgtgaaatatactcccttcctcaaacgccagaagatccccactctcggaaagcttgtgcacgtggtacagttgaaggaagattcagagggagtgaaggaggaccttccatcacagcaattcatatgactttattattgttgtttttttttagagacagggccttgctctgtcatccaggctgcagtgcaatggcatgatcatggctcactgccaccttgagctctggggctcaagccgtccccccacctcagcttctctagtagctaggaccacaggcactcaccactgcaccttgctaacattttatttgtagagacggggtcttgtcgtgttttgtctcaaactcctggcctcaagaaatcctcccacctctgcatcccaaagtgttgggatgacaggcctgagccactgtgcctgggcacagcagtttatatgatttcctacagagcactacttgtcttcattctttagtgccctttggccaccccgacatgggactcttccttgcctgcttcacctcccagggtctccagcctcacagcacctcactggttctactcttccccctcccaccttttccttttacctcctaatccccagttgcctcaaaatcccatgttctttacctgtagtgtaacccaggtctctcctgcttcaactcccaaactctgttccatgctcagaccacttactgagatgctaagcgaacttaaggggctttctaggtccccttcaccttccttataaggcgtttgggacattaaatggtagtgtattttcttcatgcacacctgtttataattgtaggagtttcaaggattccctaaaacatcatccccctggctttagaatcccattcgaagacagcaatgggaatgtctgggcttcttggatctgtgagtttagagcttttttcaggttcctttttggagcagagttgatgattagggacagagcgctcttttgaccactccagagctgtatccaagccaggacagctggtgtggggcaccacgggatcccatgcttatggccctgcccgtctccttcacctggccaatctagaagcagaggttggtatggaaacttctaggaaaaaagaaaacaggtcagttgatccaacaaaaatctaccttggttcatgcttatcagtctacctgcttcttgtcctttatgggaaatgatacctgttttataagaaaaagtgaaggatgaacacagttgttcatgcctgtaatcccagcacccaagagcaggaggattgcttgaggctaggagttcaagaccagtctgggcaacataccgagaccccatttctattaaaaaaaaaaaaagagttttaaaaattagctgagcacggcggtgggcgcctgtagtttcggctactggggagggattgaggcagcagggtcacttgagcccaggagttcgaagctgcagtaagctatgactgtgcgactgcgctccagcctggacaataaagcaagacccagaaaaaaaaagaaaaaaagaaagaaagaaaagagaacaaaagaaagaaagaaaaaggaaggaaggaaggaaggaaggaaggaaggaaggaaggaaagaagagagagagagagaaagaaagaaagaaagaaagaaagaaagaaagaaagaaagaaagaaagaaagagaaaagaaagaaagaaagaaggaaagaaggaaaggaagaaagaaaagaaaaaagtgacaattatgaaataagaatagataatgacataaaatagcattttaagagtagatagtgcttttaggaaagaaatgttttaaaatattaatgtatttttaatttgattcaaatatgaagctatgttattctgagagatgcattcttttcccagtgatgaagcttctcttcttgttggtggtctgtgactttaaagcactgttgcctgggatttatctctgtttccagggtattctagcacatctagttttattcatacctgtgatggatagtacaaaaaaattattatcatcttacttgaaaagtaatgatatgattgggctaagattgaacacgtttctaaaggaaactcttgccagtccaataatatgacttataaatataattggtaagcacaaatgtttacaaacaaaaactggctgagcacagtggcttacggctgtaatcccagcactttgagaggccgaggcaggcagatcacttgaggtcaggagtttgagaccagcctggccaacatggtgaaaccccatctctactaaaaatacaaaaattagcccatatgtagtgactcatgcctctaatcccagctacttggaggctgaggcacaagaatcacttgaacctaggaggtggaagttgcagtgagcccagatcataccactgcactccagattgggtgacagagcaagactttatctcaatcaatcaataaataaaaataaaaaattaaaaactagcagaaatatggagttagagatagaccagaaatggaattagacccattgccaattctgcagttgtgtggaaaaggtagaaattctcaaactgggaattggccctgcccatgctgcccccagaggaggagtcccttctgggccttaggctttagcttactctctgattgatctattggaggacattggggagtgtgtccctctcatgctaatgcagaaactaaagatgagctggtgagagggggaatccagtccttgtgaccagtcagtagtgaatccagaataagaagttactttaaaccagggatcaagaataggaagcaaagtatgtggccacaaatcaagccctagctcatcttcaactttttcattgcaggacaattctaggaatctctgcttccacaggaatgctataggaaactatggcatctctgaacttctgaggcatcctcaggattcactatgtcactatgaaatttaaggaacagcccacagagtggttcacttgttcattctgcctagagagcccttagaattgtgctgtctgatatggtagccaatagccacatgaggcaacccagcatgtgaaatatgactagtccaaattgagatatgtttaaatatatgagaaaagaaagcatggaaaatatctcattgataatttctatactaattacatgttaaaatgatactattttgtatatattgggttaaataaaatattttattaaaaatactttcactttttctttctactgtaagtgcatctactagaacatgttaaatgacttatgtggtttgcatgtagctcacattataattctattgacagcactgccttagagtcacggggcttcccaaatggtggtggtggtgggaggaaatttatggaaagggcttttattataactcatattaaagaagaggcatcgagagggaagtcagagtttaatttggcttaaaactggctagtatccctttcatcccactccagaggggcacaggatcttcatcttcaggaagccctgctgtcttcatggccactcacacatgtggaacagagccacatcctcagatcagctcacccttgttttgctattgttaccagtcctaccagaaatcagtgcgaagaactggtttgttcgcctcattaaatgttgactaccctacagtacagtcatccctctgtatcttgggaggcttggttccaggaacttaccctacttctgccaccaataccaaaatccacagatgctcaagtctcttatgtaaaatggcatagtatttgcatgtgacctgcacgcatccccctgtatcctttaaatcatctctagatcacttatagtacctaatacaatgtaaatgctatggaaatagttgctatttttaatttgtatttttttgtattataaactgtattttttatctgtattttttgttgtattgttgtttatttatttacttttttcttttgagacagagtctcgctttgtcacccaggctggagtgcagtggcacaatttcagctcactgcaacatccacctcccagattcaagtgattctcctgcctcagcctcccaagtagctgggattacaggcagccaccaccatgcccagctaatttttttatctttagtacagacggggtttcaccatgctggccaggctggtctcgaactcctgacctcaggtgattcacctgcctcagcctcccaaagtgctaggattacaggcgtgagccactgcacccaaccggtattgctgctttttattgtttatttttttccaaatatttttcgattcactgttggttggatctgcagatgcagacatggagttccaactgtatagatttgtctcattcatccctggtactcgacatattatctggcaatagtcgtttttttttttttgaaaagaagtctcgctctgtcacccaggctggagtgcagtggcatcatcctggctcactgcaacctctgcctcccggttcaagtgattctcttgcctcagcctcccaagtagctgagactagaggcgcacgccaccacgctcagctaatttttttattttaaaggagatggggtttcaccatgttggtcagaatggtctcgatctcctgacctcgtgatctgcccacctcggcctcccaaagtgctgagattacagccatgagcaaccgcgcccggcctatagtcaattttttgatgcattaaagaaatagaaaatgtatagatgaataaatgaacaaatacattaatggtgcacaataaaccattattaatttctgtgggcttaggtatacgggagaaggccttgtgatggtcagtgagctaaaccagggaaaaaaaagtgtgaagtgagaagtaaagtactttttacaaggggtgagatacttgccaggatgcaccagttgtcgctctgagttctctacggccagcatctcttgtgattgtttggtgtgaatgccatactggctgttaaatatttcaatattctatggttggaaggatttcttagttttttttaaattaaatcaactaagagaagtaacagtttccttctttaagaacaaaatgtagaagaacgttatttagaaaatgtataaaggttaccatctcccactctcccactattttaaggatacaaagttggctttggtttaacctgctcacttctgatagaataatgcagagacctgtttaccttcatctacacttgtgtgacattaagtcactgtactttcaaacagaagcatttttgtttagaggatataagcttccatttagaaaaatatgctttttaaaaaataaaattcccttaaaaacacaaatggattagctagaggaacatttcagtttgggtggaaggaaagttctattttattttcatttttctttgaaattcaaaacttattaagttagctttgcagaattaacccatacttagtgccaatagatgctaagtgttgccgccagtaactgtcagagaggatgcagcagtgtggacgcagggcggcaagcctggaagaggctgaatttttatgttgcttttattaatacctcccctttccacagcagtgctgggttcccgcgtcctcatgttgcctcctaattacccaggaccacgaccttgggcattacagacctgatttctttaagagatacccacacccactattttttcctgggttaccttacccaaggccaacttcccaagttaggcacagtagcatggtgcccaggacccatgaaaatatttcaatttcgtttttttaatcaaaagaaaaatgaatgcaataataatgaatacatcataagcctggattatatgcacctatagaccaatgcatttgtaaaatatcatttttaattttttttatgtaggaaagagtgcaccaaagcacaagtacctagagctgatgaaagtcataatgcagtcctgatcccacttttttaaccccctggggcacatctttttgctttccaaagggactgctattttgtcacctgacagtttagcatcctaataacacgctgtatgctaaagtattaaattaatctctccccatcagttcatcaatctgttaacaaataatcattgagaatcctttcttctgtgagttggggctgacgcggtgaccatgacgaacagtgctttgtggtagatgagcatagaacaaggaagtgtgcaaaatgccacacagaaatacagggtgcatacagcacgggacagagagatctcatctaaatacatctttaaaatatttaactgttattatattcttacagagattctttatggatttaagagcaagtataaatatagatacttcttttcccctcttttatatcaaaggtaggccattcaactcaacaacaaaaaaagaaacacctcaattaaaatgagcaaagggcttgaatagacatttttccaaagaagatatacaaatagttaataagcacatgaaaagatgctcagcattaccaatcattagagaaatgcagatgaaaactacaatgatataccacctcacacccactaggatggctattattaaacacacacacacacacacacacacacacacacacaggaattaacgagggttggcaaggatggggaaaaatcaggacccttgagcactgctgggattgtaaatggcacagctatggaaaacagtatggtgtttcttcaaaaaattaaaaatagagttgacatatgatccagcaatgcaccttctgggtacataccagcaagagttaaagtcagggactgaaacaaatatttgtatacccatgtttgtagcagcattatttataacaatcaaaatgtggaagcagcccagttgtccatcgacagaagaatggacaaacaaaatgtgatatatatatatatatttgaatattattcagccttaaagaggaaggaaattctgacacatgctacaacatagatatactttcaagacattgtgctaagtgaaataagtcagtcacagaatgacaaatatggtattgttccacttgtatgaggtacctagaatagtcaaattcatagagacagaaaaaaaatggtggtcactcagggctgggggagggaggaatgaggagtgatagtttaatgaatatcaagtttcagtctcgaaggtgaaaacatttctggagatggatagtggtaatggttgcacaaccatgtgaatgtacttaatgccacagaactgcacagttaaaaatggttaaaatgatacattttatgttatgtatattttgccaccattttttaaagaaagtcttcatcaaaacgatttcagatcatacaggctgctaataggctagaattatttgtctttgatttggactatgatgactagtgtatttatctcatagccagaaaaaacaatagtgatagccacagttggtactctgtccagatactaacaataaaaaattactttgttttaccttttttaaaaaggtagcatatggctggacatggtggcttacacttgtattctcagaactctgggaggccgaagtgataggattgcttggggccatgagttcaagaccagcctgggcaccatagtgagactttgtctccacaaaaaatttaaaaatcagccaggcatggtggtgcacacctgtagtcccagctactcaggaggctgaggcagtaggatcgcttgagcccagaagtttgagtctgcactgaggtatgaccgtgccactgcactccagcttgggtgacagagtaagactcactctgtataaaacaaacaaacaaaaaaaacagatatatatccctttactttgagattttaaatttaataatgtatgctagagatgtttccataatagcacatggagagtattcacattcttttttttacagctgtgtagcattcaatcccaattccaagtagctctctgtaggcccggaatctgtttgcactcaactaaggatgagaatccttgttttcttacagcctgtagatgcagtgtcattaaactcattaattattttatccatctgattggtgaagaatgagtctgagcacctctgtatgtttaagggccattcataattccattttcctgtgtgcacatattcatatttcttttgatacggactctgatggataatgttttattaatttgaacagctctttatggagggagatgagcctgtaatattcattaacaaatattttgcccaaattagttatatatcattgtatatatttattttaataaagattttttccttatgtagccattttgaaatgtaattacactgattattttttatagcttctagaatttaagtgatagcgagaacttcctcattttaaaactttaaagggagtattgcaagttttcttcaaggatttctatggtctcaattttcacttcacatctttcatcaatttggaatatcttcgtttgaggtatagtataatatggtgtgacaaaaatgtccaactttatttttttccacagttacccagttattctaacaccatttattgcccagtctttcttgtcctccctaattggaaataccatattttaaattgagttggtcttgtctttctattctcttctattaatttttctttggtcttgtctttctattctcttctattaatttttctttttactcatgtttctgtcctatcctgttttaattatggaggttttaggatatgtttaatgtctggttgtgcttattcttcctcattgttcttttttcacagtttttctagccagtcttagcttatttttgcatattaactttagggacaacttgtctatttaaaaaatgcttttgttacttttaatgaaattgtgttacatttacaaagtaattatagaaaaatcaatatttctaggatgtagaatcctcttatccaaacacttggtatgtctgttcatgtcctcttatgtcacttttaacagtgttttaagatgttctaaattggccttgaacacttcttataaaattatccctatgcattttatctgtttgttttattgttataagcaggtcctttcttccatcgcattttctaactgctttttatataagaaagccatacatttctatatattaatattgtattctgctaccatcataaatttgcttatcattttggtagtcttttagtttatttttctgtgttttcttgtattttgctaccatcataaatttgctgatcattttggtagtctttttttggatacagagtctcgctctgttgcccaggctggagggcaatggtacaatctgggctcactgaaacctccatctcctgggttcaagcgattctcctgcctcagcctcctgagtagttgggattataggtgcacgccaccatgcctggataatttttgtattttttagtagagatggggtttcaccatgttggccaggctggtcatgaactcctgacctcaagtgatccgcccgctacggcctcccaaagtgttgggattacaggtatgagccaccaagccctgccaacttggaagtcttttagttgatttttctgtgttttctagcagtacaatcatatttgcaaagagtgatgattttaccacctcttttattttttttttccatagatgtctttctctagcttattgcattgaattttacttccattgaccttagtggtgttatgtaagttgctggccttcaggtttcaatcaatgcctgctcatattatggttttagactttgaggacctgggttccaatttttctctctgccaatcactgaaaaacattaggtgaaacatttaatttctctgatttacattcatctctataaaatgaaggcaatacaaatacccacctcccagggctgtttcaaggttccaatatgataacgatggagaaagcacttggtaaactgtgctatataagagttccttgttattcctttttcctcctacagagaatgctcttctatggcactcttttaggaattaaaaaactggacttccctttgtggtcctgcgcctttttgtaattccattttctacatatactccaaggctggaaagaaaaagtgttttttgaacgatgagcaaattcctttgctgacatttaaccaaaatgtattccaaacctgaagcttttcggaagcctaagaaaatgttggtcaccttcttgtaaaaaagtgaaataaaaaatgtttatgtacctcagaacttcctgactgagctggaagtgagtgcactggcatgttgttattttgtggtgtttcagttctgggaaaaatgaaaccagaaaatataggagatttttcaagattttttgttgtgaaaatctttcctttcccccgcccacccctccactttggttaacattgagaaggccatagaagtttgattcagctgtaagtcttctgcaaactaattctgatctgcgatcctgcattaaatttccttctctttccttctcttgcattaaatttggtagagaatgaactacatgtttagagataggacagtggttcttctttcacccttagacacaacactgcctcctgatagccttgactgaatatataataacttcggtatgtaggatgtttgtattccttttgaaaaatgagcttccataactagtttctgtgcagagttttgtgtcctgctccaatctgataaaatttgcaaatttgcttttcctttttaagaaaccaccagcaagtggcttcactccttcaagggtttttagttacatatcaactgcccccaccctgcacctcccatgcaggcatctagcttgaaaagtaatatgtgtggtcattggtatgtccctgtgtctcctaataccactaaccttcgtatttagacagctctctctcttaggacctcgtatccagctgggaaagttgtttttccagcagcagccttttcccttggcttcctggcctatcagtggctttgggagatgcttttggctttgtccgtgcctggcttcagaagagagttttgtactccctcattttcctggattcagttctacagctaactttgaatagaaggaatttgccctttgtggaaggagtggagatcagttttgcattgaaagctaatgaggtcttaatgtattctctcctggagattggtaggaggaggacattctagtctccagacaggctgtggattagcttactgaccttaaaggaaagcatatttgaaaacatattccttctttttgtgtgtgtgtttgtgtgtgtatatatatacacatgtacatttgaaaacattccttctttgtgtatatatatatatatatatacacacacacacacacaaaataactgtaaacttatttttatattatgtatatttatattataatttatatataatatataattctctatataatataatataatataaatatgtcatatacaatataaatataaattaatatatttatacaatataaaataacatattaatatattagtatataatatataaatatattattattttaatattaattatttttaatattaaaaacaataattttatattatatatacatttatacattattttatatctatatatctaaataaacatacaaagatattaaatataatatatcttttatatattatattatatatttatacaccttttatatataattttaatcttttatatacttatgtattttatatatattatctatagtaaaacctgttatattttataattttatacatatatatatatatatataaaatcatcttttgtgactctcaaagctcaaacataatgagataaaatcacgtgagaatgcgctgcgtgccgtgatgtgcaccgcttcagttctttagagggaaagtcctttgaaaacccttgtttattaaaacgttacgtagcaattgttccaacagtagcagtgtcatcacttacgttaactaacttcacagagtgcttatcaaagcagatttagtaaattagaataaaagtcaaaatagaaacaattaagtgaatccattaaaaacttaacccctttgtagacatagcctgaactgctagaggcatccagcctaggaaattatttgtggctactttaacagaccactactccaaatgaagggcttcatccctaagtttattcaataataaaataggtatatacacctactatgtacccacaaaaattaaaattttttaaaaaaattacagaacaggagtcagggaagacaatgtgttaattttggtaggggaaaacattttattattgtataaattaaaatgaacaacctagaaaatgagagtatgtgtttagtggatgatttttctcgctaagtaaacttcagaggacacaaaccaccttcctcttgttcactactgtattactagctgttaacgaaatgcaatgaaaatctgttgattgatcggtttattgatcgatcactagggagtataataagtacttccacctttgaaacactcttagtttaaagaggaaagtatgtctatcttttgttatgtagatataacagcaagcaaagaaagcatgaagggccagaatcgattcttgggtaatgaggaacaggctctattcagcagaaatggtttacattattccaaaagcacaattttgcatttagtgtaagatacagtggtaaaacattgagcttttgatttttaccgatagtgtaaacattactccaagatgtagtctctggaaataatttaggtaactcttatttttatatgcatgttctgttctggagacttgttgcaaaaattgatggaaagttattttgtttaagtgacagtttgtttacagaaattccttgaaatcttgatggttattgaaaagactgaaataaatgttgcctgaaactgcctgctttagggctactccacaccttccaaagtaataccatactttgttagtaaatcatctaaaatccataaaggtcatggagactgctccctttgtaaaatgaaatatttatgtttcaatcccaaaaacatattgtgaatcattttgttgttttaagttgagggtacatagtaaattattccagaattatggaggccaaatgtcattccctccaaaagtttgtgtaatatctatttatctgcgggcagatgactgctctgtataatcagaggcagactttgtcacgttaagtctaagtaaacacagctgaacataagcaagttggactacaaggtttttctgagctttgccaatagcatatgaccttggagaatgctgaattcttactacaatctgctttcaatggaaagaagaatttttttgtttcaaattaacaagtgatgattagaagcttgttatgttctaatttttagctgcaagacaaatgaccgtcacacatgcaccccaaagaccatctttctgagggagttaatcccatgttagggagctgaattgaaactgggaaggcgcgtgtggaagccaattaaatggagtctctttctataagaaagccttttttgttgttgtttatttgtattttgtgggtttttaaaaacaattttttgtctttgtgccatttcaacagattacaactgtggttccatatgccaatagcaagtgaacgttattgacgtattcgttcttcatgaagcatctgtcctccataggaaaggagctttgtgttgtcattaacttttggttttcaatagaaattctcattaacttctttgcactttccacaagtcccttttttcttctccttttctttttaacatacatgtttcttttcagtcactgaataactccttcttttagtctagtatgaagtccaatattaaatttttaagggcaccttgtggctaaaataaaactcctattaaatatttcatgtcaaaaggtgggactttaagtgagaactttggtaaaagatggattagtagagatttgccttgagacttctagcttttcaatattctctgactggctgctcgccagacagatcctctgttctttctgtttcttcgcttaaggaaactattactttctgcttcaccctttgggtgtacatttctttctgagagtaaatagagtatggattaaggatgtgtgactaataaatatttttaaataattcatctttcaagactggtattttacacttttttaaaatcacatgttgaataatattagctgagcatatggaaaaatatttagatatatgtggtaagatattatactgtggttagatttatataaaactcttattgattgattgatttacatacctctttttttttctatatgcgactgactttccacattaaaaggaatgcattgaggagaaaatatcaaaacaccctgtctttccaaatatgttgctaagtaatttcgcatcgcggttttctttttgcaaaaagctgcatcagacatctctgagtacatcaacagctacacaggaaggtcctgaaaacaccacatactctcaacacatccaaatcaaacactttatgtcctgcgtccttcaaagtgaagcttggccttcttccttgccccccttcctcagacaatgccgttgccgaccacccagtcacccaaggcagaaatctgagaaacatttcagactcccagctcccactcccccaactccatgtggtcattccagaagtctctcctgtaaatatctctcgaattttgcctttccatcccccctgctactcccttaatccccaggactcctcgcatctcccctgggctcctgccatgatcccgcctggctccttcaatctggtcttccaccagggcgagaggaatctttccaacatccaaatctgatcctattatttcaatattagtgagtgactccccatgcctgtcaggatagagttcactttccttatcttggcacacagaaccacaaacccctcaatgcctggtctctgctgatctctctcggttcattttccagctgccctttcatattctccatttatttcagctcaaacaaaaactcaaacactttcccagaggagtcaagacattgcactttcatacagctcatccctctccttgggctgcttctctccatctgttcatctcagtaactcctgttcaccttgacctcaggctgaggcattccaatcttttccatgtcttggcactcagataatgataaccttggttgggcacactggcaagaccaggacaggctgcctgctgctggaagcaattgcttggggtctcttccctgctgccccactggtatcatcttctttagagcaattttcatgaccactgcctccttatccctgccattgctccaacccccctctgttcccaccatacttactacaatgagctataccattcgttcaccacaaagtgagcttctttgtaatgagatccatttgcaatttgtattttgagggcctgtcacagtgcctggtgtacagcacacattcagtaaatgtttgctgaataaaccaatgaacctgtgaataagtaaacaaagacaacatggagaagagcaaattctgttacacttgaaatgagaagatctgacttccagtgctagccctattgttgactaacaatttggccttggacctgtcagtgggcttctctgaggctcaatttccacattataaattggggattgttttgaaaataatggaagtgtgcacaaataagaaatgagataaattgcaggtttatgacttgcaaaatgctcactaaatactgttattatcatcacaggttgtattaaggtgtcctggccctttattatatcaaaaagggggagaaagaggcaacattctgcatgcaaagtatagttttccatacaacactcacaaaaagataattttgttctcatttgaataatttcagatacattgtaatgtgattacacattccctatctaagtgccaggcatccaaggatggcaacaataattccaaggaaaattgaatattcttcccattcagcaaggcagggggaagaagttttgggattgtcagcctatttgtaaaataccaggagtatttgaaaacatatatacattcttgcaccagtaaatctgagaatttgagaataccaagtatactggttaagaatgaagcagtgatacaatttaagtcttttaggtaacacgtggttactttgtgaaaagttgtgaaaaggatgggtataacagttagatcctcacagaaaattcttaccaacagattagagaagtagcttttaaaaattgggaatttccaaaggtgtcacctacattcaaatgccatactcttcttgagtaagaacctttacatttaaaacttgtctccaagccattaagagtaaaacactgtcacatacctatatgattgagtgggtgatatacgtaggatgctagttcatgcaccagctctaaaagagaacagcagaagactagctgctgacataattttggaattagccttggtatgcacgttctcactctcggtgaagattccatcctaatgttttgcatattatggctactaaccaatttaagtgaccttctccaaggagtctctaaaactggaaactttgtaatatgcagcttgtgctcttttgagaattttccacactcaagcatcaatcatagacataacataactgcccttgacccagcttaggcaattcaaatacaaaaactattctggattgttgcattacttgttttctgatccatttcaaggtaaatcttaaaagtgtgctgtctctacaaaaacaatgtttgcagttgtggagtaattattgctgcagctcattgaatgttattgggtacccgtgtctgacagtgactattcctaattttcacgagagtaccaattgtttgctactcttatatctatttcacagatgagcagaaaaaataagactcagagagattaagtaacttgccccaaacctttttgaataaaatcccagcacaactgggattcaaaccccaatatcggaggtcccaaatctattatctttccagtgtaacttaccgtttgaggaatagagtgtggttaagtttgtactgattagcagtaaacaagggtgtttaattcaagataagcaacaacaacaaaaaaggcatgaatcctacaagaaagccgctttaggaattcaaatagctaataggttattatttttctctgtgtctttataactactaaagttagcatggaatttccatttgaatacttcttcaattaatcataaactcccagttctaaagtaaccttttgatacatgcttccagcccttgtcccacacagctctcattacccttttcttcttcagtataaaaataatcatctttttccaactctggcccactttctgttttttctattctctttattatcattatgattagtcacgtgaataattaattaaatgcatttttacctttagtagggcccttcctcatcccttatctctcctgtctttattcttctccatgagctcctaaaagtcaacataaatatagattccttgctcctttcacattggaagtatttttcattttatgtgcatcttcctgtccaaataagagtctatatactaagttgcctaacaaaccatctatcttgtaggatgatttttataaacctcctaaattaagctgaaaattggctggataatagaactggttactgagtgcatggaaaatatgagatttttttttttttctgttaagccttactgagcatctctcctttcctgtctcctattcttgtcttatactgtgggcggtgtaattaacattgcccagaggcctgcgacagtggctcacttcttcgtgtgtgttgtgtcatgccttgttttcagcttccactgtgggtggcctgggaaggagcgtttctccttctatgttcagtagatgtcttctgctcccttgggttcggactcatgtgcaaaccacatgtaatgcagacagtggcacgctactgctggccattaactgggaggggtctaactgggtagacattgaaaataatagaggatgtcaggagcaatggtgctgggacacattttgaggctcagaggtcctcacagttcctggtttcttgtgagaaaccattctgcccttgaatgcaaggctgggctataacaattactcttgcttccaccttctgagtggtggaaaagtaactagaactaccacacacctgcaggagcttgggactcttgcaaggaatggagggttttcctggctgctgttaaaaaaaaaaaaaaaggcaatttgtttgtgcttttatgatgaaaatatgtagtctgtttactcttgtgtacgagtgccaggcttttttgtatgatactttgattcaaggcagtaactactatctgtttctcattgctcattcaccatctagttctggatgcctggagagaatttagaattgggagattaaatttttttttttttttttgagacagagtctcgctctgtcgcccaggctggagtgcagtggcacgatctcggctcactgcaagctctgccttctgggttcacgccattctcctgcttcagcctcccgagtagctgggactacaggcgcccgccacacactcggctaatttatatatatatatatattttttttttttagtagagacggggtttcgctgtgttagccaggatggtctcgatctcctgacctcgtgatccgcctgcctcagcctcccaaagtgctgggattacaggcgtgagccaccgtgcccagcctggggatttaatttttaaagcactttggagtatgtgtagtatattccaaaaccaaacccaaaaagtatagataaatggatctggtttgttctggaaatgtcatgtttgcttccttttctcttttgcacagctttctgcctttccctctatttctgttgtttattttaaaactggtaagagtatgttagtggttgttaaaatattacatttctctctataattgtattagtccattttcatgctgctgataaagacatacccaagactgggtgatttatcaagaaaaagaggtttaatggactcccagttccacgtggctggagaggcctcacaatcatggcaaaaggcaaaaggcacattttcatggcagcaggcaaaagaagatgagagccaagcaaaaggggaaaccccttgtgaaatcatcagatttcatgagacttattcactaccatgagaacagtatggaaaagacctgtccccatgattcaattacctcccaccaggtccctctcactgcacatgggaattgtgggagctacaattcaagatgagatttgggtggggacacagccaaaccataacagtcatcaaaagatataacaaagagtagaaaagatgagaaaaagcagaaaattgcttttaatcccccagaagtattacattcattggccatttctctaaatcagtaacttttagtgactaaaacaaatatgttttcttttttatttataggtgtcttatttacttataaccatatgtgacatcagtaacacagtatgtatggtcgtttggcatttaaattcatttaaatcatatgaacatgccattcttttgtacttaaatttccatgaaatggccttgcaaaaacttttctgtgtattatacttgttcttgccttttcctggtaattattcagttcttgtttgggggtatttttaaacctaagatcatcatggtgtttgttctctctctctttccctttctttctttatagtttctttgattcatgcttaagtactgtagtttgaatgcctggtgatgcctacagaaatacctctcctgcatattacacttcttaactctgtagtatagatccttattgttttagacctgctatgtttaatttttggccattgggaggagtggtctcagcatagaatgaccccacaggctctgggggaggcacaagcccagctcatctctcagcacacacacagccaagagttgttctcagatctcaagctctgtccctagacatataggtggctttcagatggccaccgttagcagtttagtcctcttcagccctatggttccagaagctgatgctatgacattctgtggctgttcaaaagcaaagccatgagaaggcctagataggatcctctctatcctccatcacaattcaatccaggatcctaacctctgtgctctgcctcagtcgttttggttgagcagtggccaagctgttcgcctggtggatctctaccctagtccctgttcctctttagagaccatgtagctccagctacctcgcagggctgacctagaaataacagactaaaaataaccaaatactctgttcataaaacctcatcactatgtcagtgtataataaaacaatgctctgttctttttgaggcaggcctgaataaaatattccaagagcagcagaaactaagttcactttagtttataaaagcttattatcctaccctagaaagaaattctatgttaggttgaataattagtttctgatgattccatgtggaatactatttgtcaccttcctttcccaaaggaaagattaagaaaaaagtcaaagacttataaaaataaaaggccctaccagcacaacaattttgcactgggccacatgtttattttcaaaacagaaaacacagatctcataacagtatgtcattaccatggctattccagttagaagaaggagggtgatttgcatattctgaagtatcttgtaatatattacaatgaaaatcttgaattcctttgttctcaagtttgtattagtaataattctcccagatttatatgtcatagcctagcaaaaattgtaagaactgggcaaaagaaatgcaagtaaactgagatgttttaccacctcacctgacaaaaagaatttttagaggtattatatccatatttaagcaaagatagacaataaatagtatttttgaagctggagttaccaatttctgggcgatattttcttataaaagtgttatatctgctattcatatttaattagaatcaagaacttggtttattaaaacaggattaccattcaacacagcaatcccattagtgggtatatagccaaaggaaaataaatcattcgaccaaaaagacacatgcatttgtatattcatcgcagcactattcacaataccaaacacattaaataacccagatgtccatcaagagtggattggataaagaaagtgaggtacatatacaccatggaacactacacagtcataaaaaagaattaagttataacctttgcagccacatggatgcagctgaaggccatcatcctaagcaaattaacacaggaagaaaaaatcaaataccacatgttctcatttataaattagagctaagcattgagtacacatagacacaaagaaggaaaccataagcactggagactccaaaagggtggagagagggagagcaaaagctaaaaagctgcctatcgggtactgtgctcactactgagtttcaggatccttcataccccaaacctcagcatcacacaatatacctgtgtaacaaacctgcatatgtacctcctgaatttaaaatagtagttgaaattattacaaaaaaaaatcttggttcattcgatacaggcgtaagatggctagttggcccttactggaatattagaaatccaataatatatatatatttttactatgacaaggtaatagtgccttgtgctgctataccgtagtgaacaccaggaattccagcatggttatttactaaaacagtccattttgaatggcccacaccatagttctcatagggtagccccttcaccctcaacatcggaacacctgaggagcttgttcaagtgccatagctattacctacctgaacacaatctcagagatgggatccaggaaccttcccctttgaagacttccccagacaatttcattctcttctctagagcatcctaagaaaataagtaagaggcctatatttttccattctcacatggctataaagatactacctgagactgggtcatttataaacaaaggaggtttgatttactcacagttctgtgtagctggggaggcctcgggaaatgtacaatcatggcggaaggagaagcaggcaccttcttcacaaggcagcaggagagagaaaagtgagcaagagcagggaaaattgccttataaaaccatcagctctcatgagagttccctcactatcatgagaacagcatgggggaaaccaccccatgatctgatcacctctcactgggtccctccctcgacatgtggggattacaattcaagatgagatttgaggacacaggcaaaccatatcaaggcctaaggtatgacaggagagacccagtagggggcttagtacctttatggagcttggagtggccccttggctaacaaaggatgatttgcaccctgacttcttcaagtcagggagcagagtgccacagcccttcttatatgctgggcactgtttcaagagctttccatttaatacctcattttatccccacagcaaccgtacgaagtaggtgttacaatgatccccattttataggtgaagaaacctagatatagtgtgtgtaaataacttgcccaaggtcacgtacttagtgagtccactatgttcccacaaatccagtgcctcagacaaatactgtataagcaggtggttttggatctatgaaatgttttttattttcctcccaaaagatgaacttgttaggtttttgttttgttttgttttgttttgttttttgagatggagtctcactctgtcgcccaggctggagtgcagtggtgccatctcggctcactgcaacctccgcctccgggctcaaatgaatctctggcctcagcctcctgagtagctgggattacaggtgcatgccaccatgcccagctaatttttctatttttagtagagacggggtttcaccatgttggtgagtctgatcttcaactcctgacctcgtgatctgctggcctcggcctcccaaagtgctgggattacaagcgtgagccgccacacccggctgacttgttaggtttaagcaatttatcccttacttttttctagcaatatcttgtattctaagtttaggtggtaatcatggaaaaaggatctgtatgccatcggaatttaataggtgtgtatttaatagattaataggaaaggaacataatcagatgcttccggttagcaagagctgtccccactcacccacgtgtggcttccttcagccagaaccggttctccttggcagggaatctttctctaggagcagagtggttctcatttaaaagtaggggtgaccggtctcttcctttttttggaggctacctttcttcttggtttgggatgtacatccctgggcaaaatttagagtagatctcttggcaagatttaaagtggagatgagttatttagtgttcttttggtcaaaaggggtcatgggaggactgctagactaggggtgctctgtgacctctagctccagccaccttcccacgggcaaggagttttaccccgcctttatgcatggttcttttttaatttatacccttcgataccatcagcagaaatcttcccaattttcatttcaaagtataccttcaccccagtttaggctttaaatactgttcctaaattaaaagcagaaaattgcagaacctttaaacatagaaatgtgtgaacccagaacaccgacatgccaagtagagttttaaggtttaagtttattaagaacattgcagcatatttaaaatgtagaagaaagacttggtagtagtattcatcttatgtctaaaatgtgggggttttttctagtagtaaatacagcagatgaacagtgagtagaaaaactgccgtttgccgctcttgtgaagagccaagaagtttgtgagcgtcacctctctcattgtgtcatttctggtgttaatcagtcagacaggtttaacacggagatttcctagtctgaagtgtcatttctggagatggtaatttgaggaatttgaaaagcatggcaataatgtgagccaattcaaagatacactacagttcatgtatcaaaggaaaaatactttttgatggtttttcagagatactgaggagtttgaaaatagatggaggagacagactttccagccaacttctagatcatgaatgcacatttttttccatttaaaaagtctttttttgctgaagtcacattagtcctttgtagcctaacaccattcagctgtatatttattaaacaagtcaacccttctaaaactgcagtgtggtaactataaagtgaatcttgggagaaataacccttgggctatatagaactgaaaggatgaatatcaatattaagatgtggggacaaaattaagatttagctaagaagcactataaatgcatttaggtttcagaactagtagctcaacctgcatgtaaaaaggagtgcttttataaacaatgctctttgcaacatacaagcacacacagaagttattcatgcatagttaggaagtcattttctgagactttggctggaaatctaggtttcatggatgaaacactttgggtaacatctccaatattccccttgagaaaatgaagtaacaaaatccattagacacttaaagctaatagatattctttaatgtggctccaggtctctttgtcttggcatgttgtggtgttttggcacaaaggaccatcagaaaagccatttttgtctttgaagatgatagattctgcacacttaatccattaatctgagctgatgggcttttgcccagagttaaaatattttctccttacataatggttttcatattaaatcatcgaataacactaatttttctggtgactgcatttaattccattttctagatgtagaaaattaaagtgagagaggaggttaactttttctttctttttttttttttaacaaggacttccatagtgcttggtatatgtgctcaagctctcttctaagtgttttataaaatatgaactcgtgtggtccacataactaccctatgactctggtactattatcttcatttaataggtgataaagatgaaatgcagagaagtcaagcagctggccagcttggcacgctgatgctaagtgagagagcagaggtgcagctcatgctgtctaggtctagagtctggactctgaccattacactacacggcctctaagtctccctccagaccaccctcgtggtgaataccaagagccaagaatagaaacgagaatacttaacatttccagaccctctttctcatcccccgctgacactggcctccccatagactgcattcaaatcttcaaagtgaaacttcaggctgaacattttaaacttggggaagatggagcctttgagatcacagaggagcaatcttggaaagtgggactatgctgaatgagttagcatcaagaatatttaatgtgcttagtgaaaacgatcactgggtggtggtctgtttattctgaaaagctacttttaagttgcaagtcccgcttcctgcacctccactggcccagactgacgaggccagaagagctgtgcattttaccagaaaaaaataaacatcaggaaatgactaaagagccaccagccagggctgtagctccctaacataaggagccaagcagcactttcccacatcgacccgaggcattggtactcttgtagaaagaaagatgtcctattgttgttattaatggaattataacctagcctgagagcttcgagatatgaaaatatccccattttaactagggagctcttcactgttggttcaaaatagagaagtgtgggctgggcgcaatggctcacgcctgtaatcccagcattttgggagggcgaggcgggtggatcacgaggtcatgtgttcgagaccagcctgaccaacatagtgaaacccgtctctactaaaaatacaaaaattagccgggcgtagtggtgcgtgcctgtaatcccagctactcaggaggctgaggcaggagaatcacttgaacccaggaggcggaggttgcagtgaaccgagatcgtgccacactgcactccagcctgaacaacagagcgagactccgtttcaaaaaaaaaaaaagagagaggtgtggcttttaatttttattctctagcaggagctagttggggggactatgcattgacagaaaggcagttgaaggtgaggaccctgtggatccaggacatctgggtatcattagccatcatgaggggccagcccacatgaggggtggcagaaaggaaaataatttctggccagaatatggaagtcatggctggaagcaacactggctttatttttggaaaagagttggctgggcacggtggctcatgctggtaatcccaacactttgggaggccaaggcgggcggatcacctgaggttgagagtttgagaccagcctggccaacatgatgaaaccccatctctactaaaaatacaaaaattagctgggcatggtggtgggcacctgtaatcccagctactcaggaagttgaggcaggagaatcgcttgaacccaggaggtagaggttgcagtgagccgagatcacaccactgcactccagcctgggtgacagaacaagactgtctcagaagaaagaaaagacttttctcttctcttctcttctcttccccctctttccttccttccttccttccttccttccttccttccttccttccttccttcctttcccttcccttcccttccctttctttctttctttccttctttctttctttccttcttcaaattctgaaataatttcggatgcctctcattgtttataccccgaggataaataatttagctagtctattgtaagaagaaaaaaaatactaggtccatccatgaagatggggtgggtttcattttattcatttattatttattattcatttctcaccatttagaaagcttccaaagctctcctatctccagatccacaaaatccaggcttctaataactctttcatcttcagtagccttgatcttcaccaggctttagttgcagtctcttcctgtcatgccaaagttttaaagtaaaactcactttggtcagtgggactggtagaagagtttggtcatcagcaaataactgttatgggttgttgggtggtttttcttttcttccttttttttggcaaatatcacttagaatgatttctctttactcattcaaaagctctaactgtcccaaagagaggataaccacaaaaatttcctctgaaagtgacgcagcagcagctgcctaggaactgtttagcagttattcactcagggctatagaggagcggttacagggatatcacacttcgattagaaatcgctctactgggccgggtgtggtggctgacgcctgtaatcccagcactttgagaggcggaggcgggtggatcacaaggttaggagattgagaccatcctggctaacacggtgaaaccccgtctctactaaaaatacaaaaaaaattagccaggcgtggtggcgggcgcctgtagtcccagctactcgggaggctgaggcaggagaatggcgtgcacccgggaggcggagcttgcagtgagccgagatcgtgccacagcactccagcctgggcaacagagcgggactccgtctcaaaaaaaaaaaaaaaaaaaaaaatcactctgctgaaagtataaagaagatctcaagacaacttacttgaattccctattctacaatctggacagattccttgatattacatattaaatcataaggagaaaaaaatctggttttggtctctttgtggtctaatatcctagcaaaaagtacagagaaaagtttaatccatttttaataggttctgttgccataggctttcatatacaatgcattaagccttgccatggtctttgcaggtggctttattgacagaggttacttggataatgccatgcaggggttaaaaacatgaccttcagggccagggccaggggacctggcactgagtctcacagcttgcaaagatgcaagttcctggacccctctaagctacagtgtcatttgtaaataagggtggtggtgctgtcacacagggtcattgcaggcatttaaccaaataacatttgtatcgtttctggcatagtgtctggcatagaataagcattcaataaatattaacagcagcattagattctcataggagcgtgaaccctattgtgaactgtgcatacaagggttgcgcacttcttgtgagaatctaactaatgtctgatgatttgaggtggaatcgtttcatctcaaaccccccgctccccggtctgtggaaaaatcatcttccacgaaaccagtccctggttgttttaaagataattccttcttgcaacatttgcactgcttaatattcaagtttaagttggatgaagctggattttgaattctttcaggctgtttctatttcacaggcaaaatccactgccacactgggaaaggccaaggggtaaattattgtcttatttattaacaaaaggtaaggtgaacacagaagttcagtagaaaatgcaggttataacacatgtccagaattatgcctttttaaaaaatgtgtataatacttgtttggaaggccatacattcaaatgttaatattagttatccctgattgccccttattttctattttacactttttcttagattttctgcagggaagctgtattactttcttattaaagaaaaacaacaaatgctatatttatatatgtgtgtgtgtgtgtttgtatatatatatatttttttcttttttgagacagggtttcactctgtcacctaggcccaagtgcagtggcatgatctcagctcaatgcagccttgacctcctaggtttgaatgatcctcccacctcggccttccaagtagctgggactacaggcacacaccaccatgcctggctaattttcaaaatttttaatagacacggagtctcaatatgttgcccaggctggtctcaaactcgtgggctcaagcaatcctcccacctcggtctcccaaagtgctgggattacaggcataagctgctgtatccagccaacaaatgctatttataaaaagaaagaactgtatagtcactgtagaaccaatttgtagatgggtatggaagcccagcttcagtctccaggtatggagaagtagagatggagactgcagcaatgtgagcagggagccctggggattgcttgtgagccctgggggtcatttggtaaggcactgcaacttcacagcaattggtatttcagaatcttcagggaggttttatacctgccctactcaccagagtcttgttcttatcctcagttgttccaagtatgtgaataactccagaaactgatctggtatccccagaggctctctggacttctgaggtcagtaacacactagacgcaggctctgcacacctgctatcaaagtaatggcccccaaacttaataggtgtgcagaagcacagttttcaagcatctggagctctgacttgctttggatcattatcacaggccccggatttttaattgctctgcaagggcactaggccagtcctcatgagcaaggtgaatatagccatgtgttgcttaacagcagggaagtgctctaagaaatgcaagtgtatcatcaggcagtttcatcatgtgcgaatctcgtagtgtgtactaacacaaacctagacggcatagccttctgcataccgaggctgcatgctgcagcctattgctcctaggctacaaacctgtacagtagattgctgtactgactactgtaggcaatcggaaccaatggtaagcattaaaaatatgtatctaaacataccttcacatagaaaagacacagtaaaatatggtataaaacaggggcccccccatccccgggccacggaccggtagtggtccaggctgcatagcaggagataagcagcttcatctgtatttacagctgctcccccatcgctcacattaccatctgagctccacctcctgtcagatcagcggtggcattagattctcccaggagcgcaaaacctattgtgaactgcgcatgtagttgtgcgcttctttttcttttcttttcttttcttttttttttttcgagaccgagtctagctctgttgcccaggctggagtgcagtggcacgatgagatctcggctcactgccacctctgcctcccaggttcaagcgattctcttgcctcagcctcccaagtagctgggattacaggtgactgccaccatgcctggctaatttttgtatttttagtagagacggggtttcactgtattggccagactggtctcgaactcctgaccttgtgatccacccgcctcggcctcccaaagtgctgtgattataagcacgagccactgcgcctggtcagttgtgcgcttcttttgagaatctaactaatgcctgatgatccgaggtggaactgttttatcctgaaacgcacccccatccctggtccgtgggaaaatggtcttccacaaaaccaggccctggtgccaaaaaggttgaggaccgctagtaaaaaataaaaaatgatgcacttgtgtaaggcacttaccatgaacagagcttgcaaggctggaagttgctttgggtgagtgagtgagtaagtgagtggtgagtgaatgtgaaggcctaggacattactctacattactgtagactttataaacactggacacttaggccaccctaaatttattttaaaatttttttcttctacaataaattaatcttagcttactgttacttttttactttatacgctttttaaaaaaagttttgactcttgtaataacacttagcttaaaacacaaacacattggacagctgtatgaaaatattttctttatatcctattctataaactttttcctgttattaaaatttttcattttttatttttactttctaaacatttttgttaaaaactaagccacaaacacacacattaacctaggcctgcacagggtaaggctcatcaatatcactgtcttccacctccatgtcttgtcccactggaaggtcttcaggggcaataacacgcatggagctgtcatctctgataatagcaatgccttcttctggaattcctcctgaagggcctgcctgaggctgttttacagttaactttttttttttttcttgagacgtagtcttgctctgtcacccaggctggagtgcaatggcacaatctcggctcactgcaacctctgcctctcaggttcaagcaattctcctgcctcaacctcccaggtagctgggattacaggcacccgccaccaggcccagctaatttttttgtatttttagtagagacagggtttcaccatgttggccagattggtttcgaactcctggcctcaagtgattccccacctcggcctcccaaagtgctaggattacaggcgtgagccaccatgcccagctacagttaactttttaaatctaaggtgaaggagcacactctcaaataacaataaaaaatatagtaaacacataaacccagtaacatagtcatttattattatcaagtattatgtactgtatataatttatgtgctatactttatacatttagcagctcagtaggtgtgtttgtttgtttgtttgtttgttttgcgatggagtcctgctctgtcaccaggctggagtgcaatggcgagatcttggctcactgcaacctccgcctgcggggttccagcaattctcccacctcagcctcctgagtagctgggattacaggcatgcaccaccacgcctggctaattttttgtattttttagtagagacaggatttcaccattttggccaggctggtctcaaactcctgaactcaagtgattcacccgcctcagcctcccaaagtgctgagattacaggcgtgagccaccacccccagcctcagtaggtttctttacaccagcatcaccacaaatacatgagcaatgtgtggcatgaccacattacgatgtcactaggtgataggaatttttcagctccattataatcttatgggccactgtcgtatgtatggtttgccactgaccgaattatcgttaggtggcgcacaactgtaccttcttttattgttttaaaatatgagtggcttcctcttcccactcaaataatcctagtggtctgtctttgttttcccccttggccgagctatttcagtaatgatttctcactgactcatttacttccctttccatgatctcaaaagttttttttcttctactccctccattttaatttagggaaacatatataatttttggattatttaatttaaaaacctgaattctaagtctcacctcattttacttacgtttcagtggcatctgtgaaacaaaaacatttttccctttacagcttatttattaaattttttaaaaacctcagagaaaaagatttggccacgttttggtctctttttatggctacaaatataacatcaggaatatatatcagaattaatgtgcttctgagttgcatttttcacagttggccacagagctttttgcttagctatctcaagttgcattggaactgagttttctgtataattttttctctacttaactgtagaaggaaacacatgtccaaactgaggatagccccactttaagtttcaacatggtttgggttttgcagcatccaagattttcctaactacacaccttttttttttttttttcttttcttttcttttttggtcttaaaacacgctcttttggctggttcagtaagctgttcctgccaaccagttgcttttatggtaattgacagtgtagctgatttttggaaccttggaatctaaaaaggcattttagctcagactttggagaggctgagccaagctacttgcagagtaagagatatagccgagccaaatgtggggcagtcagaccctgagtctgtgcatgctaatgaactgctctcaagagtctacataccaggagctagctccaacttgcattttccctctttcacaacatgcacaatccttccctctcctgtctgattgtttctggagctactaggtgccacttctcgagtggagccggtgagaccacctgtcagcagtggacagatgtgtcaggacccctatgaccgccagtggtgggtacacagacccactgctcctcaaatactgaccatgagctgcaaagacacaacacacagcacacttgagccagagaagagctgataagtttttacttcaaagggaaagagcataagaaaaaaaaattacaacacttaatacaaccagttagtataatgagaagattgtaaattttctgaattcccatcaaatgatatcagttctctaaaagctgcgacatttctccagatttcatcttagcacaacaaatagaaaaaaaagaaacaactccccagactcccagatctttagagtccttgctttcctaaaaaagcacaaatgtttcagagtcaaagggctctgtttgctgtcttccttttgccgggttggctattctgggaaccagaacacgttactccacaggaggtggcacttggactcaaaataccctagtgacactgagcagcccaccagtaacagcctcaggaaaagcgtgcccttctaacatcaattcattttttgaactaaaatcactttgaacacagagactgcccacccccggcccttcccaagtggtggtaagcagcttttccttgttgatttcagtctttgagattgagctttgttgtatgcagttttcacactattctccattactttgtttttaatagaaattctttttttcattgtattattctttatgttctagggtacatgtgcacaacgtgcaggtttgttacataggtatacatgtgccatgttggtttgctacactcatcaacttgtcatttacattaggtatttctcctaatgctttccctcccccagccccccacctcccgacaggccctggtgtgtgatgtaagatgatttttttctgttattggagaggaacccaatctatacctactgacattgaatgtgcccgtctgcctgaagaataaaatacagaattcagtctattgaatcctgtgtagtacattgctgagatttgtaaaacccaattaagaatacctgaatggggacttgagtctacgtttttgcacttcaaaggtattttcataggcaccaaagtgtcaaacacatacacccaaagagtaagcagaattttataatttcacagttggctgcagtaaacgtgtttctcagtggaacaagttcaaggagtcagccacagggagtgctagctacagccaggagctcatggggctgcaagacatacaagttgactcctcatcttaaatagaagctctccgtggacctgagccgtgaattacatcttctccttccacgtgcaggctccatgcattgatggcattgatacattgacgggttctgcaacccataacatatttgatagccacaggctttcttcttgtctgtgcagtaaccactctgagattgacagttcaggtagggaacagggttctggtctccttcgcctatgtgagatggcttcatctgggagccagagtgtcagttacatagtcttctctaaattatgttttgttatttccctaacgttatttaagcctcacggaaattattctgcttttgccaagtctttccattgaataaatatctccataacctattgcttcactttggcaacagaattgttgcaatttgtgggcaaaacggagcaaaggcctaactcatttttttttcctctgtaaaatgtccaatttgctggctttccttctcccaaacgaaagccttgacttgttctctgttctggtagcgccttgtctctgtccttactgagtgaagatttacagataggagaatagaactcaataaaaaatgacttcgcagatactatggagacatgctatccatacacaaagtcagtagtagtaaataaattaggacacaaagtactcagaattgtgcctggcacgtagtaagtgatctgtaaatcagcatatcagagttctgtaaattacaaatgatcattcttttcctgcatttacatgagttactttatattgcaaaattatggaaagtagcagaggtatagctaagcatccaggctgaccctgtaagagccagaagctggcagagctgcagaaggtaacgatctaactgttcacagatccaattatttcccccaaaggatccctaaaaccttataaaatgctgcctgagtagtcagtgaaaggagaccaaaggaactaacacttgttgttccattctgggccagacacacatgatctcatgtgttcttcacaacaaccttgccatttgttcactaaatccttttgttttgtttgttcgccttgtttatttaagttccttacgtgaagggttgtgaaaagagctcagagtgacccatgattgtctcgtggtctacaccttaaggcttaactcaggataggtcagcaggctttccccattcttttccttcagagagggcatcgaagcttggctgcctcatgggcatataatttattttctcttgactatctcttcctgggaaattttgccctggttagactatatgacgatcatgttgacgttattcttctcagacctcttctagttctgtgactgtcttagagctcagaattggaaattaggttgcatttcctaactagccttgagcagtgcagagaaaaagaaattgtgagaaatattgggttggcaggggcagggggcgtaaaaggaagggagaggactaagggcaggaaaagacagttttgcaaaggccgtagaactagcagagggccttgcgttttccaggtttcctgtgtgcagcacagtgccaagtgcagtagctccccagtaacattgattattgttgtggatgatgatgacgatgatgatgaagaggggcttacccactatctggttttggagtctcaaccccactcctttgctcggatgccatgccagtagcctctctcctaccaccctacatctttcccttcagtaggtaaatttttgtgttactcataccagattcttttagcctaaggagcttgagaacccattttcgtgggttctttatatttatgtggtgttgggagacattcgtgttctgagtgaagcagcaaatctaaaccaaagatgtgagtgcagaagcaaaagctagcatcctaactttcatttcctgcagcagcaggaggaggcgttgttttggaaattgaggaccaatgcctgcttcttctaataaatatgccaggaaatcctgtattgctatcaccattgggtccgttactcatttgctaactagcagagggaactatttgcccatcctttgtctgaaataaatgtttgataactggccaggcacggtggctcacgcctgtaatcccagcactttaggaggctgaggcaggctgatcacgaggtcaggagttcgagatcagcctgatcaacatggtgaaaccctgtctctactaaaaatacaaaaattagccgggcttggtggcgggtgcctgtaatcccagctacttaggagcctgaggcagaagaattgcttgaacctgggaggtggaggttgcagtgagccgagatcacagcactgcactccagcctgggcaacagagcaagcctccatctcaaaaaaaaaaaaaaagaaaaagaaaaaagaaaatttgataaccatgaaattatagaatcattgagccagaagcacccccaagattttctagaaccccccccttttttattttaattttcttagagacagggtcttgctctgttgcccaggctggagtgcagtggcacaatcactgcttactgcaccttcacccccctgggctcaagcaatcctcccacctcagcctcctgagtaactgggaatataggtgaacacccaccatacccagctatttttatttttatttttagtagagatgaggtctcactatgtagcgcaggctggtctcgaattcctaggctcaagcaatcccccgccttggcctcccaaagtgctgggattacagatatgagccactgtgcccagccaaagctccctgattttatagttagagaactgaatccctgacattgtgggaggtcataatctgcccccaggttacactgcaagtgggtagtagggcaaggccagaacctggccccaggtacagtcagcactcttttccttatgctgtttgtctcctgatccaaaaggcccaatttctcagagtaaataacttcagatttttgtgtatctatgagagctaccttttattctttactacccactgtcatcttacttctgcccctttgcaattttttttgcatcttaatataaactgctttatctttattaaaagcgaactaattttcaaccatatttcctgaagaacttttacttctggtcattagtgatgaaactcctgagatgagaaaagaaaggaaaaacataaaaataattgaatttttgcttttctttacagacactctggaaaacggatccaataagggtgaaaggtgagcaaaatgttcccattggccgttcctgcttttcagcgatggcattttcaatgcaaactgcagtgagtttgatcgtttactttctgttttgcttaactccagcgcagctaacagaaaaggaccaagcaaggatgacacgtattggaaggagatcaacgcagctatggccttaacaaatcttgcacagggaaaggacaaactgcagggaactaccagctgcatcatccagaagtcgtcccatatagcagaagtaaagactgtcaaagtgccgctggtgcagcagttttaagagcttgttgcttttcagatccaatggatgttctttccggtgttttcatcaaccctcatcctaagagccgaagcagggatgaaaatgactctctcccaaacctcttcttatttttaattatcccaaatatatcatttagttgcttctataaaagacatataaattataaaaaactcattttaatcaaaaatattaacttattttatgttactcaaactatgcataaaacatctgcattaccattacagtaagtgccttgcttcccgacaataagctccaacgtgggcatagttgaacaagctatgcctcaaaatgccaacgccatatgcttattagcctgtgtgcatcattccagacgggcctaatcattccaggactgaaaccagaatcgctgaaagcccttgaaatacattcaataattcatatgttaaaacttggatatctgttcagcccaaatgaaatcttccttttaaaaaacgtctacattattgaaaattgttcaatgtgcttttcagagtgacggtgagaattttatgcatgtatcttgcctgcatatttgatatgttacaaacttccaaaattcaaggtgcagcgatccacagaacgttgtacatttaagaagtgattccttcaagctaatttaaaatttcattgaacacatggtgaccaggaaaactttttttcaagcactgttggaaagcaccacaaagccctttagaattaatctggatttgtttctcaagttctgctgaagtttaaaaaaaaactttattatacaaataactcaaaattttcctgtgtaaaactaaacctgtagttttaaaacataatcctgtttgcattagagctcactgtctttttgtgatggaaactgtgttcgtatggaatgactaaaaatcttttatttggtttgtttcaaattacaattgctgatggacaatttgtattgcagcgagaacaacagaatgaaagaaatgtatctctgtgcggctatacatatacatacataaaattgatttttaaatttaaaacatatggaaaacaaaacattgaacagtttgaattttgccaagttggacattaaagtaaaaatgaagtgaaatcatgcattgaaagaaaacattttgtttctaaattagtctaccattgagtgagaataatcaatatcaagaaagaagactatctttctcaactaaacaataatattccaatcagcttgggaagacctgaaacttgaataagcagtggaaatgccaaatataacagagggtatgtgctacagagaagtaaaaagggtttgactttttatgatgggattttttttttctgggtatgtaatctattttttttttaaactggaaagcatttttgtcagtgtgaatgagggtcaatagtgcagccagtggtgacatttttctttattttgcaaaatgcttttaaaaccaaaggctgctctagttgatggacagtatcagtcttgatctaaattgtaggacactttttcatgtaacataacatttggggattgggtttatttagtgtaatgaagataatttgatataaaaatattttgtgtatatatatatatttttactttgttttctaaattgctgtttgcagtaacagtaagcgcaaagcaaaatatataagttatgactgtatgatcagatgaagtatgagttcttttggtttgcatccttaaatagttagagatctctgataaaaactttggaatctttgcaaaacaatacaaaaatgccaaaatgtgagcatgtcaatgaaaactaaagacaaatacttcactctttttcatactattataagttattctggtattaaatatgttaataaaagtgtttttgttttgacatatttcagttaaatgaatgaatgctggttgtattttatttgaatgagtcatgattcatgtttgccatctttttaaaaaaatcagcaaatttcttctatgttataaattatagatgacaaggcaatataggacaactattcacatgattttttttaataccaaaggttggaagattttataattaacatgtcaagaagactttatagtaagcacatccttggtaatatctccaattgcaatgactttttaatttattttttcttttgctgctttaacattttctggatattaaaatccccccagtcctttaaaagaatcttgaacaatgctgagccggcagctgaaaatctaactcataatttatgttgtagagaaatagaattacctctattctttgttttgccatatgtaatcattttaataaaattaataactgccaggagttcttgacagatttaaaataaaagttaatttctagacctcg

SEQ ID NO: 599 - DNA, 23060 bp, Homo sapiens
gccggaccctgcgagaacgggtgggcgtgtgcccggtgggcgcgggaggggcccgggctgcacgagcgcgcgtgcgcgtcggaactggagccgcgggaggaggcgggagctgaggaggcggcggagggggcgggtcgcgtcgggcgccacgtccgcagccagaggcctccgcctccaccaccgccgccacagtcttccagctccacatcctgagaggacgcctctggagccgcgactgcccggggttgtgccggccgccgctgccgcccaggccgcctcagctctcctctgcgccggcccgctcactccgcccggccccagccctagcgctggccgcgaccccggcggtgagtgagtcgggatgcgagggcaggggcgcagtcccggcttcctgccctcctccgtcgccctctgccgtcggcgcccctgcccctcacctcccagtgcccggcctggctgcccagcggggccttggcgaggccccagcgggaaagggggaggggcgggacgaagttgggggcggatggaggttcgcttctggggctactcctccttatacgtcgctgactgccccgccgcgattggagcttgcgcacccctggaaagcctccgcctgacttcttagcatctgggggttcggggttgggggcggaggaggaaggtgaggggcatcagcagcctgggagagggatgcagcggaggggcttgggtaccgggcttcctcgccctgccaactcctgacctgttgctaaacctcccttttgggttcaggcacacaagactttttcccagtggacacccccatagctcttcctgggtaggaaggctgtatctccacgcctaacctaaagtaaaagtgggaatggagagggtgctggccgcgcccaggggtgacagggagggctggagcacccatccgtgccgtcactgcctcccagtctaaataaaaactgcctgctctgcacacgcagcttcaagaccgaccccccagctcccacttccaatcagatcgcctgtcctaaacccttcttacatagaaattctggagcccttcgggagtggggggagtgctgggtgtacaacgtggagcggagggaggaggtgccaagctcagtgctagccacggcgcctccagggtcattttctgcctcctgccacgtcactcactgctaaagaaaaaaaaaagatttgctagtgcctaaagggatcagtagggagagaaggggccacccggaagggtttagaaacacctagagaaaagggaagggttcttaatttgatttttgcgtccttgtgaacactgtgctaattccaaatgaaaatatttgctatatgtgattatttgctgtatgctattgtttagcctttgaaacttctgctggtgtgagtgccctcaggggttccccaggaatatcgatacaacaccaacaggtaaacgcgcgcgcccgtgtgtgtgtgtgtgtgtgtgtgtgtgtgtgtgtgtgtgtgtgtgtatgtgtgtgcgcgctcgcgcccatgcttaactttttaaaaagaaagggagaagtagcctttgataaacccatatgcatcctgttttgctttttccactttcatttctttagtctttgttagaacagatgtaccagaaaccaagttcagtaaaaatttgtccatttatagaaagcatcgttagaaattataacggttgctacattggacaaatatacagatttctttgtgtgtgcatgggtttgatttttttttttttaactacaggaaaatctttacctttgtttcagttattcggtatttgctctttttctatttccggaagatatctcactggattatatataaacatcttgagaataagacctttgtatgcttgttcacaaggatgcctcagtgcctaatagaatgtttgacacatagtaggaatgcaaatatctgttgaaataatgtgaagatggtttactggttctctggtttaatagagtattgtaattctgcttaatgtttcatttaaggataacccttaaaaattgccattttgacactgtcagttattactcgtctaagtgggcacttacaagttttactggcagatgaccttttcttccttgctagattgagagcatttcttgtagcctatttgctgttgatttaatgggcaggggccatctttaaaagcagactcttcttgatagttggtttaactagaaaaacataaaaacagtaagctggagttttaatgtactctgcttgttggtgtatatgttgtaaagctctgtatacatatatttttgaatctctttgcagttatttggcaaaaaagctaaaacatgggagtgaggatgtggtaaagttcttttaggtagaatatgtagaagaatttagctaattcatttatagtcgtctttttctattatagggaaattggcacctactgttgaataacaggtggttttaagtggctttgacaataaacttgtgcactgtattttgtagttaagctttatataacgtgttagtgttatttaacttcctttggtgtatagaggggtggtacccagaggaaaatttatgtactgtttttggaattttttattatgaataaaaattttatatatgaaatattactgaaacccacaaacaagattgattcatcaaagaaaacacgtttcccaagaggtgtttgtttacttatttctattattggaataaattaccctttagggaattgtgttgttaatccttgctcagtgtatttgccagctgctaaatctatgtgatactattgtactgggcaagaattatttctccccatctctacaatgcttaatgtaactgctgatgaatttgtagtcgtgatatacagtctacaacaaagaagcctttcatatgtcacaatttcttaaaaacccacttataaccagtttagttggtattgtaatagtttattcacacttcaggaccaaaaggtagaactgatttatgtctgtagaataagttaaatcatttgtacttatctaaagctattgtctgtcattactactttccttagaaaagtatgtgttgttttgtttttttggtagagatgaggtcttgctgtgttgcccaggctgctctcaaaccccagggctcaagcgatcctcctgcctcgacctttcaaagtgctgggattacaggcatgagccaacatgcccagccagaaagtatgtttttaatagaaacttgtgcattatgaggtcctagagagcagatatatttgtttcttgaatatataatttgtttcttgaatgattcactaaatggcaagtgccggaaaagtctattcccactggattgtaaactctggtttagagtagtgcctgtgtgtgcttaatcacactgaactcctaattgtgtaacagggtgcctgtcgcatagtagggctcaagtatatgttgaattaatgattcagtgagttcagggcagatagtttgtatagaatttaataattttaatgtattacttaagggtaacatttaaaaatggtcattttgaattttttcttttttgatatggagtcttgctctgtcgcccaggctggagtgcagtggcttgatctccactcactgcaacatccgtctcccaggttcaagagattttcctgcctcagcctccctggtagctgggattacaggtacccgccaccacaccctgctgatttttctatttttagtagagatggggtttcagcatgttggccaggctggtctggaactcctgacctcaggtcatctgcctgcctcagcctttcaaagtgctgggattacaggcccattttgaaatttttactgtcagttgatacttgtctctacatatatactctaaaattttattagtagattatttacctttcagagttttagattggggtctatttatcttcacagttcctactataagagaaacaggtctcctgcaatggtgataataagcaggatagtaatataagaagtatttctctttagtaacgaagtggcaatatccataaagaggtaatatcactaaaagttaggcacatatttgtgtgcaggactttggaatggtttatgtgaatgaaaagtacagatgacacagttaaggattttagcaaatacctttataaggtaactcagtgtcttatgatcaaattaggaattcaggaaaaaaaatctcaaatacttgtggctttttaattaattaaaaattagtaataatttttattactctaagagttctagaggaattttgatacaacatactggctattaaggtgtgatgtacaagatgcccaaacatcaaaacaaaactaatcttttttttttgagatggagttctgccctgtcacccaggctggagtgcagtggtgagatcttggttcactgcaacctctgcctcctgggttcaagcaattctcctgcctcagcctcctgagtagctaggattacaggcatgcgccaccatgcccggctaatttttgtatttttagtagagatggggtttcaccatgttggccagactggtctcgaactcctgacctcaggtgatccacctgccttggcctcccaaagtggtgggattacaggtgtgagccaccatgtccggcccttgttttttttttttttagtcccaatgaaactaatctttgtggcacttaggactttcaagtctttctaaatagtgaattcctctagtctaggatatgcctggcatggcaggactccagagttgctgctttcttgtttattgataatcctattggtaactactgctaataaattttaaatgcaattgaatatttctatataataatatctagctttttacatttcacactcctctacagaaatactcctaattttaggccagaatgaactcatggtgggcgtgggagtgggagtgtggttggactggcagggagagctggtaagtctgagaatatacccggaagcagccccaggcgagagtgaaatctcttgaaagtctagttatcttttaaaaaaaacacaatgctcaaagcacttttcatttcactttttactgtgtgtgaatttaaaaataaaacagtattttaaattactctagattaaatgcaggcattatgtctctcctgtgtattcttaagtcctaggcacaccactgcctatgtttaaaaaggtacatttggaaagcatgtctctagcttagagttttcttttttttaaaccccaaatttgggccatatattggtaggtatttcttcttgtgatgcttaaagtatatgcggatacttctcttcgcttcgcttcttttctcctctcttctcttcgtcctgtcctgtcctgtcctgtcctgtcctatcgtttgagacagggtctcgctctatggctgaggctggagtgcaatggcatgatcatggctcactgcagctgctttaaactcctgggcttaagcagttcttcctcttcatccttccaaatatgtgggactacaggcgtgcaccaccgtgcccagtcaattttttttttttttttttttttttttttttttttttgtggagacggagtctcattatgttttcctggtcttgacttccttagctcaagcagtcctctaacctcaacctcccaaagtgctgggattacaatattttctttttattctacttatcccacaaatactatctggcagcttacaacaaaaacatgtaccaacaaattggtaaaaatatgtaaataagatactcaaattgcaaaccagggagaaatagcaatccaagtagcaatcttgaggaggtgtggaagtgtggaggaagataggacacaactgtgcaggccacaggagcctacctagttgagctgggattttagctttaagcttccaggaagccaaagagaaggaagacatcatacctttgtatcttttaaatataaaaatgcctatatctttaagaaaacaggctaaatatttgggggaaacaagacattttctaaatagttacctctgaagaaatttcttatgtggagttccgtatcagagctattaagtgttgtagtgggtaatgtctttaacagtattgtacagttaatatagtaataacctgcataaggctgtttgtcaggatttccttacccaagacataactgtgaacaaaactcagtgataccattttcttaaagcatcatgtgattcaagtatgttgttttttagattattaacttcatctgtggctaaaacttagaataattaggattagatgaactacataatctttaaaaatatttatgaatattactgatttccaagacttgaaaatatgtatttttctttaattataaaagcaatacatttttatggtagaaaatttatagatgttaattaactatgcatatttctatgtgtaggtataaaaatactatatacaaatactatattatactgtgaatatataaatgctatgtatactacttcatgcatgtgtatgtaaaatgtaaaacttatgtatttctaaccccccccgccccctggcaatctttattaatacttcggcatactttcttccagtctttttgtatgcattttttaaaaaattgggcatgatgatatatgccttttacagtctctaaatatagcattagcatatttctgtagtatttgatcataaattattttcacatctgcataatgtatgtcttttggaagcctataaattcctctcttgcgttccatgaggctgtactcatttgttcattttcagatgtgttttgtttgtttttgctggcttctcttttgctcacctcttaaatatgagctggccaattaaggctgtcagtcggcttctcatcactcttttccttgatcatatcacccactgctcagagcttcagctatcacttcaaaccgctcttagaacctcaactctaactccaactttatgctgaatttctggccccttaaatccaattgcctgctgaacaagtgtggatgccctgaaggcatttcaaatacagcttgttcagaaacaagtccttcatcttctctcaaaaggtttctcttctgatattctctgtgttcatcatctctgtcttatactagaaatatgacattagattctccctttcatctcaaagttacattctacttctgacaaaaaattcaagtatatgagtgtcaaccatgcatcattgattaagtctctggtgatagagtagtgaacaaaccaagcgtttgttctcatggagcttacattttaattgggagagacccaaagtaaacagattaggtgaaaatgataagaagagtggagggtgctcatctattataaggtggtcaggggacatcttctgataaggggacatttgcagaaggacctgagccatgtacatatactggggaaaaggcttcgaggaaaggataaacaaggaactctgtgttactagactggaatgaacaagaggtagaatagtggagatggcggttaagtatttggcctcaaaggcaaaggtataaggactctgaattttattctaagcaaaataggaagcagttggaggatattaaacagagtatgacacgactggactgaaagaagaacaaaggtggaagctcggagacccattcagagattttgcagtagtacaagtaagagattatgatggcttaaagtggtaacagtagaggtaatgagaagtggttatattctggatttatttaggcaacagaatttaccgataattagatgggaatgtaaaaaaaagcagaattcaaaggtgaccctggcattttgtccaaagcatttatttagacatgaaaatctggcagagtttagactgtcagaaaattctatcttactggactactaaagtagccacttactgtattaatctctctgtccttccatctcttcttgcttcagttagcgtcttaaggcacagatatgacagtataactctgctcatgggttcttaatgcttatccacagaaggatgaagtcaattcatattatttagattaaactgcatctatcttatgctctcataaagcagaactaatttttaaaaattgtctttttcttaattacaagataggatatagaaaaataattgtttttaagggatactgtattagaaataaaaggtaagactgttggtagggatttatggggtaggcaccagaaagtcagttttgaaatatatgcggttacagtcataatcacacctatttttaaactccagttaaaatatgtaagatgtatgggtatatgtaatttcccatatttctctatagggtatggtaccttctgttgattgcccagccaagtgatctcctggatttgtgtctatgtgtatggtattaatatatagtactgagattaccatgatgaacaaattggacaaaggtgtctgtcctcttgaaattaattgtccagcagggaagtaagtggcttcaaaatcatcatttctcagaagggacacacatattctaccaggaatttctgcatgttttattttggaatttgttaaatagcattctcatcttagggttaaggctagaattgtctttgatttttattttaactatcctaaacagcaagtatttaatgaagttatttgtcctcttctatacagtttatggtcaagctgagattcaaactcaggcactctgaccccaaagccttaaccaccatcctgtataatttgttatgatcttaccatgatgataaatcaaagaaaacataaatgtgaatggtaataaatgaacctttgtggttggggagttttaaaattagggcacatccatcaagaacctcctttcccagtaatgcatcagctgaaattcttactagtttttctgtgagagattacttagctttactattactttttaaatcttatgtttgggatgatgtgctaaattctcaaaccaaaccaggataagattaggtgccattgataaatgacctgagtcaggattttcactagagcaattgaaagctatttattaaacacatgtgctgctggactcagtaggggtgcagagaagtgtcatcttaagtaggatttacgttttaaagtcataagaagatgaattccatgaagttaaaatcacctttgaaaattcccatttctcgcaacctctgcctctaccaccctcatccaagccaccaacattttttggcctagattattgaagttgtttcctaatgggactttctgcctctgctgttgttcacctattgcttgtattccctacagcagccagaatgatcttttaaaagatcaccttactcttttgtccagtgccttttactagtttcccatctcactcagttaaaagccactctccatcatcaccttcaagggcctatgttgatccagacctcactctttgtcttcctctcctactgcccttgatgcgaccctgccacactttactggctgttccttcttgctgatccaggtaagctcccacatcagggcctttgctcttgccatttcttcttccgcaaagactcttcacctaaatatcttgtatccttaccttctttgagtgtcatcgcagtaaagccttcacagactatcctatctaaaatatcatatcctctccccatccatccttggccgggcgcagtggcttatgcctgtaatcccagcactttgggaggccgaggtaggcggatcatctgaggtcaggagttcaagaccagcctggccaacatggtgaaaccccatctctactaaaaatacaaaaattagccaggcatggtgatgcacgactgtagtcccagctactcgggaggctgaagcagaagaattacttgaacctgggaggcagagttgcagtgagctgagatcgcaccactgcactccagcctgggcgacagagtgagactctgtctcaaaaaaaaaaaaaaaaatcacacaaaaataaagtatcacaccctctcatccatccctttttctccatagcatataaataccactgacatatagtcctctctttgtatttattttgtatttatttattgcctttccccattggagtatccatttcatgatggcagagattttttccatctgtattgatatatacatatatatatattttatagtaaattttgaattctgttaactgcctctgttcataagagctttaagaacagcaaaaagtcatcaaaattgatctgttactgattcagattggtggtgtcatcattacaagagagggatgtcttttttttaaggactttctcagatagaacaccttagtatttatttattaactttttcaaattttagggtcaggagtacatgtgcagattcattacgtgggtaaaatcgtgtgttgtgggggttgggtgtacagatgatttcatcacccaggtaataagcatagtactcaatagatagttttttgacccttactctctttccactcaccacctacaagcaggccctggtgtctcttgttaccttctttgtgtccatgtatactcagtgtttagctctcattcataagtgagaaaatgcggtatttggttttctgttccagtgttagctcacttaggatcatggcccccagctccacctgtgttgctgcaaaggacatgatctcattcttttttatggttacatagtgttccatgatgtatatgcaccacattttctttatccagtccactgttgatgggcatctaggttgattccatgtctttgttattgtgaatagtactgtgatgaacataacacgtgtgtggtagaatgatttatattcctttgagttatatctagaaatgggattgctgggttgaatggtagttgtgagttcttttgagaaatctccaaactgttttccacagtggctgaactaattaacattcccattagcagtgtataagcattcttttttctgcagctttgccagcatctgttatattttgactttttaataataaccattctgtctagggaacaccttttttagttctggtatacttttttctttaagtctattgtgaaataaattacaattaaattaaccagtattctgtaggaggaaacaacatttttgtcggctaacccccaccttccagctctctttcagtgagtaattttcagttgtagttgaagcaccacagtaacaacataggaaaacttatactatgactgccactctttggtgagtgtttcacataagatttatattgtctactggtataatttaaagtatttattaaatgccgcagtttgaagtaggagagaaacaagatgaagactagttgtatagtgggtacaaaatgttgtttatctgaataatgttgatgaaatcgcaatttagcatgtgataagaggtagtctcacatgttgaggttaaaatgaaatgtgtttgtatgttttttttttaggagatcatgaatcagacagataaaaatcaacaagaaatcccatcataccttaatgatgaaccaccagaaggtaagtatgcatctgtaacactaagaatggaaaaatatactgaattaaagttctgatagtttttattttttacttattttattttatttttttttgagacagagtcttactctgtcaacccaggctggagtgcaatggcacgatcttggcccactgcaacctccgcttcctgggttcaagcagttctcctgcctcagcctcccaagtagctgggattacaggtacctgccaccacacctggctaattttttgtatttttagtagagacaggggtttcatcatgctggccagggtggtcttgaactcctgaccttagttgatccacctgcctcggcctcccaaagtgctgggattataggcgtgagccaccactcccagccctgattgtttttattaaagaaatataacctgtttaccttgtcagtaaatatgtccccaaaataattgaagataacatttttagcttctaataagaaagcatagatagtggtgaatagggacacaattttaccatataaggcataatattttgctgtcattcttcttttaagaccattttagaagtataagtatcctttcatttgtaaagggtgaggatggatacagaggaaggatggactgtgtttagttttgatatcctgcatacaaaatcagcctaatgcaagaggcattagagatctgttgttaaactcctattattcattatattgtaattggtacctctcctctattaacacatgatcttgggatctgcttcatttgtctttttaagtcataattctctttgagtttgaaaattgtgttatcatgaatcattttaattcttcagaaacccttggaaacacacctgaatgtcctgagtacatacagaaaatgactagaggcatgtttttggtatagactgttactaaacttaatccaaatagtgatctccttggagaattgcatgttgattactagggctggaggttgtgactctaggtattatatattttttcctagttctgttacccattgtctaaaattttcttcctatatttcttttattggtaggcaaaaatgaaattgctaggaaaatagcaacaaagggtttacacttaagccataaagaattcaaaagaactatcggagattgcagtgagctaagatcgtgccactgaacttcagcctgggcgacagagtgagactccgtctcaaaaaaaaaaaaaagaactagctgattaggtttagtttagtttggtggaggaatagcctggaaaattactaactcaggtcttttccatgccttacatttttaggtctggaaccatggagttttgaaaagttagggctcagtgagaaagttaacaaggactttgtgagaaagaaatcagaaaagggataaataaaggccatccaggggcatgattgtcaaggaagagaacaaagcagaatgtctttctatgccaaccactaaacaagaggaatctgcaaagcagataatttatatggtgataattaagagtatactgtaataaaagagatcagctgcattaattatttatctgacttgattaagaacaattatttgtcttctttaaatgcatgtgtaccaaatttggcatggcaagatagttttactaatgagatatttggcatgaggcagttatctgttgtagcctcaaatcaggattttgccttttttcttagggctagtgacctcgattacagaattaccaattatgtaatcctttccatcataattttataactaatatattcaaatgcccatctatatattaagtcttttacttcagtcattaaaaatttgtattaactatacttattaagtagttttaataaaaatatttggtttttaaagtttatagctattgctgtatctgtatttatgcactattttgcaaagatattttgactagtcagtgagattttcccacttgtgataaaatgtaaaatcttcagacaatgaaaagaaaaattatctcaaggtaaatttgtgccttgtgcattggaaagctcagttttcagaattttttattttctccatcaaatattgtcagtttccccatgataccttctctgagaacttgattctgctagaatctaatagttttggtgctcttagttggacttacgtacccagtaatttacccctctttttcagaagtaaagcttgaattgtgtaagtaccaaatatttttccatgaagtttagaaaaacactaatgcttatgtgttgttgctgcttaaattattaggttactaggccgggcgcagtggctcacgcctgtaatcccagcactttgggaggccgaggtgggttgatcacgaggtcaggagattgagaccatcctgactaacacggtgaaaccctgtctctactaaaaatacaaaaaattagccgggtgtggtggtgggcacctgtaatcccagctactcaggaggctgaggcaggaaaatggcgtgaacccaggaggcggagcttgcagtgagccaagatcacgccactgcactccagcctgggtgacagagcaagactctgtctcaaaaaaaaaaaaaaaaatattagattactaaagagaaaagacctgtgttcactgtgttcattttaagctagtgcaaatttttatgaaatctttctgctagtcattttattcctaagtttgagcttacatgctaatatatgtggctctatttaaaaaaaaaaaacaaagaaaataaactcatgacttagagcttaatttttcatattgctattgccttttatgggggatatctctagtttttaaaaactagatacttaaagcacacactctctttcataagaattactgaggcagtaattttaagtgttaaccatatctatagtttctctatcctacttatgtctgaataaaaatgattttttaggtagataacacgattttaaatgatgaatagttttttacttttacatagtattagctctttaaatacgtcagtaagggagacatagagcagagacccaaatgtatttacttaataggggttcttaaactttttggtttcaggatgcctttacaatgtcaaaaattgaggccccaaagagctgtgtctttgtcaatatttaccatattagcaataaaaactgagaaatttgaatattttatgcattaaaagaacccatattaacataattaaaatatttttatgaatagtaattctttcaaaacaaaaaaaattgtggaaattgtgagcaaggtgatactggtttatacattttagcaaatctctttaatgtttggattaatgcaagacagctacattcttgcagctgcttctgcattcagtctgttgtattatacatcattctgcttctggaaaactgctatagactcatgacagaaagtgaaaagacaaatgatattttaataatattatgaaaatagtttttaccttgtagaccccctgaaatggtcttcggcatctgtagtggtcccagaccataccttgaaaactactgcattttacgaagaagattgtttcggtaatgactgattaaatcctatcaaggaaatgaaggccaaatgtagttatctttttattttttcatgttccttttaggatgtaaaataaaggttatttgttaacaaaaccgtaaaccaaggaaacatttaaaataggattctgttttacaaaagttgtctagtctctaaagcatttcttctcatagatactaagacttagcattggaccaagatattgtaaaaacatgtacaactataccctgaaggaagagctcttcagtgtctttgaatcagtgtggttggccttatcaaatcaacctcctgttgtgaggaagtcttaggttacttaatgatgtgtactgctcttttaaagacttgtgacttatatttgattgtctcatgatattttctctcattaggttcaatgaaagatcacccacagcagcagccaggcatgttgtcccgtgtgactgggggtatcttcagtgttacaaagggagctgttggtgccaccattggtggtgtggcttggattggtggaaagagtctggaagtgaccaaaacagctgttacaactgtgccttccatgggaatagggctggtgaaagggggtgtctctgctgtggctggaggtgttacagctgttgggtctgctgttgtaaacaaagtgcccttaacaggaaagaagaaagacaaatctgactgaaatatagagatacacttgcgctccacagcactgtaatgccagtggcattgaattgctaaattatggactacaaccaagtcaactgttttggacgtttatcttctaaactgctgtgttgaaagtattgatgactggctttcatctaaaaagaagagaccaatacgagcacagtatatgaaggtttctcatacttaagttccaggtttttatctggtaaaatgttacacttactcggttgtaactgaagatatggtatgtttgaatatttactataagtctttcagtttgactaaaaatgtgaaagttgaatttagtagatgatcttcacagttccatatgtataatgtgccaggtaactcacctgccccttaagaagggaaccttgaattacataagccgtacctttgatgtgcctaatagtttcagatgtcttagttttttataaccatagttgattaggccaagaggcattcatttcttatttaagctggcaaaattagcaggaattagagaagtttaaaaagataaatggttttatgataatgttaaccatcttttgttagtaaatatgcgttctattattttaatcattgatgccttacaaaagaaaacatcttttctaataccctgaatatgtgctgttcttagaatcatctatggattcttttaaaggttgtttgtgaaattagttttccctttttagaatctcaggagtagtggggtaaagacatttcctgctgtcagtggataagacagagcttgttaactgttttggcagtagttaaaatcaaattgtacacttctcagcctgggttcatgcttcatcattaatacacctcacagtgcctaaggaacatttacttactggtcagaaggtattttggaagagtttcatattaaggaggaacaaataataattttaagttcttaaaaattacctaaaacaccccaaatataaaaagaagccttcacacctattctgtctttaggatgtcttaaattattagcagtactccttttttaaaaacactgtaaaagtaaccacaaatatgtgaggacttactattttaaatggaatggaatgagctccatagattagttttgaatataaagtatataaaagtgcatcagtggtttatataggctttaaaaacatgttatcttacagtcctttaaagcagccatagagtttgtatcatttttcaagccaatttcagtcagggatttgaattgtttgattatggatgataaatgtgtcatatcttattaatatgtctcatgtctcgttccttcttaatatgatttagctggaattcattttcttttcgtttcatgtttaatttcataaaacgtttaacaattggcatatatacttggcattcctgtccaccaaggattgtaatccaagcctgggaaaatcttaaatttctttttacttaaatctggaaatttgtctccattctgccacctttttttttttttttttttatagtggaggggaggaaaggggggtgataccttgcagtaagtaagtcgaaatagcatgcctgaaaatttgaaacagaccattctaacacccaaggcttgtttataaaatacttgagaattacattaatgtggaatcaacagatgcagaagaatataacataacttttaaaagctttcataaataccagcagcaattgtaagcaaatctacaaaggttcttgaacctttctattatatacaaaactgaaaagtcattaaggagttcaactaatcaggaattaaatggtcatttatttcatgcagtatgatttaaggtatttcttgagattctggtcaaatgtcataatcagcaaacgggattaaaaaaaaaactccaaaatcactaaataattatctaaataatggtattggagaacttgtttcctgctatttggaagagattgttgcttcattgctagtttgtatttctaacttctacagttatagactccactgtgctttgtgtctgaatttctcagtatagacattttgtttactgtatgcttgcatatttattttcaactttgtttgtctttaaaattgcttgaggaaaaatggttgtaattaatttctgctacagaaaagccacctggtacgttttgtctcatcaggattgttttaaattctaaactataagtttgttcagaggggcttttgcaatgatagcagaaaactgtacaaatgtacagttagttatagaggttcttgttgaaatgaacttaccatctgatgatatgtatgtacagctgtgtacttgagtcttttttagtttacttagaaagactagcagtttgacctgttaaacaggactagttcaagtcaagaaactaaggttgttgtatacacctggaggcatctgttattcagcttatcctttgagtgggtatttggcacaatgaggataaacttatgtgacccacttgaatggctgatctaataatgttgacattatgcattctgtacttagtgaaatgtcagatgaaaataactgatgaataatttttttgtattaaagggatgggaaaagaacacatgaatttgttaataaagcactatgatctgcaaacgatggaatgtttcataaagatctaaagaaataaaggaaactttaaaacagggtgatcttaccatttttagttactttgcagttcagaaagtgctgtagccagtttaaaattttttttatagtaatgtacaaacatatctttggatatgtattttgatgctgacacaaccatgaaatacaaatatattttaagcaactctaataataaagattaagagtgtagatttctaggttttaccccaacttgccaaatctctgcaaggtggggcccaggactgcattttaacaacctctctgggtaattcttgagtacaacaagagtactttcaaacaaagtttgaaaactgatggattataaagcagggagcacttctgtctgttccaagtagctgtggaaccaactgagacatctcactggaaagaaatgactgactaaaaggggtggggaggagtgtagaaaattgatatttactgggcatctgcttacctgccaggtactggccatacttctcatttaatcagcatgagggccttatgaaggaagtatcattactctcttacaaatacagaacaggctaactttcaatgttagttgaattttccatatcacttttgaattagtgtaggtcacaacttctccagtttatgtccaggaacagaaatggggctactcagtaactaggcctttattctagtgttgacattcagtgcagcctgtatgcttgattgaccaggctgtctgacttgcagcttaccggaagtctttcacgtgaccatatttactttggtgaccacattttgctacagcaatgaatttagtgtgattttacacaaattgaagaaaatctaattttgttaaagagccttttttcacagaggaaaccgaatttgactctagtgttttatgaaagggtatctccccctgctatgttactgattttgaatttttaaaattctgtttcataggaagatctgagttagaatgtatgaatggaaaaaaaaggcaaagcagaacaatttcagaggttcaagagccaaaagcaatggaatggaccctaagggaaaataaagtcagtatactgcataattgattaagaatgtaatcttttcaagttagagtaagctacaattgtatttctataactgtaactacttctggttctctgtggctagatctgagcacttaaattttgctgcgtattgactagtctccttttaaattaatggccacaaagtacacatggtcagactttctaatatgcccttttattgtatgttcgctttcaccctcctcaaaatgactcaccgccacccccgcccccgagacatggtcttgctgtcgcccaggctgcagcacagtcgtatgaacatagctcactgcagccttgatcttctgggcccaagccatcctccccgttcaccctcccaagtagctaggactagaggtgtgtgccaccacaccaggctgatttaaaaaaaatttttaaacatttttatagagacaggatctcactatgttgctcaggctggtctcaaactcctggcctcaagtgattctcctgcttggcttcccaaagtgttgggatttcaggcgtgagccacagtgcctggcccagaatcactctatagtgtgagccaattatttcctttttgctaaacccattagtcacttctctgtgtcttagtcgaccccctcagtggcttcattattattggccatgtccttgtttcttcctgggaccaacttcttgctttgaccagtctttttccaggcttggccaaccaccctactccaaatctgcactttttttcccccaggcagtctaatctagagccatggctttaaatatcatagatatgcagatgatccccaaatatgtattttcagttctgactgaaactcaactccagacttagccatttgcctgtttgacatccctgctaggatgtctagtaggcatctcaaaattgacatctaactaccaaggtaaccatatcacatataatgtcttcccaactgagacacttcagagtgaaagagcaagagcgcccctgatactttgtcaggacaagaagcataaactgaaaactccaagcgtttcctatcacacttcaaatgagattctgctccttagatggacctgtgctgcctctttcctcttgtgccactctcccaatcactcaaccctgctccaactgtactggctgctattcttcttgaacaaaccttcctgcatgaccttgggtaagtgacttaccctgagtctcctcatccatagaagagtgaacaatggtactttagaatcgtaaagcacttatatacagagctccctataggaagtgaacagatttggatagtaagggttacttgcatttgctgaaggagtgaagagtgaggatactgcctgcattttccataattttttcattatacttaagccatgtacaaatagtgcacagatgttgtcagtcaattgtttggctgtgcatttgttacaaagttcagacttcacagctgaaagtgagtcagttctttatctgggtatgtttatcttggaacaaggttcagaaatggaaacttgaaacaccacccctaaaattagtactaaccatcacccactttcccttacaggcagacctggatcttcagaaagttttctaaaaagctccatttatttcaaatgtatataaattagataattttgaattagaacactttatagagaggttttcataaatgtccccgaatttgttgttagtacttattccttttggcctgtcaggtaggggtgacttctcttatgccaattcataagtaatccttccagttcacaaggtttaaacagaagtcagagcccagttaataaacccagactctgccatttggcagctgagtggcctctcagcttcagtttcctcatgtgtaaaatgaggaaagtaatgaatgcacatggtgttttataagagttataataatggtcaattctaagcaaactgaccacacaagtaggctccaactcttctttttggatgagtaatacttgattctcaaagacagtaatttattccaaacacaagatgaaattttctccaaaaaaaaaaaaaaaaggtatagaagtttgctaatagttcacataacactaagctacagaattcagaccacagtagagtgatgtttcatggctagtagtgagaaagactggatttgcttcctaacatgaaatgtggtgtatgaatataaatgtatccataccttgaattaaggaagcacttgtccatttcttagaagtgattcacttataaagtatcacactgatatgccatttaatagtatatgagtttttgaaataatggttcaaggtaaaagttaccaaccttattaaaataaatatgatttatattttataatatggcacatgagtcagaatttatctatttagagataacttaaatacaacacagaagctaagcaggttcttaaaattactggtgtctacaaactgcctgaatttttgtctttgctagttagtttcaccctgcactgctagaaagaagcaacaacagtcagtatgtcattcttcaacatttaatggtgccacagggttaaataatggccttacttttttggcctgaattttgccaaaattagcttcaaactctttttttgatccatttagatttgctagatgtccatcctttattctgtagcctgaggaattcagtttccttatcctgtactgtactatctgtggtgttaattcaagaaccattggcgtctctcttatctgagctatggaaattccttctctcaataatccttgcattctctcttctaaaactggaacagaataatataaaagggcaggacatttcaaaactaattgcttcaggtcatgatctgtgcatttaaaagcatttttagagaaggaaatactattctgtatacttcttgggcaaagttgaaaaagaaatcctttgagtttggatagaagctggagaatttcaaagctggtgaaaccttgctcctggagaaattctagtgtttcctttatagctgtgggagaatttaacaaaataaatgggttttggcttaacaattttagtagccaaactttcatgttggcctcagagccacctacatctagataactctcttggagaattcttaccatttgcttattcttctcaacaggattatgaaaaacattaggtgcagctgtcaaaagtctgctaatgaccacattttttagtcccaactcttgaaagaactgaacattcagcttctggttctcttggtctttaatagtaaagaaagattctggaaactgctctattaacttgattaactcttcctcatttttgcagaccaactgccagagttttctctgggtgttaacagcggttggactacagacaattgcttccgggcagcgttccaaaatactggctacagcagtctcatcggcacctagttcttgtaaaatattcgcaatttcttcaacataggtttcatcctctaaaagtacccatccttttaatctacgaattttcctaatgtcaactgaacatttatagagcttttccactgttcttgtattttctttgctcgactgtttatcagttgtataggtgaagcatgctaagaaaggtctgtattttggaggtgatcgcatctttctgaaagaacacagcctgcaggactgggatctcagcagcagcttccacaacatggctgcaatctactagctagtttccaccgtcctgggacttaaatggactcattctatctgaaaa

SEQ ID NO: 600 - DNA, 7822 bp, Homo sapiens
gcctgcgcgcgcgtgcgtcgtagccgaacgctgtggcggggcaggcgaggcggtcgcttcgagcgcgctagtcagctccctgaagggagtgacggcggttgggtgcccgcggccacttttgccttcccgggtaagtgcggcggtggcggttggcgccgccggctgacgggcggcttcctgggagacggggagagcacccggcaggcccgcctgagacgtttgaggctcgcgggcgtcactcctcaggggcgtctggtccgagccgggaggcgttccgctaagttcggtgcccgcgggcaccagccggtgggggcttcgtccgctttgccgggtaggagggcggaatgtggggttggtacgggcggggagagccggacggggccaacctggaccacgtcagccagtcccgggtgactggctcgaagtagcctcggagttgagaggggtcgaccggggcagcccgcggcgcagccccggcagcgcgcatttgcggagagaacggatcccgtgccccgagcgccgccgagccccgcacgcccgtgagacccgctttgaattttctctccatgtttgctggggttgttgacccgaccccccgtaagactcggactcaacgtttttgtttgccccacgacagccagcttaatgctgtggacgtaacagggcacgaacgtttgtaactgaaagttgaaggggctgtggcgtctccgtcccgtggcgtgggaggtgatcgcccagcccttgtgagtagttgtcgtcctagaactccgccgaccgcctagccggtggagccggcgctccggacgccactagagctggcgtttcgtgggcgcagcacctctagccggtcatcttcaccatcgccattgagggcactgaggccgggccaggcttcaaaccctgccctctctgaacctgaagccagagatgaaaacccagacgacagtggcctggcacggtggctcacgcctgaccccagcaccatgggaggccgaggcgggtggatcacctgaggtcaggagttcaaaaccagcctggccaacatggtgaaaccccgtctctactaaaattagctgggcgcggtggcggacgcctgtaatctcagctactcgggaggctgaggctggagaatctcttgaacccgggaggcagaggctgcagtgagccgagatcgcgccgctgcactcctgcctgggggacagagcaagactctgtctcaaaaaaacaaacccagatgacctagagcaggttgcttggggattgcattatggggcattttccgtgtttctgaagaaaaccagcatgtgtgcagctgccgtgaagaacacactgtgcatcgtgaagtctgaaaagaagtaaagcagaccgggagaggtggcaaacgccttgggatcccaacggtttgggaggccaaggcagggggtatcgcttgagcccgggagttcaagaccagcctgcgaaacatagggagaccctcgtctctacaaaaacatttaaaaataataagcgggcgtggtggtgagcgtctgtagtcccacctactcaagaggctgaggcgagaggatcgcttgagctcaggagttcgaggattcagtgagcttatgattgcgccactcaattttccggcctgtccgccggagcgagaacctgtctcaaaaaaaaaaaaaatagggaagcattctaaattaagatagtggttgtttacatgcatctaaatttactccttcatgaagtttcactaaacttacattaaggctatttaaaaacaaacatgaacctccagcaatgggagaataggaaaggaaacgctggcaatcaaatagcgggctccaaaacatgtatggcttagcaaaccctgtattaaccacagaatcttcaaactgcacggaaactggcagcactggacagcggtggtactgggaatgaaggtggtgtggtgcagaaggtgggtgtaaggagcttaaagaaagatgatttaggtgaaatctgagaagcaattggatatccagatccccttccccatttcacctgttgggtgactgcctttccccttgttagaagactggatggaggcttattctcttgagaaagtaaaacagaggatctttgaactgagaaacccaggcataattgtggggctgcatgtatgaagatagggacactgaagcttgaagtctttcatctcctttgtctcactcaacttccaaaacttttgcagtcagatcagactaatgctctccaggctgaaataagagaattctacacgctcacacacacagatggggaaaggtacataataagttgcttatggtggtttctaggaagtgaaaggaacttggtggttgggggaagagtgtgtggaaacttctgtttacattgtcttttaaaatgtaccatgtacacacgatacctattcaaaaatgaaatgtattcttcacctcaggaagatctatgaaaaacatattctgtaaattatgaacaaatactttgacttctgtttacatttttttaatgtaccgtgtgcacatgatacctattcaaaaatgaaatgtattcaccttgggaagttctatgaaaaaattctgtaaaaaattatgaacaaaccctttgacacagcgattccttccccaggaatttatcttataaatacacttacatcgtgtgaaaataagtacagtgctatgtggaaggataagtaagaagcagataatattggttacctttggagaggggaatctgatgtcaagtcaagagtggaatgagtgagactttttcactacatattcttggtaccttttgaactttaaaccatgttattgttacctattgaatgaatgaataaataaatgttaatgggaaaaatgggtgagtaatggagatcctgatgttggtaatgtcttaaacaatacaagagctcttaacataggaaggaatgctgcataacaaccccaaaatttcagtggcttacattttatgctcatggatcttcagatcagctgttggtcagatgttggttagactagtctggactccagacttcagttttgggttcagttctgttccgtgtgtcttcattttgagacccaggctgaaaatgcaaaaccacctagagcatgtttttctcatggctgagggtgaaagttcaaaagggcttctggaagtttgccatgcctcagctcagaagtcacacattgaaatgtctacctacattccattagttaaaacaagttacgtagccaagtccaaagtaaacagggtgaagacatatatactctgccttctagcagcactgtgaagttccatgacaagatgtggatgggtaggcttgggaactataatgatgaagaaaatgggttaatggaaagatgctgaaaaattaagtttaggatagttggtttagaatgaagattcttacaaaaatgtgtatttatacattttacattaccatattttgacaagatacagcatcctactttgatatgaattaccttacagtttccatgtcaaagtatcacctttgttttatcttctataacatctaccaaccctgcacctggccctctaaccaattctgagtgcccgtagaaaaatgtacatgtaaagacaccagattttagggaagtaattctaaatgtttattttagctactgaatgtgttcattcatagtttttgtgtcatatccatgtctgccaactcacctttcacaacagaatcttcttttcagggagatgtcctttgcttctcagatgtaaatgcactttaagtttgttattcaacagtgaaaatgagtcatacagaggtaatattttcgtatgttctgcatcttcagggttcctggttttttgtttgtttgtaattatgtggcttcagagtaattttattttcaactttcactgtgggaggcagtatagcataagtggttaagagcgaggaatctagagcagactaccctgagtttaaatcctagctagcggctatataaccttgggcaagttacttaatctgctgtgccttatctataaaatggggataatgatagtgcttgcctcacagaattgttagaaaagtgaaataagttaatacatataaagcacttataataatacccgacacagtaagcacttaactactattattaatatcactactttttatttggaggctatgacttgaattatgagcctcacagagcaaacatatatatagctgttcagttgtcttaataggcaagaaagtaatttttgatccctttattctcttgaattccaggttaaattaaaaataccttttggaaataaattactagatgctgtttgtttggtacctaacaagagcttaacatatggaataattcttacacatggagcatcaggagatatgaatcttcctcatttgatgtcactggcatcccatcttgcatctcatgggtttttctgcctgagatttacctgtaaaggccttaatattgtacatagaattaaggcgtataaatcagttttggtaagaaaatttctttatatttacttataacagaattctgtttgaaatccttaataaatgtaagataaattttattagtcatctggtttaatttaaaaaatctttgaatgagtgtattcttagaaaactcagcagtacatgaaagctttttagtcgtcagatttcccttgtcatcagtttccatggagatgaatgcttacatcataaatgttcctccgtgatattgccaaggaagctacttatgatttttctccctggaattatgtaactttagcacatcattttggcattctagaatatttcatctaccatactatgcatgtataaatatgatactgttttctgtatatgttatttagaaaccttgcttaaaatcctggataacactaaagtttctctaaatcaagcttgtccaacccatgggccacatatggcccaggacagctttgaacgtggcccaacacaagtttgtaaacttacttaaaacattatgagattttttttgcaatttttttttaagcttatcaggtgtcatgagtgttagtgtattttatgtgtggcacaacacagttcttccactgtggcccagagaaaccaaaagattgaacacccctgatctaaataatttcaagcttactaataagttttttagaactttagatgttaacattatcaaatttggtattagttggaagcctttgctggcctttttaaaaaataattctctaaaaaatagtttagtgcttaaatattttagtaaaggtagattgactttttttctcacatatttgcctgtattacctaacatgtgatttaatagtgaaggcatgaccagaagaggaaggactgcttacttcttttaagaaaaatcccttaagattttctggttatctttgcatagattttcatacatttcagtaatgatgagaaacaatatatcttgcctttccagtggaatattttataggtgaagaactgatgatttttttatttttctagaattacctgaagacatcaggagaatacaaacttgcaggtgtttttcttggaggtaagtgcaatacttgtgaatacttgttaattacctgttttaatataggaataggtaatggagaattaaaattagttgatcataggaagctaatttaaggattttttttgttgttttggtaagtcacctttttaatgttaaagcactttatatacttagagcaaacttgaacctcatgtatatgtattataatctgagcctctctccttttattcatatccctgaatcatcatcctgcatatgatgattcctttacaatgattgtccttgtccttttaagtgttctttagaaaaataattgccttttatttttttagcatttaagatcaatttttagctttttttttgagacagagtcttgctctgtcacccaggctggagtgcagtggcgccatctcggctcactgcagcctccacctctgggattcaagtgattctcctgcctcagcctcccaagtagctgggactataggtgtgcaccaccatgcctggctaatttttgtgtttttagtagagatagggttttgccatgttggtcaggctggtctcaaactcttgacctcaggcagtctgcccacctaggcctcccaaagtgctgggattacaggtgtgagccaccgtgcctggcctggtattgcaacttgttaattgctgccttttggagttaatttgttggtaaacagatatgatgaacagtaaaagatccaatttgccacaccatcactgctactttatgtgaaagtttatatttcaaactgaacttaattttaattgattttaggtcgttcaatgggctcaagagcagctgcttctgtaatgtgtcacattgagccagatgatggtgatgattttgttcggggtctcatttgtatttcttacccactgcaccatccaaagcagcagcataaactcagagatgaagacctctttcgtttaaaagagcctgtactgtttgtgtcaggctcagcagatgaaatgtgtgaaaaggtgaattataactcaatgtttgtgtcaatgaaagagaatgaaaggcagacatatcttgggagcaagatacttctggcaacagtgtcttttaaaaattgctaatttgactaatgctagttttgtgtcctggttactctgttgcttttgagaacctaaaaatataagtatagtgacaaaatttgtatccctggaaatagagttggtaaatatgacccttacttggaaaatgaaggattaatatctgaatcatctgattttgggattactacactatagatttttttaatcatttcaacattcaggcagagtatttgttataaaattgattcttgagaaagggttggcaatgtctacacattactaaatattagcccaatattatgaaacaactttatattccccagggcatataatttgcttgggaaaaagatttttgggggaagaaatttttttattccaatttattttacattttattagtaataaatgcttgatctgatactgctacagctgagagaagtggactgccacttttacggacatttcctcacacattctattacctagaaagttgtctgagaaagcatttaatgaatacttgggaatgaatgccagtataggcaggggagagaggaccttttattaaatatcaacagaacattagtctagtatcctcttctttttctctttagaacttgttggagaaagtggcacagaaaatgcaagctccccataaaatccactggattgagaaggcaaatcattccatggcagtgaaaggacggtcgacaaatgatgttttcaaagaaataaatacacagattttgttttggatccaagaaattactgaaatggacaagaaatgtcattagttaaaagccatgttatcttgagtacacatacagttaatttgataaagaagagtatgcctctcagcattgtgagatatatttcagactaatttgatgttctttaatgttcccttatttttgaaacacgttttaaatgtgaaattaatgtccttcacaaaatgtcttttgaaagcactgttacagttgtataaagatgatgtaaaaatattgaaggtggtctacatataatttattttcattagtatagttaagttttgaaaaaaattaaacatctgaattttgttacaaaaaggtgcttttgtcttattgataggcaactgagaaattttgcagagcagcgttatcttcagaaaaggaaaacattatggttaatctagtcagagatttatagaatgcacacatctcttcacc

SEQ ID NO: 601 - DNA, 181009 bp, Homo sapiens
aaaaaaaaaaaaaggaaaaaagaaaggaaagaaaagaagaaaacccctcttctggctccaggaaacaagcttcaacccattgcacacaccggagaaggggtttccccctgcccgcccgcccgccccccaactacctccccgctcctgccagtgtctgcctctctgcccccacgggggtttatttgatctcacattaaccaaggaggagaatgtgagaaaagggggaaaatgcccaggaggaagcaggagcagcccaagcgccttccctcacgtaagtcatcccttctccacctcctctcgtgccattttctcgccctccctctcctctttcccctccgcagcctcctccgttgttttctgcattagtttagggttacagaggtgaaactgacaaagacacagcccgggttactcctcgtttaggtctatgctgaggcagccatgttggtgatgatcagccccgtgccctttctattctctctctctttttctttctttctctcaccccccccctttttttccttgagatcgggcttttttttccctttccctccccttccccctcctcactctgggttgctggggggagggggcaagagaagggaggaggggagtagtgtggatgccgggggttttatcgggggtttggtggggggaggtgggagaggttggaatcttaaaaaaaaaaaaattccttgtggattccggcgcctgagggtgcgggggtcggggcgcgcggagggctgggggccgtgacatggcgtttgggggtgtcggggagagggcgcgcagcagccgccgggtacaggatccagggagaggtccgtccctggctaaaggttgcgccggggttggtcggcccccgagccgccggcggcagcggcggcggcggctggagcaggaggaggcggaggtggaggaggcggcggcggaggaggggagtcgggggcgggcgaggcgggagcggctggggagggtgtaggggcaccgcacacaaacacacgggtacacacgcgccgccgggcggctgctcccgcggcgccgaggcgagggggcgcgccggggcgcggggcggccgggcggggggcgaggccgggcagcggcgggcggatgtggggtgcgggagctgcgccgaggcgaaggcaggaggcagggcggctcgcggcgcgcgaggtccctgcagagcggaggagagggaggagcagggctcctggccgcaataaaatgcggggtcagtcggagcagacggagccgggcgagactcgggctctcagaccccctccttggcgagcctgagcagagtccaggactaaagtgcatcacagccctccccggcggcagccacacacgccaactggagacacacacccgccggcacggcccggtccccttcccctcctccacccgcgcccccggtccctctccgccctccctccggcttttctttgcgcgactcttaacttttcccccactccctctccagctccccccaaccccccagtctttctccgctttgagtgtttcgagatgctgctaaagctaaaagtgaaggagaaagaagcaactaaaaatatcccccggggccgcccggctccttgaatgcagggaagagggggcaggggagaaggcgtggggcggggtgacggggaggaggggacgcgggaggcgccggagggaggggtcgggggagacggagggtcaatttctcttctctccccccacactactcccctctcccggcggtttggcgctgctcggagcccgatcctgcaaaacccgggctgggggcgggagtggagccggagcgcccgcccgcccgggtgtcaggccgacgtggtcggtcacctgaagttcacggagggtgggggaagggttaaggttatggtgtctcgggctcgggctgtgtgtgagcttgtgcttttccgctgcagacaggcagggcgatcgatctccccctcgcgaaataaccgcggcggtgcctgcccaggggaccgggaggggggcgcgggctgctcgggccaggcgcccccgcgcctccgtgtcacccgggccgcagccgaagtggcgagcaagggcacttgcaagcagtccgctccgcaaacattcctctttctttccccttcccggtacgcaggagtcgacgcaaagggcttgggttgtgcttttttccccttcctttaaaaaaaaaaaatgcccctgtgcagtcctttcttcgcctgcccgctagaggttctgaggataatatcacatatgtaatatatatgcacataaaatcactcgcaggcggctgcgtgtgtagggaaattttgtgcgaggaaggagaaggcggtggagtcggggagggcgagttgggaggctccgcgctgcgattcacagaaaactcgcagcagttggtggaagagtgtgcgtgcacatggccggactgccccgctgccgggctcttgtcgggggcgtgtggggggagggagaggaggcaggaatcctgagggggtcaggggaggtctgccgtgcttggacaaaatgggcttcagtgttctctgcgaacttgcccttagatggcaactttgggagctgatgagcttgtgtgcgaaaacagggcggtgaggttatttggtcattttccctttcttctcttctccccctgctttaaaaaaaaaaatgttggcggggttagagggagggtgggagaggagaagggatttatctgtttcgtctgtgacggagatggaacgccttccctcctcttgtgtgtagtgcagtcgggcagctgcagcgtgccctgctgatgaccttgaccctgacctcctgcgactaccctctccgtctgagaggaaattcaggctccattttagctcgtgtgcttggtgggcctttcctgcgcgtcggtgcctggtgatgaagttatattttcagagtgggctctcctactttgctgtctgattgaatcctgttagccactcacttaaaaaaatatcacctccctctttcagtcacataaagtcacttttactgaagtaagaagcaattacctttggaaacaccgtaaaagtccctgcagttttgaaagggaggccttaattttctaagcttttccacttacctttgcattgaatggatttttgtggatatgtgttgcctgtgctaagtgtgttttgcacatgtttttaaagcagtttgtgtttggactttgcaatttctgggcaaatggtgtattttgcagttcaatcacagtcacccaaggcttgctaactgctgagtgaggcttgaaacttgcaagtggtgtgaagtagtaattattgactttgggaaaaattagtgttaatttgtatttaatgtcgaatataattgtagttctaagtcccacttttaatgctagacactttgtttgtttgtttgtttatatgtgagaggaggaattctttttcactggagtactgttttgtatcaaatttaaaatataggaagtctggggattaaatattcctcctagaagtcatctcagggttttaagaagttaaataggggcagatttaaaagttgactctaaaagaaaggagtgtgtaacggaggaggagaagggagatcttgaaggaatgagaggggcaaaactgtttttgaagccaaagagcccttttgagtaaatacaaaagaggttaatagccactgttaatatattgttttaagaatctgtagaacctgtgaacacatttaagaagtgcaaattagaatacaaaaaaggaacttatgaaaactgaatctatagaaaattcggagggctttccacttcctcttaggtctctccctgtgtctgcacccccctaaggattctacagcataaagcattgctacttatagactctttctgtgttggatctatttttctgatattaagtacaatactagccagacacagtctggatctacaaagcccaaagtcctcccactacacagcacagacaccagggaacctggaagttccaccctggagtggattagtcctggaaatccagactagcacttggtattatctgataccaagtctggggtgagcctcagcccctggcacagagtcccagcaattccccagtctgagctccggcctgctaaggtttcccagctccttctgttcagttagacacccatgggactgttcagaaccgaattagctttggagatgggttagcctttaacctgacactactaacctaagccttaggtttctgatttaaaattctacacagccatttcctcctgggcctctgaagtaagtgtgtgtgtttgtgtctgtgtttgctttgttatatgggccttatacatatacagaaaaagatggcctatactgtagggttgaatggcgatcttactgtctataaatcaaaagaagtcctgtattaacttctgcaggtgaccctaagcaaagagtattaaacctacactatttttgaggggtggttttaaaaattattacacgagatacagcctttatttcttggcctagagcagtaattatcattttgggatttaaatatgattctactgttgttgatggctcttttacaaaagttctttccattaacaaggtccaatactatatttaaaaaaatgtccaagaggccctttgagctatatcacctgcttgtctttagcagaatcctgaactggataactttaaaaagtttgtcagcctaagaaaatggaagagtgggtaactgtgtggctaactgatgctgtgaccgttaccacgcatgggactgggcactttatgaacggttttacatttggaatcacaaactgaagagggaaaggatgaggaagggtgttctcttgtttttttgtttttttttttttcaccattggtgatcacttatttcttcattagcttcagcttacacataaatatatacaagtttagatcctattatatttaccattggaaatttacctgatgcctattcccgagggggaacacaaaggaaaagttaataaagcagttgttttgttattccagtattttcattgtttactcagttgtgggtcaagaccagatcaggttattgtgttcttcattaacaaaactttttaaaattctttcttgctttctagtaaaattaggaagcaaaatgactgaaaagcaacgggatttcttatttttatcattttaccagtctttttatgtctaatgaaagagaaagaaagattgaactcttttctcttatttacttttattaatttttgcagtgactgggcagtacctcctgactaactgtggcagggaccacgtgagaaaaaatttgagtctcaagtagcaaaatatttcactgatcctgtcatccagagctaatgattccaaggtacccagaagcagtctagattgatgctggataataatgcctatctgttctctaaaaagaacatccctgtattcctatacagtaagtagggtatcactgagctttcctgttaaaataggaaagataactcaaaatcacattccttctcatgcttcaaaatagtttctaataaaaacattgatttttaatttacctgcatgctgccatctcactctggggatgacacagctggtgtgagttgacaagtcttgctgcacaaagtgttaataaatcatgctggagaggtataaattggacagctttcggccagtgttagagcttgctgtgcatttgagattttagagtctgaatggcctctattaggagagttcgaagggaaatgtagaaaatctctgtcttgtgaggcttgtaaaatcagatggacaaagactatgggcacacctaagggaaagtgtgttggtggagtgacgatgcaggcttctcctgaggtcagaagttggtttaaaatacaagctgagcgcggtggctcacgcctgtaatcccaacactttgggaggccgaggcgggtggatcacgaggtcaggagatcgagaccatcctggctaacatggtgaaaccccgtctctactaaaaacacaaaaaattagcagggcgtggtggcgggcgcctgaggtcccagctactcggcaggctgaggcaggagaatggcgcgaacccgggaggcggagtttgcagtgagccgagattgtgccactacactccagcctgttcgacagagcgagactccgtctcaaaaaaaaaaaaaaaaatacaaggagttctattaatgtcaacatgttcttgtagaaaaggctggattggaaatgtatggtgcctggctgggttggtaaactagtttacttaagtaatcccagtagtttgcgttcggattctgtctggacaagttagtttcacaaaagagaaaaactctcatccactgttattaaccctggtcacttataagcaaattggtatctttggacttaaagatgacaaggtgtctcagaccgttggctgctataacaaaatatcttaaactgggtattttataaacagtagaaatgtattgcctacagttctggaagttgggaagtccaagatcaaggtgccagcagattcagtgtttgctgagggctcaatctctgcttcaatgatggtacctttttgctgtgtctttatatagtggaaggggcacacaagctccctagggccccttttataaacgcactaattcctttcttgagaggtctaccctcacgatctagtcacctcccaaaggccccatctctaatactatcacattggggattaagtttcaacatgaatttgggggggacaccaacattcagactgcagcacaaggtgtgagagagggaaatgatggtggagcccacattgctatacctgtttctatggctggtcaacagtgccatctgtgaaagctgaaggcagtgtatttctgagattaggttaatatatcctttgtccccttttgaagttgccatgtcttcctccattcttcatttttaaatatccactgtagtattaggacaggacaaggaaaaacaaacagagtaggctggagctaatctctccattctgagtgatgtattggtaattttgtataatttaatcagactgatcacagaacaagataatcagagtatgacctacagaatagggctttagggggcgttaaggatttccagcataaggttttacaagaacatgagctttgtggcgaaggcatagattttaggttttctcttattggaaaaaaatccaggccaggcctagttatggtaggatgtgagctttttttcatcagatttcataactatattggcttagttaatgtactcttagaaccacattttaaaggtatagattgtaaatgatggtgcctgtttctgagatacacttttctgtctcctgctttgccaggtgtagctcagtaattcattccatctagggctaagtgtacaacactttatagttcatggtagctaaaatgtcttctatcatattttataagagaataatgtgtgaagcacagaccttagaaatagctaagagtacttgatgggctgacatttctggctgctttctcccttctgtttgggagtaagttttttgtatttctgtcctctctctgtaagttattttttatgatattggagaatagtgtgtgactaggtgctgaggcaggggcctctctgatgactcctgtcattccccagggacccaccttgggctagaattgttgtagttacaaagtagtttcataaattaaaatcagactttggcttgatactaatcttaaatggcatgggtacatgttgctgtttattttttaaaagttagcttcactgcatgtacacacatgcgcgcgcacacacacacacacgcacacacacagagaggctgcactgtagctaattttataaaatgcacagtgatacgcgcccacgatctgaggtcagaatgtggcctttagcaactctgctttcacagtctgacctagggttatactaaatgcagcaaattcagtgtgcctaaaaaggatattgtttccgactgtccattcccttcttataaaaaacagcttttactactgaagttctgtctctggagttcttaagtgaccagggtttagatacactttgcttctgtttttaagaaaatcctaattcaaccaagtttctctaccagcaaggaagaaatgcatggaccttcttggaggccagggcctgaaaaagcaaaccctaaaataacctgtctctctatctctttctctttggtcatttctacatgggtcggaaaagtggttagaccccattagaattgtgatgtgaagggaaaaagaaaaggggtgagagagagatgtggatctcagggtgaaatgttttgagtgtgctgaagaagctggccttcaaaggagactgaagaaggccaggaaaaaatgatcttttacatgattgatcagtagcactctgcttatctgagcttttgaaacaagctactgtgcttgtggagggtgatagatgtttctaaggttacatagtgctagtatcttaggtggtctggtgctgtattttaaaaagcttttgttgttgttttgtaatgagagggagaaagtatcatctgtgactgtgccctctttaactttgtctactgtgtatggcacaactaaagtagaaacaggattcatgtgctttcaaagttcgtagggcagcagtcaaacgtacaaactctggggccaggctgttcagagcccagctttgccactgactagctgtgtgaccttgggcaaattgcttatcttccctgtcctccactttactcatctttaaatagtggtaatagtttctgtatcacagagctattagaaggaataattgaatacatatacaaatgtaaatattatacatatacacaaaatcatgcctaattagtgcctgctgcatagaaaggacttaataaatattacttattattaagtatgtgaaaggtgtttcagtttgtttagattgtgaatagattacaggtatttctgacctggaactttttggtggtttctatggtttttttttctcaatatatctcattagtgtggtgagtaataataatatgatatggtaaaattcttttacaaggctattattgtagggcttgactaatacttgtttcataggccaacaatattatattaggcttttactacaggaatgagtttctctgtttatatgatttgacctgaattatatctaagttgtgtaataatcatatgcattataaccagattttactataaagtgaggatactaaatcctcctttagacacttagagtgagactcaaattagagaataggtattccataaatatttatttattcttctgttcaacaggcagcccactggttagagtaacacagacgaaatttatattaggtgttccatatgttacataggtaatagtttatttacacagaaagaaggaaaggcagggtctgctgtttctaatcacagagaaccaaatcaagagaatacatgcaatgaatcttaaatgaaggatggggttgtgtatatgtgagcacagtgggaaagagagatcatatcgtaggttacaagctggtgccatagtaatgtgttttgccccacacagatactgtttaaaaacttgagacaacattttggaaatcggaggtttcatataaaaatccaaatttccagcttcctttgaaaacttggaagagtcactcgcactgggcccacctccccacatggcagcaatctgctgtagtcggtggcggctgtctccattccccaggcatgtgctcgtcagtctgccacagttcctgccactcggccaccatgtccccatatgcatatacacctgcccacctccctcaggtatcttacctcctgatccctgtaggcgtttggattagaaactgttctgcattccccagcattctttgatctttccattcatcactgactctcaggtgttgtatagcacatttgatggcagtatcaagaagccgtatagtaatccctatcctagcagcaccacattgcagccgtgacacaagcgagttactgcagttatctgcctgtttttctcatttgtgaagtgggagaccattgtaggttctctgagactaagtcagcctatacacgtagatattttagatttgtgtctggcatagggtatgtgcacagtaaatgctggccatattaacacacttgaggtgtgaattcatgtcaactgaggattgcttgaactgtattatgtaattagtcaaggaaaactattgctgtccgtcagtttctgatcaccatcagccaacccagtggttctcaaccagatgtattagaatcacctgggagatttttaaaaaatacaaacacccccagagatttaagttgaattgacccagagtggagcttgagcatgaacgttttttaaaagctccctgggtgatgtgattcatttgcttaatcccgagttgaggacccctgaactaaccagaactcccactctgggatgttatcatttcagtcaaaaataaagacaggagatggtgagcctggtcagcttattgatggtattttttcaggctcttaaaaccctaaaattagctcgtggacctgggtaatggactgcaactcctcgaggttggaaaccagagagactgatggaaggaatctacagtaggcaggagacacagactgcagtcttctcccttaaactctcccatcaccaaggtttttcactggctttgtgaccttgggcaagtcacttaaccatctctgtgcttaagtagctccatcatgtaaaacggaaaacagtacattactcaaaccttctgtttgtattatgctttattcttcatgaagcactttatcatctgcctgtgaggtgggcagggaagggctgcttctcccactgattggacagaagtggacacagacccagagaaaggaagaaattagcttgtagtcaccagtgtcagcactaccaagggctggaccatttgatggtctcttgagacacagtgcagctgtaggtctgtgaaatctacatgggatctcacagcctgaaggagatggttttggccactataaattgcttagagcctctccactacaggagaaccccttaggtgttgatggaacgtgatggccccatgattcatgaaaacctctgctgccaatagtatttccctcctcaaagacttaagatctgagttcatctcagtcttatcaaatcaaatgtatcttccttctaacttctaccctattggtcctactctctgttttctgatcagcacttcataagtttatgaaaatacttttcaagctgaattttaattatttgtttccatctctttctctgctcacttgtctctgagctccttgagagcagggactaagcagagaatagtagaacggagtcacatgcagtgacactgtctgaggcctgaattatgtgctccatatggagagcactgcctttgcgtaatggcctagaattaggcggcgttttctaatctgcacttgtttggccgtacttgttaacccaacagtcctctctagagcatgaaacacagctgtatttgggaggaaacaaagtgtgggagaccctacgctccaggaaacgttactgaaatgtgctatatgatttctcccttctagaggaaggcaaacttcaaataataacttactgggttttaatctgaccttaagaaagtgagaaatcaaattacagtgagctgctttgtgacatttatagaaagagagaaatttcacaatccagaagtagggtttgggttggctactagatcgtagttagaagtgctgtgcacaaatggctactcacatacttgttgataggtgaaaaaatatgtgcagaagaagagaaaaagtatgagaagcttaaacatgacttgggcgtactccataaggctgaaaccatagaaaacacaaatattaactattaatttatttttaaaaattgatattggcttttaatgacaaaagtagtatatgcttagtataaataattaaactcatgcgataatgcttaagtatgaaagtcccctcatcccaacttccacccccagagataaccactgttaatcaacaattaatatttaaaacttggcctttatttgaaaaattggtacatttcagcatagttggctaaaagaatttaagtatggaattcagaacaagggtggcaacatcactcttacaaactgattcaacccatctatagtattgaatcccagattggttgcactgatttaaagggagaaattgataaactgctcacaagaagggaggcaactagaatgttgtaggctcttgaaatcatcatatgagaaattagttattgaggcaattgggaatacttaagagtgggggtggataaaaattgtgcatgatcactacattcaaatatatgaagttctttcaagtgaaaaagggagtaaattgttattcatcctaaattctcagcttgtgtgtgataaccgatacttcatttgttcattcattcattcatttcaccagcactaattgagcaaagtgtgtcagggattgggaatttgtggaaccgaatagagcatggtccctgctctcaaggagctcagagacaagtgagcagagaaagagatggaaacaaataattaaaattcagcttgaaaagtattttcataaacttatgaagtgctaatcagaaaacagagagtaggaccaataggatagaagttagaaggaatatacatttgattttataagacttgttgaataaataaaactaaccaaaaatgaaacagcagatgttgtgtttatgaagaagctggttcaaccacccgttgggggtgattttctaaggacttcaagtaatgtggggtgagatgagaagcgttgaactctaaaattgtttaatacttcaggaaacaattctctaaagtactgctttgcttggtttctatttaaagttggaaatctgttcccatagcaggggaacacgtctttcactatactgaattgagagccttttgggagtagaggtgtgtggcgacttggtgtcatgttagagcagtgacaatttgattggctaagagttgtaacccccacttggtgctcattcattaaggaaaacttttgagcatttacctggctcacagaagttctgtaggatgcaacctctgctgatagttctttcaaatgttgacacgaaataatcacagaggataagtcaaatcaatatgataacaagtgcaagaccatatactatcagttagatgggtaaatgtttgaggaatcacagagcaagtgtgatgggtaaaagattctcaaagaggaatgacatataaagcatcctcaaggaagtgatggacttagatcctgagcagagaggagagaacattccaagaagaagaaatgtcattagctgatatggttttcctgtgtccccacccaaatctcatcttgaattgtagcttgcataattcccacatgtcatggcagggatctagtgcgaggtaattgaatcatgcggatgggtctttcctgtggtgttctcgtgatagtgaatagtctcatgagatctgatggttttataaaggggagttcccctgcacacactctcttgcctgctgccatgtaagatgtgactttgctcctcctttgccttccactgtgattgtgaggcctccccagccatttggaactgtgagtcaattaaacctctttccttcataaattacccagtctcgggtatgtctttattagcagtgtgtgtaacagactaatacattaaccaaaacagggcaaaataaaccaaaagttcatttatgtgagagacactaagataagggacttcattgaaccagaggggccatattagtaatgtaaagataagaagtaggaaaaatatggaaggggttggcccagataagagattatgattgctaaatttagtggtttgattacatctcaaaaatcaactgtgaggtgtggtagtttcttttacagtgataaaaatggaggtggagggtgatggcctaaatgaagaagtggccttttcaagtaggcagagctgttgaaaaaccaaactcaggtggatggcggtggatgtgacccctgaaggggctgttgggagagccctgcctcaaaccagcttctcagggccagtgctgcagacactcagccagggcttgccctcccctcttacccctcccttacctctttggttcctcaataatcagcaaggagtgttctaatgctgtgtctccctttgaaggtgatataatatgtgctcttaaaaaaaatagtatatctaacatctatacatatataatgaaaagcatagtgacaacaaacatctgtaaacctaccgcccagtttaactagttttaatgctattgaacttgtttgtgtattcttctcctgctccctgtctcctaagagttaccctaaattctctgtttattgtttttcttgttttttctctggactttaccacattgcttagttttgcttgtctttgagatgtgtaacagtgttagtgtacagtgtgtgttctgcaccttggtgtttcattcaatggttacctttctgggatttatccatgttgatgcatgtagctctggcacattcattttcactgctctccagtatttcactgtagaaacataccacaatggatgtttgcttttgtttccactttttttgctgttttgaacagcactgccgtgaacatgcatgtacatatcagtttagcctgagtgtgaatttctctaagacactggttctcaaacattttggttttaggacctttttaccaggacccctaaactccaaaaaccttttgtgcgtatgcattgtatctatttatctatatcatggtagagattaaaactggcaaattaaatatgttattaaaaatactgattctaacccattacatgttaactataaatagcatattttaataaaaatatattttccaaaagagatttagtgagaagagtagcattattttatatttttgcaaatctctaatgcctgagttaacagaagacaacgagagtctcctatctgctacggcattcagtctttttttttgagatggagtctccctctgttgcccaggctggagtgcagtggtgcagcctctgcctcctgggttcaagcggttctcctgcctcagcctcccaagtagctgggattacaggtgcctgccactgggcctggctaatttttttttttttttttttacatttgtaatagagatgggttctcaccacgttggccaggctggtctcaaactcctggcctcaggtgatccgcctgcctcggcatcccaaagtgctggtattacaggcatgagcctccgcacctggcctgcattcaatctgtgacatgttttggatggcatatctgaagaaaatctgacttcacaccaatatgtaatagtcttttcagataattgtgaatattcattgatattacaccaagactcaaaaagagatagcttcttaaagattagttgcaatgattaatcaaaacatttcaataaacttttcatattttgaagcattaaaatctactggtctctcttgtgctttgaatggatcaatgtgcatagaacatcttgtgttggacatttggaaaatattggttcactgagttatgtagatctaccaaatgttgacacattttgttataaaatataaaaaaaatattaatatcaacactgatgttatctgaaaggtgtttaaggaccgtattgggaagctgtcaaattcacagtgtaagatacatgttttccaaaattttaattcttgtttgaaagcttgaattttattgttggcaacaaacactgtcagtttttccttgaagtatcagtcttacttttcatttccaatgaagagtctgccaaataccgatacttgaatgaccatagtcagttatcctttcaattaaaagtgatgttcaaggaaaaattggctagttcggctcttaactcagtcacacatgtccttttccttgagacagccaccgtactttggtgatagcagaagtgctttatgcatgtatttcattacatgtgttattaaaaagatgtttactcaagggtcagtcttcaatgaaaataatttttactgcttcatcaaagacattcttaagtgaaactggcagggcttttctccttggttttgtttttgtgtttgtgtgttagttttctaaatatgtgcagcagtgaagaatgaaatcattaccagtatgatttattgctgttgctgtgattcaagctaaggtcccaatagttttacccgtcattgcttttgtatcatcattacagatgtcaatggagtaataagggcaaatgatagcttagtattattataaaaacagttttgatcttgaggatccctgaaagggtctcagagacacataggggtccacacaccacactttgagaaccactactctaagttgtctacatagtaatggaaatgccacatcttggtgcatgtgcgtcttcagctttactaggtaatgctataatgtagcactttgaatattttcaccaaagaccccaaaaggcaaagaatcctgaagatggggaatcctaaactcacaacggttctcacagcttctgtgagatttccttgatgtatctttgaattatcttacaatgtgcattatactgtatatctgttggtttagactaaaagtaatgttttcaataactcatcagtcaaattacctttgtttcttgtaaatatgtatgtatcagttttggtctgtgaagatgctccatatttatcctggtacctgttatgatttcctggaacccctgttggaggagaactccagtgagtgccttggtccagcatgatttatcttggagactgcatggtagcaaagaagagatgactaagatttccagtcttggggaattaggagtatttctggtcttcgtgtcttctttttctgggttgctgtcctcattgtccatgaacccactcatctgagacagaaacctgagtgtaatccaaatgccacccccttccttttcctcccctcattgaatttcttccccacccagttttgttggttctgcttcccaaatatctctagaataaatcatgcccaccccctgccactgctttggtttacactcatattttttctcaaagagaattgaaatggttgccagctgacctctttttttttttttttttttttttgcctgagtctcacctctcccctccccaacccctgcctctgtaatccagtctccacactgccaccatggcagactttctaaaacactcatgtaatccagataatcctatttaagatcttttaggcattttctaaaaggataaagtctggacttctagactttgccaagaagcaaatctagaagatgctttgtcatctaagcccctttcctctgccatgttgtatactccttgttttattcgtactgaactatctgttctgcaaatcatacttatacctccttttcttggcgtattcttttctctgtttctgaaatatcttcaactcatttatgtgcctgataacctcctacttagcctgcaacactcagttctctgagaagcctttcctgcttcccctcctgcattgtcccacatgctgggtagaattaggcgtctcctcccctggttcccatagctctatcataataactttgtgtgcatagtatacttccttactagtcgatgttcttattgactgtgagcttttaaagggcatggactttcttattcatttttgtacattcttgcacataacagtaactgattatagtaggtggtcaataaatagtgctgaataaatgaatgaagggagaagtaaagagctggtcacagaatccaagaaataggagatgttctattaatattgttgaatgaagaaatgaatgaaattaagaaggggggaatcccataggtgtttcataaacactgctgaatgaataaacaaagaagttaagactgggtcacagaaccaaagggttttagaggtggaaaggactttagagaccatctcctgctgtcttcctctttcaaaaatgagaaaacgatttgcctaaattgtcccgggctgggtataggaggcgatgaacagtaccctggacattcgcgtgaatgtagcctggagatgactggagggagtcacatgcttctcctcccttcctgaggagacttgcccagaagagcagaggccgtggcgtatgctgcaggggataccaccgtctaagtgcaagagagaacttttgtggttggaagtctgtggcacattccagactgtggagtctcccctcagctattggctgttgctctctttctgtcctcaaactgtgccaagaccgtcagattttcctgatgactgggcatattctgcatctggattccatggtcataacaaccagaagtttcctgtcttctttggttggggtgattatgatatagagctgggtaacaatatcaacagttctgaggtaagccgtcctctttaaaacataatgttttctcatttgagatttctaggtgcctgggaaaaagggaaagctattattcactaagcgtcaactctgtgccaggtgctttacttatgtaatgctaatttacctttacatagccctgtacaattgcagatattagtatcttatactctaaacaggagaaggtgcttgtagacttcaggtgggcctagtgtatagcaggataagattcgagtgggagtgtctggttccaaagcttgtgccctttctattttgccatgctgtttcatgctgtataaatagattttctgctatacaaaacttattgtggccctatttcaccaatattagtgaattgttggagttgattatatttatttacttaaaaggaggagaatctacaggtttctggtttaatgttatccatgctttgcagtttacatgtacttggccatcttggcaggaccaccatgtatgggagagagagcagtattaataccctactttatggatgatggatttcagtagtgggggacagagcattcttcatatttctggttcatcactgtattcctcataccatgtctaagagcttgtttatagtagggttttcaatttttgttaaataaacatcagaagttatatagctggtaaattccaaattcaaagtggaaccaggtctctgagtctcagctcagtggtccttcctttgctaaagcattctgcttttcccagtgctctaagcagagtgatgcaggaatgagctctccctttcatgagtatatgtgggacttgggaactctcttgatttggctgtccagtgaatttccacaaatctgaacaagtacgggtggtcccttaggataagatctttcttgtttttgcctctcctcttttaaatactcaatataggatttgtttttattttaatttttgagacaggatcttaactcttatagtccaggctggagtgcagttgtgtgatcatcagctgcagcctccacttactggtctcaagtgatcctcccaccttagcctcccaagtagctggtactagagtatgccaccagtcctgggtaatttttaaactttttgtagagatgggagtcttgctatgttgcccaggctggtctcaaaactcctggcctcaagtgataccccacctcagcctcccaaagtgctgggattataggtgtgagacactgtgcctggctcaatataggattttaaatcatttctatttacctgacacttagtccccagtaagatgattggataatgactgatgacccaaagtggattcatagaggatttgcaccaggaggatccctgaggtcatctaaaacagtggctttcaaaacaaaacaaaataggtggaacccttccttgtctttatggagagctccactatgtagaaaagatcaaagacaaagcagggctgtgcaggctgggtgtgtgctggggtgagagctgggggtgggtccatagagcccaaccttgcccgagagccccaggcttcctctatgtgtggtttggaaaccactgatccatcctaaccccttattttatagatgaagaaactgaggcacaaaggtgctcaatgacttacacaagtggctggattaaaaagatgatgatgaaacttgttgccatatatcggaatttttttttttttttttgagactgggtcttacttttttgcccaggctggagtgcagtggtgcaatcttagctcatcgctgttttagagcaccattccgctttttttttttatatataaagaaaaagtacctgttctggagagcagaagtctgcaaactgtagccagtttttttttttttttttttttttttttgccttgagctaagaatagtttttatgtttttaaagggttctttaaaacaacaacaaaatataaggacagagactatatgtgccccgcaaagcataaagtaggatttaccactgctgatattaatgtggaaatttttcttaaaaattaggttttctgtaagtaacttcaaaacaaagatttaaaacaaagcctgattagttgagcaaatttattagattggtgcaaaagcaattgatgtttttactattaaaagtaatggcaaaaccgtaattactttctgccccaacctaatatatcaaaagcttttcaaacttgtgtgtttcaaataacttctttaaattgcccaatatattttcactctccttttaaaataccagttttgggtggaggataagctggttaatgaaattcttataatatgtgggaatgttgcagctacagaactgcagacagttcttaggtgaaaaagaagtggtgtttttattcaaatacaaaattagggcacttaacagtcacccaaaaggtcaagaaccagaggaactgatgtaggaataatataagtggtcactcccaggaaatggcatatgaatgttgttttttcttttcttttttttttttttttttttttttttgaccagctaccttggagttgagccttatccaaagtagcagtagagcatgtttccaaacttcaatcttaccacttgatgcattttccaaagtgctatgatttgagtgtgttccccaaagttcatgggtttgaaacaattgccagtgcaacagtgttgagagatggggcctttaagaggtaatcaagagggactttaagaagctgtggcttcatagctgggttaatattattatcatgggagtgggtttgttaacaaaaaccagtttggccctctcttgctctctctgtctccaagtgataccttcaactatgttatgatgcagcaagaaggccctcacaagatgcagccccttgatcttggacttcccagcctccagaactgtgaacccaatacatttcagttctttacaaattatctggtcgtgcgtgttttgttatagcaacataaaatggactgagacagaaaattggtactaagaagtggggctcttgctgtaacaaatatttgaaaatgtggaagtggttctggaactgggtaatggatagatgctagaagaatttggaggagcaggttagaaaaagcctaggttgttataaacagagcattaagggcaattctggtgaaggctcagaagaagagagctagtggtaaactaagaaacttcttagagattaattaagggctgtgatcggaatgttggtagaaatatggacagtaaaggccattctgatgagatctcagatagaaaagaggaattattggaaactggagtaaaggccatccttgttatgatgtggcaaagaacttggccgaattgtgtccataccctcgggcttttaggaaggcagaatttaagagccatcaactagggtatctcttgagagaaatttctaagcaaaatgttgaaggagctacatggcttctattaacttcatatagtaaaatgagaggagagaaatgatttaaagatggaatttataattaaaagggaaacagaaatgaggaatttgaaggattctcagcctggccatgtagcagagaatgaaagaacattttcaggagaggaaaccatagatgtggccaaggaactgattgattgataaggggattaacatggatagaaggaaaccaaaggacgatgagagaatgaccccaaaggtactttggaaatcaccagtgctccccttccatcacaggcccagagtgccaaggcctggggaaaggaaatgtccaaagagagtcctcgggtgcccttgagacactgggcttgctgcctagggctgctgtaagtctttgctccccacattcccgtacggctcatgcccccagttcaccccaggtgtcacagctttggaaggtgtaagcagcaaatcttggctatgttcatgtggtagaagtgtgcaggtgctcaaaattcaagagctgtgggcatatggcttccttcatctagatttcacgaccgcctgggggcccaggcagagactttctgaggggcagagctgatgcagggagcccccaactagggcaatgcctagtggagctgtagaagtaggggagcatgcagcttcaggctgggaaagctgcaggcacaagaccaacccttggatgaactgaacccagcaaagccattggggtggggttacctgaggccttggcggcccaacccccaccccagtgtacaggggattggggacatggagtcaaaggagattattctggcatcttaagatgtaatattgttttccctgttgggttttggacttactcaggaccagttatcccattctcttgcctatgtctccctttggaatgagaatgcctattctatgcctgtcccactattgtattttggaagtggataacttgtttaattttacaggcttacagctggagggaaatttgtctcaggatgaattgtaccttgagtctcacccatatctaatttagattagactctggacgtttggatttttgagttgatgatgaaagaagttaagacttttggggctattgtgatggaatgaatatatttcgcatgtgagaaggacatgaatttttggagccaagggtggaatgctgtggtttgagtgtgtcccccagaattcatatgttggaaactcaatcctcaatgcaacagtattgagaggtggaacctttaagaggtgattaggtcaggagagctctgccctatgaatagattagtatccttatctcgggagtgtgttggttattgggagagcgatttttttttttgagacggagttccgctcttgttgcctgggttggagtgcaatggcgccatctcagctcatggcaacctctgcctcccaggttcaagcgattctcctgcctcagcctcccgagtagctggaattacaggcatgtgccatcatgcccaactaattttgcatttttagtagagacgggatttctccatgttggtcaggctggtcttgaacgcccaacctcaggtgatccacccgcctcagcctcccaaagggctgagattacaggcgtgagctaccacacccggccaagagaatgagtttttataaaagtgaatttggccatctcttgctcttgctctctctcagcacaggatgccttctgttgtcatgatgcagcaagaagacacgcactacgtgtggccccaagggctgcagaaccatgaggtagtagatttctgttccttataaattacccagtcttaagtattctgttttagcaacacgaaatcagctaagacaagaagcatccgagttttattggggatggaatgaatggctcctctggagcatccctgctggtgacaaagccctagaaaacagtgctggatttcttttaggtgaaaaatctagaaaagccctcttagtgaaaaccccaagggcatgcctgaggaatgcctgagaagaaaggaaggtacaccttcaggattcttcaaagagaattaaatggataaaaccactggacttgagttgttaagggaatgttaatttagctgtggggtatcctggcccttggaattaccttagcttgttggttgattgcagtttttgttaattgttgttgtttttttgctctctattgttgacttctgtgtgtaccagaaggtgggcagggaaaataaaaggagacaaggaataagaatacatttgaccacttgatagcagccctggcacaaagcctagtaggagtaaaggttaaaactgttggcctaaatcagtgtttaaagttaactttgagttagggctgtccttgaaatggattgtcctttgctctcatggattcttgtgcataactgataaaaaatattctcatacaataaattgcaccaatatcattttgtgaatgtgttggtgggttgcagggggcgcgttaggggaagctgcctccttgcagcttttgttttatacgtatttaagcactaaataaaaatctattttgtctcttttcccttgctaagtctcttgtctcccacggcccttttctttctggatatatgtatatttttagtaagtaaaggacttactgtatgaagtttttctttggcagacagaatgatgatgactataatatgtttattacaaggtacatcatgccaatgctcttggtgtgtgtgtgtgtgtgtgtgtgtgtgtctacaaagaaatgtatcattttatgtataagctaagattttgataagtagtcatttatctatccatagaatgctatttcttagactgtagaatgcattgttatatggttagggctattgggggtgttcatttttgtttaggttctttgacctagtaaagacttcctggtgatttcagtagtttggtaatttattactgatcttctaagaagtattggtaatgttaaaatgaaaacatttatacaaaaagaaataaaagtcaaggaagcagataatcaaccgatttatcagccttagcagacaatttttctgataacgatgtggtagccatggtaaatttacttctgattgcttgaggggacagattctatgtgccttttgtaataagaggtgcatgaaagggtaagggagcaagtaatcaatccgtggactaaccagtcccattttggtctttagattggccttttggtgagtaaattcaagctatcttttcaacaaaagaaaaattttgttattaatttgctgaaacgtgagtaaggatgtaaggatgagtatatctttttgtttggatatctctaagtagccctagtaagggaaggcctcttttggtaatgtcttttttttttttttttttttttgagacagggtctcactctgttgcccaggctggaatgcagtggtgcagtcgtgactcactgcaacctctgcttcctggactcaagttatccttctgcttcagcctcccgagtagctgggaccacaggcatgcaccaccacacttggctaatttttatatttttggtagagatgcggtttcaccatattacccaggctggtcttgaactcctgagctcaagtgatccgccagccttgaccttcaaaagtgctgggattataggtgtgagccaccatgcttggcctatttttttaaacctttcatttgaaagaaatttgagtaaaattgagagataagcaaaaatttattagtccactcatagtccttccagcctcacaggacttaacactgatcagcaatgtggtcggttttatgtaataatatccagcttattacaaaaactacattacaaactgaggctatagttgagaatccagaggtgaacaaattcaggaaaaatgcctcaggccttcatccaaatatacttatattagttttcttgggttgctgtaataaagtatcacaaaccagtgcttaaacaacagaaatttattgtctcacaattctggaggctaaaagtctgagctcaaggtgtccacaaggccactctcgctctgaaggcggtagggaagggtctgttccagacctctcgcccagcttctggtagtttctaggcttatgatagcataactcatctcatggtgttcttcctgtgtgcatgtgtgtctctgcatccaaatttcccccttttataaggacaccagtcatactggatttgagtccaccccaatgacctcatcttcacttgattatctgcagaagcctatttcccaataaggtcacagtcacatgtactgggggttagaacttcaatatcttttgagagaacacaattcaactcatgatactaggtattcattccaagtttgtacacagttttaataagcctggtgatttttatctcagtttatgcatacaaagagttataagtataggagaaagagtctctgctgaggatataatggagaacaaaagtattcaaaaagactattaaagtaggaataagaacttaaaatacatagttgctttgggccactcaatggagggacaaactgctgaaaagttccagtagctcctgaaacacatttatatataacaaacataataacagcatcaacatattatgtttgagtgtgtgtgcacttttaaatcccatcaaattaaattttgaaaatattgcgtacttgatggcactttgataatttttggttacctgaaaaattattcttttgtcaagctcctcacatattgtcagatgttctgaatatttgggtttcaacttggctttgtcactcagtaagcatgcatgttgtgtaagccattaactttttggaacttgggttttttggtctgtaaaatgaaaagtttggtttcctatataaaattattgtgaggatgaaatttgctgatgaatatgaaaacatctatcatagctccagatgtgttttcatgattgttcattcattcaacaaatgtttattgggagcctactgtatgcagtggcttgttctagaattcattcattcacttaatgctgattgaaaagtaccatgatttagtagtattgggacatctgagctcaagcactgcctatgtttggaaatcatctaggggaccttgggcaaatctatggccctctctaggcctctaactagagactagtcatatagagtagatttccaaggcttttccatctgtaaaataattcatataacaaacttcaagtataatgaatagtttttgatatcgtacagattaattgtattatactggcaagttactttatcctctgcgcctttgcttttgtctttgaaagtggggttaataggtctagtactgttttctggttagtaatagcagtaataatgatagtcacccattattgagctcttggcattgtgctagatatttttatacattcttgcttctacaaacacggtacatgtttctccaaagcatgtcggtacctggagaaacaggttgcatctttctagagaataaagtttccttgatggcacagctgtttatagagtggaatgcagaagtcacttgaaatgttaagctaaaactcaaagaaagttggggcttcttagagggggcggcgactttaataccaagttcccctgcagtgttgttctttcttggcctttggggaaactggtggaaaagtttgcaaaacaggctttttccctgttccatgtttgactcacatgagaaaaatagcattctaatttacaattttgaaaatagttcttatttccatcactgacagatgttacctttatgattgttcagcctattcttccatttcatttatgcattggacaaataataattgactgcctgctctgtgttcagtaccaacctaaatgccgaggatgcagcagcaaccaaaataaagtcctccctcggagcttgtattctaaaaaacagtgaggtttgagggcagacctgaggaattaggggaattaagcatgtggctgtttcaggcagaggaagagcaattgcaaaggccctgaggcaggagcttattttcctagtaagggagagtgttaggagaggaggtcacaaggagatgattagggatgccttgaggttcaggtaagagttttgtattttatactgagaaacatgggaaaccattgtggaagtttgagaacttactttggctgctggttgagaataatggagcaaggttgggaagtgaggagaccagttggaaggctactgccatagtacaggtgggggatgacagcactgggtaccaggttagtagtagtggtggaaatggtgcaaagtggccagatttggtacctctgttgaaggtagaaccaacggaatccgagaatgaattggatgtggggtctgagagaaagagaagagtcaagggaggtggcatggttttgggtctaagtaattgaaaggatggaggagttgccattcctgctgagacgggcaggtagagggaggaacacgggcagttcctcggccatggaaggtctggctaagcactttatatgaagaatactgaaactgacttagctactttttcgaactcactctgcagaggagtgatgcgttcatttgtgttacctttattttactcacggtcatttagaataatgatttgaaaatgttgctgtgtgccaaatgctcgtcttgacccaggagcccctccctccccccgtgtgtggactactctcgtctccagacttcctctcacttcctcatgcctttgcagcaccttttccctagctggactggtgacaggaatctggttgtcttctgcaccctggcagttttaaataactagcagttcttacattttcttcctgggcacgctgacagcggttgggtgtcctggacatccgtgtttcgataactgtaatctccgagtctctgtcctgtgaagcccattgccggccgtgcatttacctcagactgtggacttggagccttgaagacgcgagaggtctcttagtttcaggcagacctggtgtgggggatgtgctaaggctctcaggctacaaagggacaatttaaaacttggcaagtaaaaccggcctaaatgcggatgtgttttatgcttagcatcataaaattgattcagaacagcctgatatgcggcagaagaaacctttattaaacattatagaggtcattgcttttgtcttcctgatacctcttccctctcctttcttctgtgacccacattgagcccattgtagaacccgccccctggcttcagtgataggcccatggaggggaacatgacctccaacaggccaatcagaggcgtaaagacctttctctagtgggaagtcattgagagtgaaaacccagaaccggttgcagccaggttttcagcctcctgggaaaagtggcctgagaggaagagactagaggcgaatgagagagagccctgatggtgctttcgacatcctatctgatgctggctccattgtgccccttttattgtttggtacaggaactgagaaaattcccttattgcttcatgcggtcctgctggttttctgtcatttacaaccacaggagcccagatacccctactatgagcagggaatcaagaaggaacacaaaaatgactaactcatagccttgcctccaggtatttataatgtaatagtttgatttcaaaactagtgagtatggtaaaatagttggtaaggtctacctttgacaaatcaatagtatatttttaaaatgtgaagatagtgtattttataaaaatatacaattttttcattgggttaatttatccaacatatatcacttgaatattagctttctccatgactggcatatttcctttttgataatttgctgaggagcaaggctgcttgttaatgaatttttgtctactattaaaatcgccctcatcctttgaggtccatttccaaagccacctgcacctctggagttcattattccctcttttgtgcttacacaacccttgctgtttctgtatggtggcaccagtcattatgctttgaatgcttgtgaaaccctcactcttctgttgattagaaacttttatgccagagactgttgtgtctctgtttccctttgcagggaacagttccctgaacatagtaggtgatcagtaaatgcttgttgaattaagtcaattagtagcactggttttgctaataacttttgtagtaaacttacaaactacttttatgtaaaactgcatgtaaaagttggttgtatgatttgcagcacttattatgagtataactgataatgctaatggaaatgtatgatcttaaaaggcattagatatttagctatagaagtgtattagtaggaaagggaaaacttacaagatttttacatgaaaataaaccagaaggttggttggtaggtaccaggtgaacatacctgtggtcacaagaagagagtgttggagacactgattgttagagagttgaccgtgagaaagcatctctccaatcctatgccaggtgagtcctaagaattcaagtcctgttctcattaaaacctgctggctagactcatatggactgactggtgggaatagtttgcgagtagatttagaaatgggacttttaggcttccttccccacttgcttaaaccaaaaagcttgaaaattaataggtgtctctttgttatatatttttttcactgtgcactcacaatctttctgaacgaggatgctctgagatgtatattggtccaattaaatgcatctgattaaaactgtcaaaccaaaaaggaagtgagttgaaaagacattctctaccgagaatgcagcaagagttgtagatatcaagttactgagttgctgcttgagaactgaattataaataaatgtgttaggtagtggaattttgttttgttttccccaaaggagaaatattcgccacatggaaacaaaatttattcagcatattttcattctgtaattgcaccattgctattcttaattctttgtgtttctgatttaaagggaaaacacacacaaaaacagactgttgtgtaaaattgacaagaatgagtgtgaacctgacagtcagagacagaggttgttgtaaaattagcaatggaaatagctttcttctctggaggttaaaaataatgtatttacaaggaagttatttacattggccacttagaggcttccccgggaagccttggttaagaaagctgtgaaatccacggtcactgtaccgcaggaagcacttccaggaccttggcttgtgcagtgctgctctgtgaccatgtgaagagtctgcgctggttggcagactggaaaatggaggtgtcttgctgcctgagacttctcagattgtgaaagagagacacaaaagtcaaggcttgcatgttctaaagtttgttgtgtccagcaaattcatcttctagatttaaaaaaatgctttgttttgagctccacaatgagagaactttttctcacgatgtagtgtgaaaggaaattccaggctaggaaaggtgcaggttgtcgtacactctgcagaaggagagctcaccatagctagaccactgcaacattcaagaactcctccattatgagattggacatgaaaatagaggagcccagcaggcaaaaaaagaagaaaaaaaaagtgggagaaaatccttgctgttttgtgaacacagacatatttgtttgagcttcttataatttttccccaccctctgcacatcctcattttcttgcattcatttctcccaaagctcctctcaccatttatttaacctcaggtattgccagaataatttcagctatgtttctcctcaagtttctgctctttctctttctatgccatgcattaaaattatatggtaacttatttcttgaataacctcaatttcagtagcagcatcttcagaaaagtgattaacagagtattatgaatttaagagatactcttcatgcatccaagttttcttgcagtccagaggtgtgtgtatctcagtgatcgagtctgcaaacaacagagggatggatggttgagaaattatctaggcattttaggagccacaaacagttctgtttaagaaatactttgtttattcacttgtttattttgagtttgtgttttgacaagttaggaaagttgctttaaatgtagacattagctgttgtatctttcaagaaggttcagacatctttatcactgcttggtaggattagaacctgaattgacagtttctttagcctttggcacacttacctgtttgcacactcacctgtttcagcacgtttggagggggaatattcttgctcactgagggtgtggagggggttaggaaattaagctttgcttttgggactttgccagtagaagtgctaaattctttaggcatttgaatctccttttgaccgactccaacaaagaagaggcagaatgggaatgaagagattagagtacaggaataatgagtgttcacctcttaatgatttatctcaagataaagagtgaatactgtccttatctaagagaatcccttgctgatttctgattcaagaggttggcaggaaggatgggggaatggaaagcgggtgagcagctgctcagagctctctagaagtcgtcgttcagcggttctgtctgcagattgtgcagtggaaccttgcagagaagcattgggccagctgagagatttggggttcttggtttctgcattagctctacgtggtcgtgtgtctttgattcagccagtaacctttacttaacgtatttaatagtctgagtaaaatgacaagatttgatgtgtggttgtaacttcttgtggttctcaaaacctagattttaggtatgctgttaggtgaccctactgcattagtttggaaccattcttgactatcttgagctcctctggtatgacacacatatgacctaaaagtatttaaatttgaataatatattttcccgttacttcacttaatgagtgtacttcatttaataataaagattaaagaaaagattatttgagcagatattcaacaaattcttactgtagggatttttaaacttttgacttactatttataggatacttcctatgtgattctactgaaggatgagatgtttaatctgaaatcaagaaaggtggtttgccaaagaaacataaaattagccctattgttgaaattgatgttgactgcttggtgtttggtaaaaagcatctctccaagaagccactggggaaatgatgagtttagggtcgccgccaatttcaggaaagatgaaaaatgttaaaatcaactgggaaggaggaaatgtggcagatcacaaagaaccagactgtttttaacagagaaaattcaatttaatctgctttttttcccagcaaattccatttgatattttacattttcttgataacttaataaagaatctcaggaaggagttgcagaattttagcttcgtgaaagagaatttgtcatttgtgacatttcttctctaaatagcatgggaagatcaatgtattagtgtatggttcatgcattactagttctagttacttctatttcaaaaagaaacagcatgctatatggcaaaacttggcacaaggagggattttggctcaatccctacacatacattgaactctgctagggaccagacattgtgctaggcacagtgtggaatatgtagataataaaatacaattcctgccctctaggagcaccactttagaaggaagccaacagcagacagataatttagagtaatataaaaccaatgtaaacaaaatatgagaatgttggctctgcaataaaaatatgcacctaattgagtcacttctcacgccttgcagtcctgagctgagccttcataatccccacctggatcctagcctcctagctggcctctttgtgctcatccttgtacctgaagtctgttttccacacagcagccagaacaatgctttgacaacataagtcatgtcataacactcgcttgccacaaaccctccagtggtacccagttttgccaaattcagaagacctttctgcagttcacaacgtcctgtagatctgtgtgaccccactcctgcaccacagtgcatgtgcacacacgcgcacacacacacacacgtgcatacacactctcatacacatgccaacacacactgactcatgatattctctgacctcctatggcactgctctgacctcactcactgcaccccatgcacactggcttcagtgctgttccatgggcgtgccaggcatgttcccacagcagggccttcacagtgactctccctctgcatggtcagtttctcacttcctccaaggctttgctgaaatgccaccacttctgtgaagctccaccttgaccacctgtttaaaattgcagctctcttcccacccattactccccatcctccctgtcttgccctatgtggttttccatggacttatcaccctctggcatgctatgttatttacccatttattaattttgtttgacacttgtcttcccccactggaatgtaagctccaagaaggcaggatcttagttttgttcattctgagtgagagttccagggagaattgtaaggaagaaacctttgagtcgggtgttgaagggtaagtagaattggacaatcagcttttctggggaaagacatttgagatggaaggaatatcgtgagaaaaggtagaaaagtggcagggctcatgaatgcccctagaatggcaaggagcctgcctaactggtgcatgagagtgtcatgggagtggtagtggtggatcgataaatagaaaataatgaaaagacactcttagtggagggagggaacacattcctaaccgctgcctgtgataatatggcaagcatgttgatgactggagttgaggaccctcaaataggtagcatgcataacatgggaggtactgtcacagtcagaagccagaaatgtgagtagtgtttgctaatgaaatctgattttatacggtacttgactgttttcaaaacatgatcacatgcttattatgatataagctttataacaactgataaagtgagttaagcaggtattatgtacatttttgataagctttttaaaaaatgaattgcatcttatattggaggaagtggattctcagaccagctcagtgacttgcctagagtcacggagttagaaagtagggaagcgcttcccactgtctgtgtctcacggtctgtgtcccactatgccaggctgcctctctcattctgtcacagtgctaaacatactgtgctggtttttcacaaggatataggcttctttccatttccccccattccctgaaaatagcagtttcttcatccaattacctctttaccagatccatttttctttttccttcttttccctttcaacttatctggactacttgggtatgtttttacctttgcctgtgtagcattttttacttttttcaggcttctgccaagtctgtctgacattctgttaaggctgttgccacctttcatttggttcttgggtggaagggaagagaaagcatgtcatcacctccatttgaatgtcttgagacttacttattgttcactttgggagtaaacctgatcttcttaattctccccagatgttagtaggcaggaagaggcggagggagagctcagtgaaggagaacactggtatggaaactcttcagagactccgtcagaagcatcctatggggaagtccaggagaactataagttgtctctggaggaccggatccaggagcagtccacgtccccggacacctccttgggaagcacgactcccagcagccacacgttggagctggtggcactggacagtgaggtcctgcgagactcactgcagtgtcaagatcacctttccccgggagtgtcttctttgtgtgacgatgacccaggctccaacaagcccctgagcagcaatttgaggcggctgctggaggctggttccctcaaactcgatgctgcagccacggctaatggcagagtggagtcccccgtaaacgttggctcgaacctctccttttccccgccttcccaccacgcccagcagctcagtgttctggccaggaagttggccgagaagcaggaacagaatgaccaatacactccaagtaaccgttttatatggaatcaaggtaagtggttgccaaactcaaccaccacctgcagcttgtctccggattcagccatcctaaaactgaaagctgcagccaatgccgttctgcaggacaaatctctcaccaggactgaggagaccatgcgatttgagtccttttcctccccttttagctcccagtctgccagttctaccttggccgctttgtccaagaaggtcagtgaaagaagtttgactcctggtcaggagcaccctccaccggccagctccttcctttccctggcttctatgacctcctcagcggcccttctgaaggaggtggccgcaagggctgcgggcagtcttctggctgagaaatcatcgctgctgcctgaggaccctctaccgcccccgccttcagagaagaaaccagaaaaagtcactccgccacctccaccgccacctccaccacctccaccaccaccaccacaatccctggaattattattactcccagttcctaagggaagagtttctaaaccctccaattcaggtatggcatcttttctttcaatcatcgtgtaagtcctttagactataaactgcgatgtcttattcattgcttttttcagttgggttccccatctgatctgaggcaggaataaaaaagcaagagcacaacaaaaatactttaagtaagcagcatagtagtctttcatgtacgtattacacaaagacttcacaaatagcttcacttttgaaaggtaatgaataatcttagagacatacagcattccctccctttcatacaaatgatttttttttcttactaagttcaggctaggtccatacaagatatatttaatgggagaagatcaaagcatctttgtcatggagtgcatggcatcactgaacataaggggaaaaaaacccactgcttttgaaatagtggacaagggagagcccacactcctgctgcctccatcacaaatggacttttgtacaatcaggaactactctgccctaatttatcacaccatatacttttatgttagcatttttattactttttgtggaatttaagcccttttcacgtatcctattctcctacaatttcttgtcctataagaactcaaaaagattgtcaatcaaacataatcaacacatttcctgtgaatgctttatttaattcaaatccaatccaattttgaaggaatgtgcatgtggaaaatttgaatcctaaggtttttctagtggaggcagtctttccaaaggagaaatcgctgtcatataggaccttagcattcacaattattcatctgagggagaaatttagtcacttgaattctcacagtggaaacaccatttcttgttctggtttgctttaaaattgtgtacatgataaatacacgttcctgggatgcgtgttggggtttcagatgtctcttaaggatatcctgccagactggagcaggaagtaggctatgtgcatcctcatcggtacaaacattgccatcgtgtgtgtctagccaacttttgattattttcagcaacaatgatgaagagggtttggaatggcaaataattgacggaacgatcacagttaatgtcaatttgatgcatttatgacaaatttccatttaaatggctgagtgagctatattcactaattataagtacttcaaaacttgagtcaacagcagaagacaacgaggaaaatgggtatctgggacttttatgactcttggtgatccaaactgttctctccagagtttctgaaatgtcagtaaaatcctaggatgttgtcaattctaagttccacttctcctctcttctcacctgccatctggtgaaataaggagagaaatgggtaaaattaggaaacaaggagaagagcaaaggaggctggggtagttctacgatggaaaaaatcactcctgacttatagaaatttcatttagggatagcagtagaaagagaggtatggctgtatataaaataaaattttaggccgggcgcagtggctcacacctgtaatcctagcactttgaggggccaaggcgggtgggtcacctgaggtcagggggtcaagaccatcctgaccaatatggtgaaactccgtctctactaaaaatacaaaaattaaccaggcgtggtggtgtgcgcctgtaatcccagctacttgggaggctgaggcaggagaattgcttgaacccgggaggcagaggttgcagtgagctgagatcgtgtcactgcagtccagcctggatgagactctgtctcaaaaaaataaaaataaaaaaaagaaaataataattatatatatgtatattctgcatatctagttattgaataaatgtgtgaatggcgtttctagtatacaattcatctggacatttgttagttgggaaagcttatgcaaagttaataataaactttagttgattgaagacttggaaagaagtgactgataaaaccatgtttcctgaagcccagactgtagcagctttgtcatattgaagtctccggtataaccagcaatggttgtgaatataatttttttcactcaaacgaccagatacatgtaaagatgagaaagaggtcatgagcttccagtgaatggtagactttttgtttgttttgttgtgggaaatacacccaagggaaaagctatgttcctttttggtttaaatacacttaatctatgccagcaactcagtggggttctcagaataattgaatatgggagatctataagaaatcgtttcttactttgctttttactatatttattatattgctgaaacacttaatattttaatcaagggatgttcagaatgttcaaactgaaagaggagggaaaggaacttctcagctttgggttatagaaccctgtgctgattgacttgtacctaaggcctccccaccccaactctcccatttcaacatgcctctgttcagtctaagacttgaagaagcagcttcatcagcagagtaattttatttaaaaaatctttcattttgtaaaactcatgcatgaggaaagatcactgccaagaaaatgagggtccttgaaattgttacccgaaaaatattccatacgtccacgtgggcccatcctacgttcaagttctgtttgttattgcatggcttggaaacagaagaggggatgccctcactcttttcagttaaagtgaatgtcatcacttcccagcagcctagctagattatgggttaataaggagttcacagagtatctaattttgttatttgtctttgtatcatgggtacatgatttggtgttactggggatcactgattttggcatctgaggagtggaaggaaaggtggatcatctccatctgtcccctctaccctccccaactcccttttcttccctccccctccctcccccaccttccacacattatactgttggtttgggggccacctggggctggattgggatgtaccttcgatttatctaagaagcattatggaaatgtggtgagagtcatcacccctgtatgggaacatttgtcattattattctttcctctcccttagaaggaaatcttagtttaattcaaaatacgtaggtgcattggcctctcacagcagggaaaagagtttctgttgcctaatgacttaagtaaacaaataataaccgcccccaagaacaacaacaaaaagccacaaaaataaactacacaccatcctgatttcaggcagggctttcatttttaaaaagcgatttctcaaaatgcgcaagaaaaaagcatataaagttgattcttaagttacaaagagatatgtgctagaaaagctgatcccgccttgagtaatttagacaccaccatttctttgaccttctttaggtcaagggaagtccaaaccatgaaaaaaaaattgtcttttaggtttggccttattcttcttttttgaacaggattcagtggttgccaggtcatggtgtatttaattccttaagagtccaccactcgatagcctttccgccctgcaagagagacgtgacacttgagggggaggtttctttcatgtgaccctgcgcccccagcacatgctacacggctcctctgaaaggggacacgatagagggaagattatgtccgtttgctataaagataaatgtcacacattgactgaattctctttgaagctactgttctgttgcagctaagaataaaataaatggtttttattttaaagacaaagtttcttgtagaaggccaacaagattcccaggatgccagactcctgtttaaaagaaataacagggagagtttcagagagagggtctccaaaacatcttattgtactgaataaaatgtaaatattcttagaagcaaacctggtctcatacagctgagaactaagaatatttcctgtgggtcaatacatagggggtttctggctgctgttttctttaatatttatgtgatgttattaaaattattgcaaaagcatacaaagtccggagagggagatcacctctcctgatactcccattaggcccgtggttattataataaatcttttgtttgtgacagcgtctggctctatagcccaggctagagtgcggtggtgcgatctcggctcactgcagcctccgcctcccgggttcaagcaattcttgtgcctgagcctcctgagaagctgggactacaggcatgcaccaccacacccgactaatttttgtatttttagtagagatggggtttcgccatgttagtaaggctggtctcgaacttctggcctcaagtgatccaccctactcaggcccccaaagtgctgggattacaggcatgaagcacaggacccggccataagtctcaataagccttaatctgagaatgatcccatatatgaacttgtttagaaaattcactttttaacctagatttttagaactgtccgtcattaatctcaattgtattttcgcagtgatttaaacttagtatggctatagatatcagacttctctgaatatttactagttaaaataggcattaataaagtcagcatccataataacagataaacccagggacatccattgctaacctaggctttttttgttgccatgaaatagcatttgagacacataacaaagaaattctgttaaaagatttaaagtccatgtgtattgttaggaaggaagataggtcgtcatcctacacagatgtgtaccggtaatgttagtaggtccagaatggagaccgtaataatgcacagattatgcagatccagggtcaccaggcatcttgaactcctaagtttatggtaaggtatatacgcagaaaccacccagttgcaagttatattgacttgctgcaaatcaccacataggattgaacaacaggaagtttgatttcgaagcctacaaaacagttacatttgttttaaaaatacctttgtgttaaagcagttaagcaactacaaccctccgtgatttaaaaaaatttttttttagcccaatgaagttttgttgttgttgttttgtggatttatgcatagacaataggtagagcagcaaaccagaagtgaagagatgagctgtaatctcagttctgccactaactggtagagagacttctcagcatactacctcagtttagtatcctcatctgtaaacagagctggatgatctccaaggtcttttcctgttttagaatttcttgcttatatttactactgtagctcagtgttttaaaactctgtttattaactcaaaacaaactcttttttttccaatttttgagtttaatatgttgcttcttaaaattcactatcaaacctcccataagatcatctctgctttgggcagatcttgttcattataaatggttcaacatatatctctgtactttattaatgatgtagtcattccatatgcatttttaatataagctgctccaggttcatttttggaaatagctgaggtctaagtacacgaacatttatctgtttatccatccattcatttagaatgtgtattggggcactatgtgaaaggcatacatacactcttgtcctaacacaagttccattgggacttactggcagcctcctgcgtcttttcctttcatttctagccctcatttcacttctctctattcccttaacccaacctttttcatttaatctccttacggtctaacacacacttactgaattatatgttgtacctggcattgtttgggggctggagacacaaaggtaaggacttccaggccctgttgcagccaattcctccctccactcttttctatcttttccatgtctctttttttccctgctgagctggattgtccatcagtattttgtctaaggtgagccagatcctacctgagccacactatggacttctgcttatttgtttcatattggctccagtgacaaactacaacgttgggccaagctctgaaccgtgtatttattatgtgatgttagttgtttagatttacatctgctctgatggtgagttttcagctttgcagggcatgtttagagtttgtttattgtcactactcttactacaacaacggctactacaggtagcttctatttactatgtgacaggtgtcttatgcacattcattatttcgtttattccaataatattattgcctatgaagagaatatgttttctccagaggagcaaattagcagctgttcatcccacttgttttcttagcatttgatggaatttagttgtgtttgcagtgataataactagctagtgatatacttgggaaaagttatttattaggcagttgtaaactaggtaaaattatgaacatttcaatcctattgcctcaagagtgtatggttcattctgaggaagtggtcctctttccttaggttctaactttgagtgaaatttacagctgtcagtttcctgaaaatagtttggcatacgaaatagaatacaaccttacttcctcccttctttaaagtagttaacaacatcataaacacatggagaacgtctctaaaatatgaaatttctttcttgaataaataaaaatgtagatgttatcggtgagatgactggccaaaggtgaaaatcagtcatggtacttcggttacttttatcatttggtttctgtcatcttcctttcctgctgtgatcagttaaaaatttcaaaagttacagtagtgtagctatttgaccacatttcttgcagttagtttctcttcattgtgtgttctaatttttttcctagtcagtccaagtgcaccctaatttgtacccaacttgtgtattttggtactaattaaaactaaggaagcatagctaaatggatttatatgaaataataatatgcagggttaaatgtaatgtactctgtaaaacatttgaaataaagaattgttgattagggtgaagactgaggggtctcagaaagaataggaaacgcattggtcacattaggcaaggcaagatgcgaggggaagacggcagtgttcatttttttagctaatgcccttttattgccttcctatggtgtgccatgaaatctcaggtcagtggaaaacatctcagtttttctctcctcttccagacagttctgtaaaattaggtagtttaggaatttgatagtgggacatacttcttgaagatggggatcaatgacagcctgtttgtttatctctttcctattattttgatgttcttacaaccccaaacagacattgttatgattatttccctgtagtgtatgacaataatttcacctagaggcctgattcagtcctttctctccagtctgttgttcatcttgtagtcttcatgatcaaaatatcagggtggaggaaatgacaaggaaggatagaagacaagagacataattacagataggactccagatcggcagaggcaattcacaaaaagagacagcagaaaagctacagggggttaataaaaatgcttgtttatatgtgtctacaaggtgtgcttttcctagagtaaaaggaaaccctcatttcctgttactcccccaattaaaaaaggaaatacatgtggtggaacacatcacaagtggaatttccagacttgattctttttcaagttgcatggttgagctaaccaatagacctgtattagtaaaactgcatttttggaatgctctaactttattccagaaccctctggttccatccagttgaagtgctcctttgtatgtagagactcagttgacccagtaaatacatgatgagattattttaaagtatactcttgggaatattttcttttaaaattaaaagagtaatgtgtacattaaaaaattcaaatagtacagaaggatatgaaatgaaaacacaagtttccctcctgattccttccttttaatccacaatccttcagtggtaactgcttagtggtttcctgggtatgcttccaggaagttttcatatgcaaataaaaagataccattttttgtttgttccatttattcatgccattcttcccactccctccctttattttttctcaagtattttaaagcaaatcccagacatcatatccgcttgtttgtaaatacttccatgtatatatcttcaccagataaggacttaaaaaaataaccacaattccactgtcacatctaacagaaacaattgctaagtgatattttggaacatccaagctataatcagtatttcctcaattatctgagaaatgtccttttacaatggttttatttaaacagaatccaaataagcttcacaccttgctttttttttttgtatatatctcttaagtctttatttttccataaccccttctcttttaaaaatgccacttacatgttgaagaaactgggtcgtttgtcttgaggaattcacacattatagatttggctgatttcatcccgttggtgtgtttaacacttttttaaaaaatcaattgtatttccaataaagggttagttatatagaggattgtttaattttttataaggacatttcacagatgacatatcagaaggcacatggtatctgccccatttttagtaatgttaagattaattagtggttttaggtgttgtcaactgatccatcctttataaagttccctgctaatatttcacctaatggttttagctgtgactgatttccacttttttagaaaacaaaaatagaattaccctggatatatggttttgtatcttgctttatccaccaatgctaatatcttggacatgtttttatatcatcgtctgtagatctagctcatttttaaaagtgctttttatattttattgtgggcacatatgctaagtcatttaaccggttttgaaatatttctgattccttatgattaagaaagaaatgtctaagttcttgattctgcttctttttattccctgtatccctaaattgcagaggctagtgtggcactgagcaatataaattggtagaccaaaagtttagcaatagtgtcacaacagagacccttcactttgagagcgaccttagctttatttggaggaggtagttggtttgtttaatttcttgaaagattggagcatttgtggtggcctcattgcagctcttcccaaagtgggcaatgaggcccagtcaccgtgcagaggaaggcagcacatattgttagtggctaccaaagggacagaaataaaagggtcaaaaaccctgaccttaagaccccctgatggctaaattggcagcagcatctgctcaagccacaactaaacaagtcagcagtagggatccgaaaatttgtctccattggagttcagagagtgaggtttatgctagctgtttggttttcagtgtggagcagtgcattattctctgtcccatgtgatttgtttttatttctcactgttttcaaagttcaggaattcagacatggacttgagtctgacagtttccttcaggaaacaaagcccctgcattcagacttctctgactgtgcatggtgcccttgggccctgagttaggacaggctgggcgaagcccctttgccgatgtcttccttagtgttggatggcctttggaagtcagactttcacaaggcaggatgatcagattttggaaaatggagcccagatggaagtaactaggtgaatatgggtttctacctgaagaaaagcagtactaaaactttcttatggataaaatctcggaattgtcaagaaaaaaacccaaatcatttttagtgctttttatatggcagtgtatgtgaattaatgccagatgcagtgtacctttttgttttccttaatggtcctttctttctccttcttccaagcctcagaagaggaaagtggaaagcctttccagtgtccaatatgtggtttggttattaaaaggaagagttactggaagcggcacatggtgattcacacaggtttaaaaagtcatcagtgtccgctctgtccattccggtgtgctcgcaaggacaatctcaaatcccacatgaaggtaagccacctaccgactgcacctcctggagaggcaggcacagccagggcttctgtacatggtctggtgcaggaggcttcttggccgagggagggcgcctcactgatgaaacatgcggatgacagtactccacgtagcaaggtagaattcaacagaaaggtgttaatgtccactttgcagccaagaacttaaaggcagagagagagaaccttcgatatccaaataatgtatttactggagggcggtcctctcctataggggagcaacagcctgcctggcctgtgtgctgacgcatttcttggggcactcagaggcagggctggggaatagcaagaagcagggaaagccaagttcaggaagagctgctggactgagcaccaaagagagggctgttgaacctgctccccttcctggagagactgcccttggctgttactgccttaccctccagcttgcaaactaagaggaacacacagagacaccgtgtaggaggcatgaagacagtgaaggcaccgggcctttaactttatttagccctgtgggaggcttgggggccctttctaacaagactgtagtcctcattgaggctgtcattgtttgagctatcataattcccaggattacatttaccaaacatccaaggacataattttcaatgtcctattaaaaacaactggggagctcaaacctacactaaacatgtacagaaaaattgactggaatccatgagtccctcttatatgagatgggggaaaacttagttagatggaaatctttttagctgactccgttaatgcaaagggttttgtctcaaaatccaggaggaaactcatgggatcaaaagagcatgggcttttgaatttgatagacctgaattgaaatcttattatgcaacttactagctaagtggccttgagcaagttaacctttagactctgaattttctcatctgttaaatgggaatcataatgtttgtctggaagagttgtcattagtatttaaggagagaatattaaccaaatatctgacacaggaattttcaatggaagttatttaattctaataactatcattgagcatcttaatagcaatcatatcttcactgatattttcgatatgatttggctgttgacattatttataaagtgtttactttcctaccataagaagtataatgtatggacataattaaggtatttgcttatttggaaatcttgcagtctaatccttttaaatagatcagtaatcactcttcagaattgtagctctaaaaaagtgtgaccagatagaacctctactgactttaggaaatagcttggaagattaagaaaatttaaatccatgatgtaatttgttttctatcatttgcctttgtctcctgggagtagcatgcccttcatcttcagaatccatttaaccaggagttctggttggctgaattttactcagccgacttagtttttactttaaccctcctcatcctctgtcacgtcttcccagagtaaaaacttgtattttaaacctgcaaagttgaatttcgttagcaggatgagacttcaaaagaaatgcctttaaaatgaaaatttgttttagttactatttcctaagctgtgtttagaaatcaggtctggcaaatttaaagcttcagcgagcagaaaacttgcatctagcctgacaccttgtaagcttggtttcagctcagggtcacttaaaacaacctatttataaacccatggaaaaaaagcagggttttcaatagcaggaactactgaccctgaaactacagggagatgagttgggtgccttgatgacacagacggccggccatggcagtgtcacagatgagagctgcaagggctttgtgggtcgtggggtcttagaatgctttcagaacaaatcaataaccagtacgataaagcagttgtgtgaaattactactttattcaaactcatggtgtcctaacctgttgagctatgacttgagcttttgatacgggaagtgtgagaagagctcatgcaagtttaattttatcaaacggtatattctttcttgtccctgctttccacctcacttattggctgttctttttttaatcaaagcattcatgattttatttggttaaaatactttaattttgctacattttgcaaatctagtctacctggaaatataatggttgtagtcttatgggtagatatcctctgctacatccaccagagactacaaatatggacggacagatttttttttttttttttaatttttgagacggagtctagctctcttacccaggctggagtgcagtggcgccatcttggctcactgcagcctccgcctccgggctctaagcgattctcctgcttcagtctcccgagtagctgggactacaggcgtccgccaccacgcctggctaatttttgtatttttagtagagacgaggtttcaccatgttagccacgctggtcttgaactcttgacctcaggcagttcacttgcctcggtctcccagagtactgggattatgggcgtgagccactgcacccggccgtggacagattttcttaatgaattctgcctaagaagtggggtcagtacgggaggcggagcttgcagtgagccgagatcgcaccactgcactccagcctgggcgacagagctagactccgtctcaaaaaaaaaaaaaaaaagtggggtcagtatagccagagattaagatctcaaactgtatggtcagaaaaaccttagttagaatctcagttccaccttaggaactgtgagactttgaaagaatcatttaacctctccaaacctctgtttccactaatggagataataatcatacagtctgtctcatggggttgttatgagagttaaatgagataatgcacataaagcacttaatacagtgcccagcctggagaaacaacattcagtaaatgtagctaatacagtgatcattatcggaaagccatctcaatatacattaatgtttatttacatttagaaataatcaatgaaatggtataaaaaattactctaaaataaattttattccttttccctttttgtgatctgtctttagtgctgagaacttagaaaaactgataaacaaaggaatataaagttgatccttaatcccatcaccaagaatgataaataaccattatcactttgatgtatattcttctatattggtatatcgatgttttaaagaaaaatgggattctactttctttgttcaacaaatatagtacttactgcatttgtattatagtacttactctatcctattatgtcctaggcactgtacattcttttagcccacctttccttcataatatatcgtgcaaatgtttttatcacccgctgtggaaggagcttataaaggcctccagatttccttggggttatctcagatttccattaagtcctttaaaattttcctggataagtgaacatacaggaattcaacatgaattcataagctaaaattgaacagaaaaggtgaggaagactgctaagataaagaacactggtgaagtattagcaggaaactgaccgagagtcagggtactgagttctagtagcctcaggtctgccatttaaggagctctaacttctcatgaaggccctcacctgtccccctagtgggggatggagtagaggtttcccaaaatttccccaagctctgaaataccacaacccaagcatccaactgctaccaagaaatggccccaatggtgaagagatggccctaatgatgtaacagcacctgatatgggttgtttgtgtgaaatgaccagaggataggtgagcccctaaacatggcctggagagaatgacgtgctttagagaagcatgtcttcattttagtagactaagaagatctttaaagcaaatgtcaagctaaagagaataaaaattatgacagaaaagtgctcgaatgtcaggagagaagggggaaaaactgcagtcagaggatagagctaatacttctctcaaaggccaaatgtgatatatagtccttttgggaagttgtagctcaaaaaaaattgttaagtgcaaaagtcaacaaaatacccactgtttttcctttaaagcttcactaatttgtccataactaaatataacaaggccaggatctggtgaaaaagaagtcacataaaatacatgcacatagacggtttttaatccaggactcccttttgattttagaacttgggcttgtgctctgtccttttccttcttccagaagctgcttccggagcttctgttcttggattagctcccctcctctcctgggtcagtagatgtaaggacacttctgaaatggatctgccccactgcactgctctcagggacaatggaagctctctaactcgtgacctttatcacctggttccagggcatgcttttggcagcaccggtcagggtcccatgggactgtgacctgaggtccccaaggtgcctgcttctgcgtgaattggtcggaggagatggtggggattctgtgagaaagcaatgaaatggtcagctcctagtgaaatccttttgttgtgaaagaacagaaaggggtgatgttaacagctggtgacaatcagtgtgtttccccacccccagcactccaccccagcagagggaaagcctttccatgatcaggactttgcctaactgagtttaagtgtatatggctatttctgttaagaaactcgtgctttgggggacccagaatctcttctgttgtttttttcaaaaagccacagtggggtgctgtagcgacaggatctcaccattaacttttaatttctttgcttttgttggtcacttaacattatttaaaagtatgttttggctggtgaataatgcttttggattgcattcagaatgcataaacagctgttgtaaaacttgctctcttggaaaggaaacctaccgagaggggccaggtggtgcagcggattaacgcatgagcctttaaccttggtgagacctgggttcgagtcctgcttaggtcacccctaaaagaggaggtgtcagttttgttttgcttttgggttccaatcactcacttgtttgttcagatcacacagctccccaaatcatttggcccacatctacacaattggcagttctacttaagggaggaccagtcctgaaatagcagagtgtagcaggtcagcactaaagtgcattggcagagataaatggggaagttacaagcttatgagcacctgccagctcaaagcctggctcaggccaatgcaatgatttcctcacttttttaagcactaaatttggtagtgacaggaagaaaaagtttctcccaatttttacaggtatcatgtgcatgcaagactggaactggatttaaaagtctgcattctttcattgcagacgtcagaatctggagcatgatattatagccacgtttggaaaaattggtttcctcttgctcagaatacttggtgagggtcagaccttggtttttctcctactttgttttttttttttgtatgtaatttcgctcaatccatttattctggggcctcaatttctctgtctttgaaacgggaataccctggagacattattttctacattcttaattacctaagagcagcattttgaaaactgaaattatgtttgcagaacataactaacaaaaaattggatgaatgcaaagtatcattattgtgagaggaattacttgacaggttacctcttttgatccccaactagtaattttgtaagtttggattgtgctgggtttataatattttctctgaagacatcaactgagatcagatgactagaatagtgggatgctacccaaaatagcatccgttggccggctgcatcctcagttgtgagcatggccctaataatggactcttaacctatgtggacccactttatgtttagggattggcctcattacctggagccccatagtgaaatgctctgcagtacaaaggccagccctttgcacggtgaggaaatgattgatgaatagtctggatctacagcaaggcattttccataaatgcacggtggctagctcattcttcttgcttctccgtcaggttcatcagcaccaggatcggggagagacctttcagtgccagctgtgcccttttacttcctcacgccacttcagcctgaaactccacatgcgttgccatcagcacttcctgaggacagaagccaaggtgaaggaggagatcccagacccagatgtcaagggatctccccacctcagtgacagtgcctgcctggggcagcaaagggaaggaggagggacagagctagtggggaccatgatgacgtctaacactccagagaggactagccagggaggggctggcgtctcgcctttgctggtgaaggaggaacccaaggaagataacggcctgcccacctcctttactttgaatgctgccgacaggcccgccaaccacacaaagctgaaagacccctccgagtatgtggccaacagtgcgtcagcattgttcagccaggacatctctgttaagatggcgtctgattttctcatgaagctgtcaggtacttgaatagggttgtattctctctctctctctctctctctctctctctctctctctctctctctgtctctgtctaccagtattcttatttgtaaaataagctggtagaactagatgatttcaaggtccctttaaatttggatagtctgcacttccatacattttctccttgactttgtgtgtgtgtaatcctttggaagtagtattgctttggcttgggtctcaaaacagtagggattgttgatttccttctgcttttttccctttggtgagttcttactgtaggggggaatggtcacatggtaagccaggcttgtgtcagttgcttgtgtgacattgggccctgtttaacatgtctcttctgcactggacttgtatgaaatacctcattttggcattattcaagttctttactgtcttaatttataagatttttaaaggacatatatacaaagactactattaggaattatagacttctaaaatttgagcaaatgataactatctttaagaagtttttcaggtttttttaatgggaaatttttttattatggcaaactgtatttaacataaaatttaccattttaaccattttaggtgcacagttcaatgacattaagtatgttcacattgttgtgcaaaccattgacccccatccatctccagaactttttcattctctcaaactgaaactcattaaacaactctcggttcacctcttcccccacaggccctggaggccactactttatgtctttgaatctgactatagggacctcatataaagtggaatttaaaaacacatttttaaaaaaaattctttttttaaaaaaactgccctgatccatttgggaaaaaaagatggagtataaattataaagatgtattcttattagttgacattctttctatcaccatcaaattgtacatgatgtttctttttttatcattttttcccaacatatttgatttaagtcgtggtgttgaaaaggggcatcaaggtcttagggcactttgtttttcctgtcattctcttttggaatgataaggtgtgttgcaggattgtgcagctactcattacgcttttaagagtatgattttaaattttaaaggagatgtagggggtggggaaaggtcggtggagaattggttctgtatttcagtgaagatggaagtccccacgatgatttccaaatgccatgtcagctctttggagattgacaatacccttttaaatggagaataattggtcaccaccttcctttaaatggaatgtgagtcgcatttcactaaatgtcattgccaggtgaattagaggttcagctccactctgaagtccctttgctcagggacacttcagtcgggtcttttggaatgtcccccttaccacagatctttgctcctcaggagtgggagacactagttggaagaaatgaggaaaggtaggggatggaaaatgagatgtcccagaaatgaaccaagtaggcaaagagcggggaatgtaacagtgaagcacaccaactggcaatgagagtgagggggccctatgctggaattggccaagtttctgactctggctctaaagaacactggcttctctgctcctcatcacctctctcccccgacttctccctcctctattccaatctaggggaaaatgtgatttttagagactttgagttttatatttaaaaatttttgaacatgtggggaaaatacatgttttcatgtattccatgtttgctgttctgatcctttaggatttcacctccaggggaactctagtttttccttgattgtcttccctgccaccgtgatagcaaagggggctccttttatgggcccttatagtgcaatccccagggaaggaatgcaaatgacatattcacatcacatagcttagaaagggggacatttccttacctaacagacaggggcaatccgagtgggggtgaatgactctgaataaggtgttactccctttactccatgactccagggatgttttaaaatctagaggaagttgagcgagaacagggaaggtttggtctttggataaaacacttgtgtatgatgcatggcttctgctgggctcagctctgagtgctcacattacgctgtaattagctctagacccaatctcagggagcataagataaggctgcttagagccagcactgcaagcagcagacacgaggggagaagccagttgataggttggggggaagaattgcgcatcaaagccttatattgtgatctgtgttttcagttagctattgatggggagttgtttatggtttggtagtcagaatatttactgactgataattggcataagaaaacagataacaaatgcacacactatttatgcaaaaggcccatgtggctattttatggtggcttactggaggtcctgaaacctgacttgtatgcactgttacctagcaacctgttataaagtcactggggagtgagatgcatccttaatttttttgtgtgtgcatatttggatgtaaatgtaaacttggtgactgtggcaatgcagctcaggagaggagaagataagttaaaaggaaaggaatacattttctagagcgattttttttttttttttaattttacttaccctctggttggtctggccatacgtttgatagctgctctcactgtgatgccctacctggctgtgtctgtggatatgatttagggacaaaaaggccaaatcccagggagctgcggctgagtttctagctcttcccatcatcaaatgtagtgaagtagtggctagtctcgggccttgtcccttggcgttataacggcgccattgttcttgcactgaattttttccctgggctctgtccgtgcacctgctggtactgtagggtgcagctgtttgtgggcactgagtctgtgaatctttgtgccagccagatcactgtctgcaaaactggagcacagtgacaaattcaagcgtgcagacacctacttgtttccaaaagagagaaaacacttgatgctttcttgcctggttattaaggggagtctttcttgctccttcaactaaaactaagcataaagatgattgaatggaaccgagtgggattaaaagtcagtggatagaatactgttttaaatggactctcaataccccccacccccattcctgttagaggtttcttaacgtgcatgattgtgaaataaaatcccttctccaaactatcagctattcttctgactgagcccacacttaacactgcttggtccttcaaaaataatgctgcttgcaaaacggaggcttccaggcccggcatcgcagttgattcagggaatagtatgggcagctttcagggctgacagaaaaatgaattttgtagatttcacccacggtttagactgaggcagacctgagaggactccaggcctgtatgttccagcagctctttcctggaagccagaaagcatatgcaaatcattgcatgtcagggcaggtgagccagtggtcacgtggctagggtgttcagggaaaaggtgttcacccgactgcggagagctaagttcctgctgattctgtgccttgtcacccatagccagcagcagttcttaacctcggctgcacattagccttgcctggggagtttttcacaaaatgccagggcccagaaattatgattcactgggataggccctggacattggtattttctttaatatcctcaaatgattttaatgtgcagaatgattttagtgtgcagccagggctgaggaccactgatgtggaatataaacttgttacatggtacagtattttttggtacagctacggttttcatcagtgcagttttgttcctgtggtctccagccgagaccatgaaacggggcatggtggtatgagataggcctgtggctttcaccataggtcaaggttgacatgaaggagaggcctgggtgagttgtgttcatggagccccaggtgtttccttgtggggcctcctgacaggggagtttctccagttaaaaagtctcaagattcagtgcagagcataaaggaactgggagggtcgtcattattagaagcctgattaaaagttgcctgcagcaacggccttacatcatttctttttccgaaaactacccttttcaagatataaaatttaattctaactctccaaattataaccaagcagttgacagaaacttggcacttcacttgttggctgggaatatctttttgtccctggttttccaaaataaaagatatgtcatttcaactatttttaatttggaagccagcaaaaattgttgtgctgtctcccacatcatattaatttcgtaaaattgagaccaaaataattttaactaggagagatggacttctttaaagcactaacttacttttagcctcacagagacagtttatgaacaaatggatataagctaaactgtttctgacttattagtagctcatccattaaacagcaaaggtgttcacatataaacgtagggtgtaggttaatgtgtttgtgtcatatactgtagttttccattggcctttgttctacaacttccatctatttcacctgcttttaagcctctgcatttacaatacagtttttgtataaatggcagctccccatcttgctttacctttgtttgtgctgctggagaaggagggatgggagatgcccattgaactaagtcatcctcattgcccagtggctctgattgcctttctgtaaaggcagtcatctcaacaaatgagccttcttccaagtaaatgccatccttgtgttattcacaccctacgacggcagtgccaacagccagggggctctcccactccccacgcctgggcatgccctctccagtcaggtgattttcgacagcctccctttgcatttttagtttagcccttccttttaaccctgccttgcttttctggtgatgggcactcactaatcacgtgactaaaattcctcatgtgagcagctgcatttaggggccttatatgtgtaagcggcttgaatgcccttttgaaattctcgactttattgaacttggtgattcataagagaggaagagtgtgactctttcttatttttcagtgacttgccactcatgagacaagcactgacctgagttaagaaaggagcaggtaggactataagtaagtgggacctggaggattatacgtaagtggggcctggattgcttacacacacagttgctgaaacttgcatggacagagttcttacgctagttactcattgcttattatttttactttgtttaatacttactaactcctttgagccttgtggcaacgccatagtaggtggtataagtattcccattttacagatgaggaaactgagaaatggagaggttaggagtcttgcccaggttagcacaatgaataggtggtagaactgagattcttttttttagacggagtctggctctgtcgcccaggctgaagtcagtgatgcgatctcggctcactgaaacatccgcctcccgggttcaagctattctcctgcctcagcctcccaagtagctgggactaaaggtacctgccaccatgaccagctaatttttatatttttggtagagatggggtttcaccgtattggccaggctggtcttgaactcctgacctcgtgatctggctgcctcggcctcccaaagtgctgggattacagatgtgagaaactgggatcacaggcatgagagactgggattctaatccaggcagtgtggttccaggattctcttccccaggctgtctctacccacaaattacagaaagaagcagcaaaacaggaactcggctctgttctctgcccttcttgtgcgttgtggaattagccaggatttcagcatgttctggatgttgttatgtcagacagctttagaatttgtgttaatagttttaggcatctcaggaattatttagtacaaatagagcagtaagagtagggccaactgatatttctgtagagcttcacagcgtactgtgtatttctaaatacatcatttcataacaagcatgtagatgagaaaaccaagacttggggtaaataactataaaagagtcatgactggaatccagacctttctttcctgaccctgctagatagagtgtacctagttccagaattgccatcagagtgattttttatcttgatagacccctgggaaattttaccaaagcctattgtatctgtaaaaacaaagggaagtgtcattctccttgaagtccgttctttttactactgttgttattattgttgttgcttctactattattattttaagagctataattaatcaaatgtgcttacagtgagctgggcactgtgccagccacatcatgtaatttctcatttaaccttcaccacagccctatagggtctgtaatagtaaacctatgttatagataaggaggccgagacttaaaggtttcggctgcaaaggacagagcaaggattcagctctgggtaaccacagaaggttggctcttgactacttaattagctattacctattttttttttctcagttgagcaaactgtcttttgacctccgtctgcttcactgtttattttccttggcttcaaaccatggcatcattttgaatgcatgcactttcagtcactaatctagttaaattttttgtgtcttcaaaattgtactgaaattttcatctacactccatcccttcatgtgcagcctgctcctcatgcctagaagttgcccctccagctccctccctgatgccttttcctccccagcactgcccccacccatccacccagcatttctgatggacttttcttccagtacctcttgcatcagatcatgctcctgtctggctagctcttttccttccttcctcctttccttctttccttccttccttccttccgcccttcctcccttcctctctctcccttcctcccttcctctctctcccttcctcccttcctctctctcccttccttcctttctctctctccctttcctttcctttcctttcctttcctttcctttcctttcctttcctttcctttcctgtcctgtcctgtcctgtcctgtcctgtcctgtcctgtcctgtcttgtcttttttttctttcgagatgaggtcttactctgtcacccaggctggtctcgaactcctgacctcaggtgatcctcccacctcagcctcccaattagctgggtttacaggcacaggccaccatgctcagccctagctcctttctgctcagtaactatctctccacttctcttaagaaaactgttaacagtcttcaccagctcatgaacatacccctctcatttccatttttctacctttactcatgttgttcctggggtctgataattggaaccatggaattgcatgtatattttcctcctcttgggaggagctacaaagtcacactgtaaagaggtgggcctttggaggggggaatcgtagccatttcatggtctgccacagtccagagttcttcagactctctgggtgatccacaatgacaaaaatcatttacaaactgatctgtaaataagaatgtcagcatattaatttaaaatgacaagtatagcagtcaagaggagatgtcatttggggcaagtggatcctgactttcctgaaaaaggttggaaatatattatccagtcttcaggttttctttcttctagtctccaggcaaaccactccattgctgctcatacatttcattctttggccgtgttaatagtgggaatttaaaatacagccttctttcacatttacttagggcttgattggttttccaggacctgtccttcctgcttttgacgagggagatatcctgtctgttaagtgggttactgcagatggcaacttttgccctttgtgggttggttttagtagtttagtttttgcaggaaaactttatatattttaaaattcttgaggcactgctcactttttgttatctttgacccttctgcagaggctgtttttcccctttggccatagctatcataggaatctttacagtcttgctttgggtacatagacactgaagggtggccaaggattagctcaggtggggattaatgagaaatatgagatggctaaaatttcactaaacactaattataaaatgatttaagggaaattaaagagcaagattttaaaatatttagcaaatgttctaaacattccatttgaatataatacgcttaacatttaaaagtcatatttaactgttattaattattatttaattaaatcttggcttttcttacgatttcagaaggcagtttcttacccaaagcacatcatagtgctgaaaaatcccagatccccaacctgttcatacatacatacatacacactgctaacaagggaacttggttggatagaaccgcaccggcttgtgatctggagagttaagctctgattctggttctatcattaatgagctatgtgattttcaaaagatcgtataatcctctgagcctatgtgttcttattgtaaagtaagggagtggaaaacagtaatggctttcattttgtttcaaaagttcacatttattacatttacatatttaaaaagccaagcaattagggggaaaaaaagttgctatttggtgagcacaaaatgtgacactccagtgctatgagggagtacagtctgtagcaatgtgatcatctagtatatttctaaatttattttgctgatctcagtttgaaaaaatacaagtacggtttcacatagtggcaaatgggaacagatttttaacaacttgtcttgtaatttcaggatctcctcaattaaagaagagtataagcttttgcttcaaagttgacaacatttggcaactgccctcattccttataataaatggaagataagcagtatccagaactcacaatatgccctaaagccatctgtaattctgtgtcaactacttggttattactcagttaactgttatttgggaaatgtatttaatctctctaggtctgagatctctcatctgcaaaatggggataatactagtgcctacctcaaagggtggctgtgagaattagataaattaatacaggtaaatacttggtgtgttacccagctcatgttatgtgctcaataaatgatagatctagctctatccatatgtatctacatatgtctatttgtctgtctattagctatggtcaaaagctgcaccaagcacacttgatacacttgaatctacccttgcatttaatttaaggcaggtatgcccaggggatagctggcaatgtctagagaaattgtttttttcacaactgggaagtactcctggctactagtgcgtagagatgccaaggatgctgttaaatatcctacaatgtgcaagacagtcccccacccccaactgctcccagcagattatccagtgcagaatatcagtggagtggaggttgagaaacactaatttaaagtatgtttataggctctagtaggactataattatatatgaacacacatgcataggcctgaattctttgaaaaatcagtgcaaaggcagccacttcattattgatgacattactacaactgcagctctcctatgagagggggagaaactgcattacaagggctactacacaaaactgaatcaacttggcaacatattagtggtctccagtatgttgatgttttatatataatgcagtggatgatgcacgctttgaacttaaattttaaattaattaattttacaatgattttttaaaaacttaaattcaaaacaaacatttgttggaacccctgaagcatatcctagggttccttggaacactgtttgaaaaccattgctctgtagtcccttccaggctcaagagtctttggccttggtttagggtgagatcgtaaataaaattctcagtgggttgctttttcacagagcagttcagcatttataaaattgccatacgttgaactgaaggagagttctgtcttattaagctcaagaaaaggtgtcattttccttcaccagagggaaccaatagaagtatttattttgcagttgattccttcccttcatcctcctagtcaaatcttctcaggatttcttcctaccagaaaatgtcccttttcttcagacaaaacccacccttccctttctcatgaacagtgcttaattcacccacatcacttattttccaaagccattgttcacctgctgaggatagtgtcccttttaaaggtacctgggtgtcttggagagaaaggaaggggtttggatgcatttccagtgagaaactctgagccaagtgtctctgtgaattagatctgtgatttggggcatcagtttcttaacctttttaggaccttagtttcctcacctgtaaaatgaagatagtaataacatctgtctcctgtgattgatggaaggtttgatccctatgtaattactcaagagctagttgtatacgttgttaaaacaaatgatggtctttagaaggaagttatatagtattttccctagtaatagggaagttatatagtattttcccaattactatataactagaaaatattgtaaaatatatagtattttctagttatacagtaatttcctagaattggaagactggaatcatcttatcccagcagctttcccattcctttcccacatttgcctttatcttgaattcttcataaatcctcaaaaaagcggatttgtttcctttaaatggtggtccacctccatcaagtacataaactgagaggtatgtgtaattgatcagcagcgtggcccaggtcctacgatgctgggaacaaacagcgagagagggggcctcttgattaccaagggctttctcatcacatcaaaagtgcagttatccagaaactttcaaataaataaacagaagtcaaggcaggtgttgtgaaagtccttgacaagttgagttccgcacctgcacaaatctttctgtgttagtagtaggaataaagtgaagactatgtcatgagtcataaatggttgcttttctcttagcaatttccccaaagaaaaagaaaacatcttgaattccacctctcactgcacatgtgggtttttttgtaaagtgggataatttaaaagatagtaattattaagtcatattaattttaaaatataggctttatgtactgttctcaatgtaaatatttttggtcattgaaaaaagcaggttagccttcatatttctatttttacgtcttctattgagacccaaatgtttgggaaattaaaacttgggcaaatgagtgatttccatatgctcttctgatatgtcattagctatatttacatttcctcagcacattacaattttctgttattctctgtattgtcagaatgaaaaccaggtatgtagtgccttgcaaatgtataatccagcaatatacagcttgcctattgccttttaaagtgtctttttgaagttctattaaatccaggttgtgctagcaatgctaaatatctttacttttttccccctaagtctcttatagcatatactctgactaatgcttctagaaaccacttacatgtgcaggaagcatctgcttaatgatctctagaagttgggatttgctcctggggcctcaatagttttttttttttcatctctttcttagcttcatcttagaattttaaaatgtttttaaataaaagatgcagcaaggaagcattttaaaaatacttaaccattcactttaaattgttcttcctcaaagaatcaaagacacagacttaataaacaccctatttaattactctgtcgtgatgaactagggtgcccttggaaaagactttataaagggttctgggagaatggtgttgggagagagcaagctttagaagggtgaccagcaaaatcccccaagaagtgggggaaaggtgcaaaggggagaaatgtgctagataaaccaagtcctcttaggagcaaccttcctggtagacgttggaagtacatatttgaggattgctctgtagaccattattgctccctttgattcagattcatatggcattgtccccaaagggctagattttaagcactttccttgagatttttctggactcctcctttagtaatgctctagttcaagtgatgattagatatttcagtaatgctgtggtctaggtagaaaggcctttaactttacttcaaagatcttatctcccatctaattattaaatccagggaaagcacttctgattgcttttggtgggatattttggaggtcttagttcttgttaacttcagataatattggaacgccattggatgccactaatttggagcaacacattttactcattcaacaaatatgtattgatcactaactatgtaccaggcactattcagggtacttgagacacatcagtgttaaaacaaaaattgttgggccaggcgtgtcggctcacgcctataatcccagcactttgggaggccgaagcgggtggatcacgaggtcaggaagccgagaccatcctggctaacatggtgaaaccccatctctactaaaaatacaaaaacttagctgggcatggtggcgggcgcctgtagtcctagctacttgggaggctgaggcaggagaattgcttgaacctaggaggcagaggttgtggtgagccgagattgtgccactgcactacagcctgggtgacaaagcatctcaaaaaaaaaaaaaaaagaaaagaaaaaaaaattgttgccttcatgaagcctaccttgttttgtttttgtttttgtttttgtttttttgagacagaatctcgctccgtcacccaggctggtgtgcagtggcatgatcttggctcaccacaacctctgcctcctgggttcaagcgattctcctacctcagtctcccgagtagctgggattacaggtgcatgccaccacgtctggcttatttgtatttttagtagagatggggtttcaccatgttggccaggctggtctcaaactcctgacctcaagtgatctgcctgcttcagcctcccaaagtgctgggattacaagcatgagccaccgcacccagccataaattgttaacataataaattttaaaaaccatatagcatgtgattggtctgttaaactaaataccgcgtaacaaaatgccacagactggatgacttaaataacagatttatttctctcttctggaggctggaagcctaatatcaaggtgtcagcaggtttggtttctcctgaggcctctctccttgttttgcagacggccgccttctcactgtgtcctcgtgcagactttcctctgtgtgcgtgcatccctggtgtctctctctctctctcttcttattcttctggttctttaatggaaccagtcacaatgcattagggctccactcttatgacctcatttaaccttaattacctccttcgaggtcctacctccaggtatattccacactggcaggttagggcttcgacatatgaagggacacaattgagtccataacagtaggttattaggtaataagtatttggagggaaaaatgaaagttagatcagggtaagagaggttgggaggactgtgaaggtggtgattatagttttgaacaggatgatcagagtagacctcactgagcaggtagtatttgagccgattggaaggtcaagtattttcaagttttgttacaatacagagaccagaagtggaggtggtgcggtggaggcaggtaagggacacagcaggggaagcccatggacttaggttctggtcccagctctgcatctttctggtagtgaaacttccagatagttctttgggcttctggggttcagtttccaaatatgctggtctgtgtgaacttgtgattccagaatgcatattcttacaggggtatgagatggaaaacagactttgtgcttgagtattggcttggagtaggtggtaggcaaggggtgatagatgtttgcttcggggatttatttttatctttttgtctgttaagatggaatggacttaaggctcattctaataagtgtttctaagaatcctgtattaggatgagatcctctttctcaaaagatggacacaatcagtgtaatcaatcctaagttcctacctcatggactcttaaagggagtgagatgcctgtgaaagtgaagagtagtaggaagagggtgcttgtctcttcctttgtggtctttcctgggtagtatgtagcccagtggagaaggcctggtacagtgtggctgagccacagaatccatcccataataggccagttagctctgtcctgaccacacactccacagcaaccaaccatgctaaaaatggaaaaaggacattagtggaaaaactggtgaaatctgaataaaatctagagtttagctcatagtaatgtgaatttcttagttctgacaaatgtaccatggttatgtaagatgctaacattagggaattctgggtgaaggatatatgggaactcttggaaccatctttgcaacttctctgtaaatctaaaattattccaaaataaaaactgttctttaaaaaaaaaaaggccattttggactcagtgatgacttgggctacagacatggatttatcaccataatcagaagaacagtgctaagtaaatgccccactgtttatggatcagtagtgtcgtcttataatgaggcaagagtggtctatctctagtctgagcttttctgtttggcaaattctccatcctcactttaccattgcaccccaggtttttgctttgggtactgcctctgactcatgtttgtattcaatatcttatggcagaataattgcctgaaagcattatttcataataggattaggtggggagagtgctaataagtcagggaggcagtggcatacacaggaaacaagacttctagggaaaccaaagagaaaatgcccagaaactttgtagaggtagcacttcttaaaatattttaggttcaaaagattcagaagcccacactcctcagagttgtaggcccatggagtgtattgtgtggttttgcccagggcccagcctgttctgatgaggttgtgatccctccggttgttagcacagtgtgattgtgcattccatacttcgtgaagtaccagggcagctaaggaggggagtggccttttatgtatatataatccctttttttcttttgacagctgcaaatcagaaggagcccatgaatcttaattttaaagtgaaagaggagcctaaggaaggggagtccctaagcacgactttgcctcggtccagctatgtgttcagcccggaatctgaagtgtcagccccaggcgtctctgaggacgcactaaagccccaggaagggaagggaagtgtgctaaggcgggatgtgtcagtcaaagcagcctctgaacttctcatgaaactctcaggtacttgatttattctaaaatattcacattctgatagtttcacttgcaggccaactggactgcttcctgcatgggttataattaacccaatggcagcaatatcgcattattgctgtgaattcaaagaacgatcagattacttggcttaaattcctgtgttgtgtgtgagtttgtttgtgtatattagctgtgtacctatcttattaaatacaaccttttcctgactatcactgcaaattgttggaaaccactgctgctttctaaggtgatataggccataattttaaatgggttctaatgatgttcaaaggtcttctgctaattgatcaaaatatctattctttcctaatagaggacctggcattttgtgtgtatttatactacactctttaagcaccattacaaatatttttcttaacttcataagcatttgagatggcacttgaagtaattaccaatagagtggcaataagagattttatggatagagaattttataatggaatattacaataattaatctgttcttaagattaatgaatcattctttactagcatctaaatgtaatctcagcgtattaaatgtagggaaaatagcttataatttgaaattcatatagtttggatttttttccacgtcatctcctatctgccctgtcctctctgaaacaggtaaaaacataatgtcttttcaattcaaagataggactttcagaacatggaaaaaaaaggttatatcaataataatacttgtcaagtcatatcccatccttagttcattacctcttaagcagaatttttagaaactatatttaaaatgctaatatgaatcgaaagctgtttttagtttgaaacttgctgtgcttggagaatgaaagcaagaaatgcattagagagactcctttaagacctgtaatttcatcagcagttctgactgtgtttctggttgactagtgggttggaaagtaagaaattaacagtgatttacttagtcgttatatcagaacagttgaaattcctgtacttaccagttggtggggttaaaaattcttttctttgatgttaattcaaagcacattggaagttcaaggtaacatgatttgttataaataaagcataatgcaatcattacattcttatcatagctctgtcttcctaaactttgcagagatagtgcagtacctcctatgcagatgagatgttagtaagattgtactatttgctattataaaagctgaatatttttataaaggatgttcaagtgaacacattttttgtatatttgaactctccttcctatgttaaatgatgcagagtaatctatttgttgttttctgataaattcaaagaggtcacatagctctgattcttcccccatagcatacactttcacattccagtgacttgaagtcttaaccaacagtgacccctgtctccctccttatggtcagattccagtatataatatttctagttcagagtttgctgtgcagcaggtgttgtaagcagaagagacttgggtagcaccaaaagataatatgcaaaaaatgagatttcaagagtgatgttctttaaggaaaaatattttatcttaatccttttgcatgatgagatttgagacacaagtgtggaatcattttgtagataataatgatatcccccaaacagaatatgtctaacagccatgaacagtgaaagatatttgtggacagcagtggtccttctaaatgtatatgttgcctttggttgagcacatgtgctatggggttcagcaatagttgaatggatgacgtcctgtttccaaagggcatctgcccctgcttcgtgatgtggaaatgaaaacttgtttgaagactgacaacaattatttttgccctgaaaaaaaatcctcaaatcctcagcattctgtgtgcaaaagacttaggtcaaagagatatgcatcacagccctgacccttagatgcggtggtctagtcagaagtaatccagggcagtggaatccattcatgtgatttgcgcttggaacttagtactgccatactctagtggccatggtcaggtaaactgggaagaagttttttagtcataacaataggcatgtgacttaaaagcaaatatcatttcattcctaagccacaaggtaaagaagactcacccttaattaggtttaaagtggatattagagtttctaatcactgatagaacagtgctcttgcaagaatgaagatgttaggaaaaaactttgtgtgttctttcctcaaattgtaattttaacaatttcatagttcatgccctaaaagacatccaagtaaaggacttgtgtcttcagataccctttgccatgatcacttctgttgctctatagacaagagtaataattcatttcccaaaacgtctgtgtagttggacagggctacaccaccagtttgccttggctgatacccccaaagctttgttgtagctgttcttgtgaacaggagttcctattgcttcctgccttgcttgttttcatttgtagtcttcccatatgcttgggaaaatctttctggtcaggaagagttggttgaggatacttagttatgcaaggatgaggcatacttttccttgttttagttttgacccaaggagtagctaagatgtggaataaaaggaattttcttctctgttacttatttccttgaggttagaagtggtgacctatagtttagaccctttcagtcttctcattgaatgaataagaagaaactagtccacaattttggctgcttcattttcagttttaaattaatttatgttaactccttaaggatggagacttggcacctggcccagtcacatatcatgtggaacttttctatgtggagaaaactctgtaggtatattgttttccaaattgacatttgtgttttatgggaaaaacgcagatgagctagagtaggctcaatttttcattaagtgtgcattggggaaaatctgagctttcttccttcctgtggttcgagttctatttccagttgttaattgggaagttgaatgcctgacagctgggccaagtaaattgattgccataaagaaagcaacacactctgaggaaagcactggaagtctgcgactacttgttgttatgtgacacaaggcagccaaaataatcagacttttttgctaagcatatggttgccaaagataattcccagaagtcttcattcaaggaggccgaaatctcagtgttcaatatagaggatatataacattagatagtgtaagagattcagagtacctttaaactctggttttgcaatgtctggtcaccttgcaaacttatgggatagctgtgttatcatggatatgatgtaatgctgaaaatgacacaaaattttgtctgttttgtctctgttttgctttaagagaagtagctagatgcaaagtgatgaagataaatgccctcttctttctttggggagttacatgtttccatgggaatacatatataaaatgtatcatgcatggttgggtgatcctagaagtagtagataagaatgccatttaaaaatatgaattccacacacaaaaagtacatagctggaaagctggagctatgcagaaacattaatgaaaaattaaacgtttacatttctctaacatggtaaataaaacttcatattagaccttaattttaaacaagtttattggttttaaaaatttctgtgctcacccagtggatttatattcatttctggtttatattcatttattcctgcctagtcctggagaaccatataaattacaattgcttcttgtataggaattcaaccaggccctagatttgaaataacatagtgatgggcttagggtatcacctaaatgagatggagcttcagctaggagatatttagaaacaggtaaacttgagtaggatgacattttaaggtgaatttaatctctgcggtgacctgaagtggagaagaaaagaactcactttattagcagctgtaattagggcccctttggttataaataacagaaacccttttcagatagttttggcaagatagaagaatttagtagaagatgcaggtttgggattggcttatggatcccaagggcagagatgcagtggggccttggttttccaccgcagccagaggctggaggcccatatggaacccaggaaccacccccttcctcacctcatttctgcttctctctggaccgacagatggacttcttctgttacccagtccacatgatggaaagggggaattgccagcagcttctgagtttatgttttgctcaaaagaatagccagacagaaatgtctttatcccagtcctaaatcccaactgagtgtcttggctttaactgggacccaagagtggaaacttctctatttagaaatgagggcatgttgggcagatgtggctgctgccattagccatgtgggattgctgggagggagagcaggagggtgaggtgcgaaacaggaagatagaacaatacatgcgaaccacaaaaggtccaggaataattatggtggttgctgtcatttcagtattgagtggaaatgtgtttggtgctgtttatctttccttcttgaaagggtctgagagaaaaacctctctaatttgctaaggcagtgcttctcaaagtgtggtccctagaccagcagaatcatcatgaaatttgtggggataaggaagcgttagagatgcaaattcttgagccctactctggacctagttgaaactctgggggtgggagtcccgctgtctgtgttttcacaagccctcctagcgattctgacagctaaggtttgagaagcactgtgctgaggaagtggttaattggaaaaataagtttcatccatctgagaagaatgctttaggttgaagctgacagagaacaaagctctattaaatgtacattttactttttaaaaagaaccatctctcttcagtgaagattctttttaatttattatgaaataatggtatctgggaacctttttttagaagggcacatgtacctaataaatcaagatagtgttggctgtgagcctcagataatactacttttttcaatgctctttgctgttaaatttcatgattattcctgagcaatgttggctttcatttaggagaaaaacctttctctacctcccctctacataatctaagaccatgttggagactcttctaaacaattatttgaggttaattagagatttagcttaataatttctcagagcaaaaacttatttgcttatttggtattttcccttggaaaattatggtctagcaagctttctaagcagtgtgacttcagtaatctatacggatggaaaatacatgttgtatttttatgttactgccttctcacatttgcctccttcagacttggaagttatctagttaggtggtagagacgatgtgaggccaatttgtacttagttccttatgattctacctgcttccataaaaggctaaatgtagagttcacttataaagtgaacaggtagatctaatcagtctagtaagtccaaaaatcaaaaaattcacatattcatttcaactttttttgagtccctggagaaatttattgaatccagtattctgcttttctagaatttatatattttattttattatttttttagagacagggtcttgctcagtcacccaggctggagtgcaatggtgtgatcatagctcactgtaaccttgaactcctaggctcaagcgatcctcccacctcaggctccagagtagctagaactacagatgtgcatcatcacactcagctaattttttttttttttttttttttttgtagagacaaggtctgctatgttgcccaggctggtcttgaactcctggcctcaagcagtcctcccaacttgggaggactgggaggtatgagctactcacaaagtactgggattacaggtgtgagctactatgcctggccagaatttatatattttatgttttagagggcatttctagactgattttaatgtaccatctcattttaaaaactgtgtatgtatgcgtgtgtgtgtgtgtgggaggttgtgtatgagagagacagagtttcaccctgttgtgcaggctggaatgcagtgggttcctgggttcaagcaattctatgcctcagcctcctgagcagctgggattacaggtgcctgccactgcgcccggctgattttttgtattttagtagagatggggtttcaccatgttgactaggctggtctcgaacatctgagctcagacaatctgcccacctcagcctcccaaagtgctaggattacaggggtgagccactgcgcctggcccatctttattaaaatataattcacataccataaaatttacccattcaaagtacacaattcaatgatatttagtatatccaacagagttgtgcaaccatcactacatcaaattccagaaaattttcattgctcccaaaaatgtcgagcccatgagcagcagtcactctctatccccaccacctccaccccccacccaggcaaccatgaatctactgtttcaatagttttgtccattctggacgtttcatatgaatgaaatcatacaatatgcagtgttttgtgtctggcttctctcacttagcataatgttttcaaggtttttctatgttgtaacataaatcagtacttcatttttatggctttattcattttcaatttttatgatattccattgtatggatataccacattttcgtttatgaagacatttggatgtttgccatcttctgctactatgaacattcatgtgcaagtttttgtgtgggcttaggtttttaattctcttgggtatatacctaggaatggaattgctgagtcaaatgctaactctgtgtttaacattttaaggaactgacaagtggttttccaaagtagctgcaccatttcacgtgcccaccagcagtggatgagggtctcaatttctccacatccttgcaaaaaacttggttttgtctgtctttttttattataaccatcttaagagtgtaaactagtgtttcattatagttttgatttgcatttccctgatgactaatgatgttgagcatattttcatgtgcttattggccatctgtatatcctctttggagaagtgtctattcaagttattttcttactttttaaattgggttatttgtttttattcttgagtgttgaaagtttcttatgtattctggacataagtctcttctcagatatatgatttgcaaatatttcctcccagttctgccagttgtccttcgttttcttaatgatattatttgcagcatgaacgtttttaattttgatgaggtccattttatctctgtttttcttttgttgcttgtgagccctatcacattttccataaatccaaaaattaagtaaaaaatgcagacttgtttaatattaaaaggaaagtctgtctcatattcacatagtgctatttaattttcagagatataaagcctgtgaaaccaaatttattgaataatacctcagtggagtggacccttctgactcccgtatttgctgtagcattctttatatgtctgatggcaaagaatatttatatgtcaactttttaaatgacttacagtgaatgtgaccagcaatgggcctacaactaatggctggatcactttcctcattgccatacacaccgtgagcaattttatatatatatatatatcccatggctgggggacaatgaaatataaataagaattagactttttttagcccttgaaaactcagtgagaattggagacattgggagtaccaaatctatatgttacacaaacagggaacagatcactttaataaggtaaaaacaacatattactatacccagagaaatcttctcttgaaggtctagatcttgttaagctcagaggctagacagcagtattgttaacctgaccatttaagcaggacagactcagaagtagctggatgcagccagccctggaacttggttctttctcagctacaaagaggaacttattccaacaggctctctggccatacctgctgttacacccgctctggccagtaagcacccttctgtttattttgtaattccacatggcctttacaaatcctcaaacccgtacacctgaatggctcctgctgctttcccccgccccatatgggagctgttccagctcacaccctcaaggccagggcctctgcacctccctttttagccctcaagcttcaggctaccctttttgcttttttgacccagctttctccaaggcctgggattcaaaagaccagactcaaaagggctcttgttttattatcatctccctgtcgcatagctgcatatgttaatatagccacgaaaatttgtattggcttgtgttcccagaaaccaggcaagaactctgacaggaatttaatgtgctccaccttcatcgtagattccttttctgttggactgcttcaggactagggcagggaggggtctggacgcagcagggagtgggtagggctgcagggtggtggatctggggtgggggcgtgctgaaggggctctagatcttcctttacaaatatggagcaaaagaattaagaatgacgcctaggccttcctcttggattcctgcatctctttctgtttctggtataaatgactacagatgttacctaatcggtaacacatacttggggcacaaacggagaggccgctggtaaatacgatttgatgatgacgactctgagaagacgctttattttccgagggatccagttgcagtgtggttgcaaatatttgagtaaccagtcaatctgctcaatttttcactcataggacaagttttcctgatggatagaaggtatgtaccttgcaccattctaggtttttgaggttcctcccagcggccttttggctatatgttaatacagttatagtcttgtgagggagagcttaatcattattttccttaaagagatatcaaaagcattctcattccacagtggtttttcttctcatcaccatattaacctttcacctttaacatattcatgtcaaagaaggggaatatttgcatgcataattaaatcgcatgaatatggtgcccatctggatacatgctggtctcatagacctaccccttgagaagggaatcctcattgctaagtagcttgtctgctgccaagaggccgggtcacccactgggcaagggctctactgcgtggtggggcaggggctactcagcgcatctgtgcaccgcactggaagatgcatatagtctgagagtgatggaccctttccattgggcaggggagtgtccatattagcccaagaatagaaatttcacaaagagaattgtttttctcttatggcttttaggattcttacagaaagacaaatgatttaaaagtgtttccccgctatcaagctgtaagggcctgtggtattctttctgaagggatctttgtcttcccttctaataattcttttctttactccacccatgtatgcgtttttcccattttaagccatcctgagtttgtgctgtgagttgatttacttccttttttctaactacgggatagcagctggattcaagcacatttcctggtttcctgtggcttgccatatgcttgtatcacttatctccacagctggagagaggagggaaggttatagaatttatgtgcgacccatcacattttatcttaggtacaaaatcagatggcgagggtcactgtttaaagaataaattatgaacttgtttctttacttcctactactaccatccttttccccataaacccacccttgccctaaacatatgtacacacttcccctatttttgctaccagaaattcttcctgctattttgaggtagagggcgtttatggggacagccttacagagctccctgtggtccacatgcgtgtttccaaaggtgcattaagagcccctcccctcaagaggaaaagaggccctcaacagaaccaaggattactgagaagaagaggtgaaattgcactgatttgtggacctgattatatgagtgggatctcttgcctctgcacattcaaatattggtaagaactttcacttggaaatcagccatgtttatttagccatcatatcgggtaatatgtaagtaatactttttttagaactttttttccaaagagctgtgaagaagaaagaagaaagctggggagtaggaagacagtttcatcaggacagaattacacgtttaatcaggacaaatcttttcaattactcctgctagatcccactacatttgcaccctgtttatcctatcatactgtttaaaatattttcttccaaagcattgttcatactagaaagctgttcctgcctgacgttcagctctcctggagacacccaggactggggtatcagtcctgtgtgtaactgtgagtgttcagtgactagggtctcgctatccagtgtaagggttgcgtcctcttccccctgccatctggttggctgtttctggctcttcagcacctgctctagagaggacgcgagaaccagagagaggaagggaaattaaaatgagtcgcttacactacttgtaagtagctttgatttaaaaagcatttggaaaagaaggttgaaacacagccaaaatacatcaggggaatatccatgcactctgtatctccagaaactatggggaagtgagagcccggagggaacattatctactagtgggaggtcccaccccacagtccaacgactcccacaggcatgggactagggaccgtaccctatcaaaaacagggactcacttattattggctgttgcgaagatttcttgggggtttaaatgaaccctatattactcctcctatctttccatttcttctttgtgacctccttcctttttgttttatttcacttattctttcattcagcagatatttattgagctgctaccattttccaagccctgtttgggcactaaggatacaaaagtgaataaggacctcacctgcatggagcctacgttcccttcctaccccatctattgctaccatatcttactcctggtattgcctgggttctggtctctgttattatctgattctccactctctgcatgtttatcagcccttccctgcctgctgggaacattgaccaacaagagtgaagtagtcacggcttttcagcagcgatatccttgcaacagattcattattatttatattagcaatatttgtagattaatattactagtatctactagtgttatatactagtgcatattagtaatatgtagcaccacataagaaaagcatgttaaacttgtctgcatatactgaacccctttgaccctctggacatggaaaatacttgaaaaattgacaaactctcagttattaaaataaaacttcttttgctcctttccctccttgggcattaaggaatccctctgtgcataaagcaatggccaacccatcagttgacagagatggcctttgctttttggtaattttttatggtagcagggattctactgaatctttcaggagttatatattttttcatcatttttccttttttttttttttttgagacagggtctctctgtgtcacccaggctggagtgtagtggcacaattacaactcactacagccacaaactcctggcctcaagctatcctcccacctcagcctcccaagtagctgggactacaggcatgtgccaccaagcccagctaattttttgatttttatcttttgtagagactggatctcgctatgttacccacccaggctgttcttgaactcctaacctcaagcagtcctcccactttgccctcccaaagcactgggattacaggtgtgaactactgtgctggccagaatttgtatattttagatttttatgttttagaggggatttctaggctgactttaatgtaccgtctcattttgaaaaacatctttattaaaagtgatcctcctgcctcagcctcccaaagggctgggattataggcatgtaccattgccaggaatcctgtttagaagccacatgtgcacacacacacacacacacacacacacacacacacacactcacacatgcacacacatcagcactctggttcatggaaggatatataaaggcctattattcacaacatataaggatggacagggcttagatttattaaatggcaaaggataataatgttaaatagctttaaggttagatcagatactttaattgaccctttccatttttttcttttttctgcctttttaatatgagacaggaaaagtatattctggacattagatgaaaaataggttaattttttttaaatgagatcatttggaatgttaccaaatggcatatatatagttcaaatgcacctctttagctaatttctagtgaaattattaaatgaaaagaaaacaagatgattgggagaggttttacatttaacaccaggacactcaaagttcaacagataatgactgagccacccgacatcatctgctgggctgccaaagctaatctctctgagctcccagcgactgaaggattttaattttgattttgatttggacaaaagtgaaattgagtgcagaatttgttatgtttgagggacatattctgatatctggtcaccagaatcaagttgaaaactcatactgcaggtgtgggcatactgttgtggccagtctgacaacatttgcagatatccaactgagttagctcagtcgaggacctgttgcattgataactggtgtagaggacacaagactaatttaaaaatctacgtaagagtaaagcaacaagcgctttgatcttgtagaaaatgatatgtttcatgtaccccagaaagaaattccaagtctcactaactcttttttacctgtagagtttgagctcagcatttttaagacatgtttgttctttgcaaattcaaaaagttagcaaaatagaatacctggtgcttctcaggtgtttttctaaaattgactctaagttgatcccctgctcacctctgtctacttaattatgaattctaatttgcatagctaattctaaagacatttgttaattttccttcctaaatttccaggtattatactgatatagagggaaaatgttggttactttatgattttgatgataaaattcaagaaatcaattctgataaaatacctttgaaattgttttaagaataagagtgtgtgtgtgtgtgtgtgtgtgtgcgtgcgcgtgcgcgcgcatgagcgagaaagaaggaggaggcatacagaaaatcctagttctatcattttaaacaaaattcttctaatgtttaggctgctgtaaagattggtgtaaccaccagaaaagagtatttaattcaattaattaatgaattaattaaagaattaatttgccacagattttttatcatcttcatcatagacattggcttggtctcgtggtttgctcagttttccctgcactattctgagtgaaatggggtgtgtgtgtgtgtgtgtgtgtgtgtgtgtgtgtgtgtgtgtatgtgtgtactggaggtcattgtatggttttctgttgaaagctaccattcttgaagtttcttatatattgaggataactaaaggaaaatgtgcccactactgttttcttttatgaagaaagagtcccctctttttccccaggaacagatggccagtttgtcgaggagggagagcaggcctgggagcaggcttgcatcgcctctctctggggtgtggcagcacccatgggcaagccccagtattggagttcactcctcagagcaggaatggggagcttttccccaccaagggccacactgtagataaaaatgaattttaatatattacttcccatggagaagaagcatataataagccgatcctttatagaacataaaacttgtcttggctggagacacggtggctcatgcctgtaatcccagcactttgggggaccgagaggacagatcacgtgaggtcaggagtttgagaccagcctgaccaacatggagaaaacctgtctctactaaaaatacaaaaaattagccgtgcatggtggcgcaagactgtaatcccagctactcgggagcctgaggcaggagaattgcttgaacccaggaagtggaggttgtagtgagccaagcttgcgccattgcactccagcctgggcaagaagaaagaaattctgtctcaaaaaaaaaaaaaataaagcttgtctcaatcgacttgtgattctgttttgtgatacagggggagacacagtgtagggtaaaaaagccaaaagagagaataacattcagcatctaagcattgggttcttaattctcataacaaggatggagatacaaggtatctccattgcactgggtacctagctccagtcatagggtgaggggatggcttcagggcccgaggctgcttcacttccacattgcttctctctaagaaggagaagccaaacatgtaatttcagacttctgtggaataaacatttccttttctgctccatccttggcctccactccagtagatctggggcttagccattctctgagcaaccaagaaaacccagcccaattcttcattccattgtggttttggaagggcaaaaagagaagcaaagggagcaggcatcttgcctttatcagatgccagcgggtgccagtcccaagataaagatgttaccatgggatctcatttctgtgtcctgatcatttgtttcacttcattggtccttttggtctgcattcttgttcacaaagttttaagtaatgatcaatcctaagacctgcaggaatcaaatttcatatgtggagggtgtttgcccatccaagacctttgtatctttgaggttcataagttggagacgaaagatttttgatttatcccattgaaaagcctatcactctagaaagtgaatggtgtcagcatggcatagttggcagtgcttttagaggctcttttaagcttcttgttctacaatactagttccaaatcatgatagcatgcagtcgagagggaatgaccaattgatattgtttatatcagtgccatttccagtgttccatcctttcatattttgttgtaatctgtagcatgtatgagtgttcgcagcagattgagggcccaggaagggaggataacattacacaccaccgtgtgccacacctcaggtgatgtatggggcaaacatagcattaagcttgctcaacgcgccatgccctgtgctctcttgaggatatccgaaagatgaacaagaactaagcactcccctgagagctcagtgcagaggggaaatgaatctacacaaaataattgctgtgtaaggcatcacaatatttataaggtacaaacactctagatatagaaaagatgagggagagagtgccactcgaggaagatacaggaaggctgctcacagaggggacatccgaatagggttttgaagtttgaatagggttttatcaggatatttgggaaggaaagagcacataacaaaagataagacaaggagcagcatgctctgttgaagcaactggaatatttcagtattgcaggagcacaaagtcacatggaggagtgctcagagatgaagtagggagggtggggctgaggctttctgtgggacagagaaggaatcgttgtgcaggtggaagaacccaagggcaagaaggcagagcgcaggaagctcacgtggcacctgcagagcctcctgcttctctcctggcttccatgccaccacaccaggtgggactattccctctctatctcttttccttgctcttttcttcctcctcctcttaagggtaggtaacaacagttccaccccatccactgccctctgcttgctctcttttgcagacctcactctgtcccatgaattcagatgacttcccatctccatgtcacaaatgtccttcccttcccacctgtaagccatcacaacctccacttcctgtgggaaacttgaatacttaggcaacacagaacttcttctcctgaatttctcctcagcccaactttggtagtttccttactcctagtgaggaagacttccaaactcctagtgaggaagacttccaaactcctagtttggaagataaaaaatattatcttccaaaccttagagacttacagttcataggattttcatctcacctgcctctcatccagttcctgtataaatttcatccataatttctctcacatttgtttcttcatttttttttaattgagacttttttttttaattgctctgttgcccatgccggagtgtaatggtgcaatcagggcttactgcagcctcgacctcccaggctcagatgatcctcccacctcatcttcccaaatagctgggactacaagcatgtgccaccacactcagctaattttgtacttttttatgatatagggttttgccatgttggccaggctggtctccaaactgctgggttcatgcaatccatacacctcagcctcctgaagtactgggattacagacccagcctcttttcattcttaattcagactacagtcagccaccaagtccttcccattcaacctctgaaatatcttgtagtttttttttgtttttttgtgggttgtttgtttgtttgtttgttttgagacagagtctccttctattgcccaggctggagtgaagtagcacaatgatagctccttgcagccttgaactccctggctcaatagatcctcccacctcagcctcctgagtggctgagactataggcacaccaccacaccaacagcaacgatatatagaccacctgggataaaatgactatttgtcctattattttgggaagagattctaaaaggattcacgttgtgtgtgtacaggaaagagtaaaatcctgtgtgtgtagacatgtccctgggtatgggagacaaagctaagagatagtagaaatgattaattcaaccgttgttatgttagaacaccccaggcaaaaagaagagagctggcctggggaccaaatgaggtatgtaacagaaaccagtgttgccaggtcagcctgtccaggaacctggctgaggtggcgattgataccaggcctaggctagaaatgaaaggagctttttctttcttctttgtcttgtgtggtgattgaactttctttggagcaaaaactagaatgcggcaaaaactttagagccgtggttttcaaccaggatggttttgcccttccctcccctgagaaaatttggcaacatctgcagtcatgtttggttgttaaaactagaggatggagcccaggatggtggcttgtgcaggtagccccagcttctcaggaggctgaggcaggagggttgcttgaggccaggaatttgagactgcagtgtgctatatgaccacacctgtgaatagccactgcactccagcctgggcaacgtagtgagacctacgtttcttaaaaaataaataaataaaagttagaggataatgctactggtatctagtgggtagagagaccaaggatgttgctaaacatcctgcaatgtgcaatatagtcccccacaacaaagattatccagccccaaatgtcagtagtaccgaggttgagaaatcctgcttgaaaagaaaagccaaaaaaaacacttggcaataatgctattgcatggaagagaagggactgtgatatttactgtattatttgtccagtgtttcacttgtccattgagatgttagtttgaaaactcctctccctgagtctggaatctgtcaagtaaattaagaaggtcaaaggctttttatcagtgatcagtgttttgtgcattcttgaaagggcaagggttgtcataagaaagagcagaaagcacttcatgtaaatcatacttgatgtgatcccaggaagcttttaaaaactaatttcattaaatttagtggtgcaaatagccaggtgattttttattccatggtcaaagctagggaaatgaggcagggtggtatgaggtgtgaggagaagataaataacagagcttctttctggctttgctttttatagtgtcaagtttttttaaatgaagtgaatccctttgtatttgtcctagtattcttttgtgtttgtccccaggccttacaatgacttcccagtgcaagattcagacgcatcattatgtacctatgacactgaccccactgtttattttccaaatattaggtactttggggaagcatgatgagggaagctgtgttgtgactgcccatgagggtggctgatctggctggaggtcaggatggctgtgaggtcaccagatccctaaggggcttgagggaggaagatcagttctccaggaagaatcagatgaactggaagtaaaggcagagaagctaagcgtgtatcttggacagctttcttcttcttctctttttttatttaaaaaaatttttttatcatgactgactgattcagtgaacttgatttttatgagctgctttgcagacatgaagagaaaaaacagcttggcaggagtagggaaaggggggagggatctaaagtaaataccacacttgcctgcagtttagttgttgacaaaaaacagttttccctgagaagcatgtgtaatatgtcaggaagaaaaaagagcaattaacactcttcttacataagatcttattgatagcactgtattaattttaatcatttaggttaaaatgctcttcttttttttaactaccggtcaataaactatatacgtgtatttgacgttcacccatgtcatgctttccagggaaagcatagctttttggccctcccagcttctaacaatgaggtttccctgatgacatctcctgactgtcccacagatcagcacttcctttacactgcttcttgctgtttgttttatctgtgtacctgtgtgtctgtctgcctgtctgtctgtctatctatctatctatctatctatctgaagtttcctaggtctgctgtagcaagttaccacaaagttggaagcttgaaacaacagatatttattctctcatggttctggaggctagaagtctgaaatcaaaatgttggtctggctgcactccttccagaggctctaggggaaaatcctggcttgcctcttgcagcttccagtggctgcagggactccttggtttgtggctgcatcactccagtctctgtctgttttcacatggccttttccactgtttctatgtcttgtcctcttctgtgtcttattaggacacttgtcattggatttgggacccacctagataatccaggatgatttcttcttgagattcttgacttaatcacatctgcaaggacctttttttcccaaataaagtcacattcgcattcacaagttcccatgattaggatgtagatgtttcttttgggggaccacaattcaacccactactctatctgtctgtctatcatctatctgttcaactatcaaaatcctctttgttttttgtttcccagtgtgctgagtacacagtagttcctaattattattattaatttgaaagtgtggccttattttatagcgacccaagttattttctgggctaattgtcccaccttgtttcaaagatgttttatcattaactctaagcaatagatggacatagacactccacccttacaaaacaaatatgtgtttcagactaaagacccagcatctaatagccacacctaaatgacacacagtaaattgtaccattattataacttgtaagattgctgtttttctgggtgttgctccttgggctgcagttaacttcctgcgtggtcttccatacacctccagcaaggtgcaaatgtctccgttgaattgaccctatttatccttgattaatgtatgtgccctagaagagagaaaagcaattggtcagagctttaaaaatagagggagaggccgggcgcagtggctcatgcctgtaatcccagcacttttggaggccgaagtgggcacatcacctgaggtcaggagttgaagaccagcctggtcaacatggggaaaccctgtctctactaaaaatacaaaaattagccgaatattgtggcaggtgcctgtagtcccagctactcgggaggctgaggcaggagaatctcttaaacctgggaggtggagattgcagtgagcccacatcgcaccattgcactccagcctgggcaacaagagtgaaactacttctcaggaaaaaaaaaaaaatagagggagaaaaccataatattaagatgcttgctcttatttgattcactgaattgaataagttctaaagcaagaacaaacacttaccgtgtcctctctcagttctggaaacagtgtggtagagaggaaggggcacatgtggttggtgagagaccttggtcaagaaacataggctccagcttgcaggccaaggcctggccctgctaccatctgtgatctcgaacaagcctctgagtctctctgggctaaaaaaaactgaagtctcctaccttttctggtattagatgattgagccaatggttttcaaactatggtccagtgtgccgtgcacgctcatttttctcttccctgccacaatctttatggttttctctgtgattagaaactgggtctagcttggaattaagaaatggtggtgtttttgtttctcttcattcacctacttgcagcggaaagctacaaggaaacacagatggtgaagattaaagaggaacccatggaggttgacatccaggactcccatgtctcgatatcacccagccggaatgttggctacagcactttaatcgggcgagagaaaaccgaacccttacagaagatgccagagggcagagtacccccagagagaaacctcttcagtcaggatatctctgtgaaaatggcttccgagctcctctttcaactgtcaggtatgtttatgcacaggaaaatgtcaattattggaaatcattgaaggaaaacccttctaacacagttttttttaaaaaaaaaaacctgaattataggattttttagacagaaatcaattttgttgctttaacatgcatactgccacccaaactaacagttaataaagtgttgccaagtagaattcctgccaaactttccttaataaatagttaagaatcacttgaaattaaaactctattcaattctgcgcaaatgattcctgttgactgggctaaacacctcacctctaattttgcttaggcagttgatctgattaacaggcttttttttaatgtgcaaaagataaatttcaatttattccaacagtgactgaattactatgacttccaaattagtgtggtctgaattaatgaggttttattgtatcttgccaaaacaaaaacaaaacaaagaagggaaaagcaaaagatgaaggtatgaggactatttccagctatagccttagcagaacagtttcggtaaaccaactttttgtactgcacatacttacaattgaaaagtgcagtaattaccagctcagtgaggtgtctggatgaaatagttaaggatcccagtacctaagttgttccttctgtcatctctttcaagccgcatagcatttgtccctagcaaatttaatatgcttctatttttttgcacatgattgaggttgatggtatatacatatataagattcggatagaaatacatacaaataccttgtccaaagtcaagcactggcctacaatattaaagtttatccatcaataaagcctgttactaatgttcaacaaactctgttttgttatggataacacatttagagcatccatttaattctctcttaaggaagataccaggaaagagaaaaaaagctaaaatctgtctgtcgccataatagttcaccttctcattgacctggcaacacagcccatagctgtgtaattatcagatggtgctgaaaatggtggcctccaggtcctcaaacagggatggtatttgtgcagatctctgcagtagccgaaatcactaattctgtaaacttaataggacacacagatctttgcaagctccaaaacaggctacttttatttatgtattttttgaaggatgaagcttatctaaaaacaatataactttaataatgattgaggagttaaaatttgcaaaagtgtgacctgcgtggttcttttcagaaagtctctctaaaccgtatgctgtcgcagtctcctatcagctaaaaagtttgggtctgagagttctcaccctggcgctgtcactgcctgggtgacctcagacaagtcatttagccccgatttcctgctctctgaaagagtactggctgtgaatccaaattcacgctcattgtcattgttgagtggacagaaaggaattgtccatgcacacatgcatgcagtggcttcagactagcagtacaaagtgtgagacgggtgttgcaaatctttgtttaaatttttccaaaaatccacaagattaagagatttttatttgccctgctgtttaaatctgaaactcttatacagttggccaggttttttctagatattaaaagaagccattgacagctgtgaccgtcagtgtagggtcctcacatttgaactgcattgggaaggccagagttcaacttttgtgttcttgaaagctcattaaataatttctgacagctgatagatgtagacctcaagccacagtaagggagggtctacctcttcttgtctaaatgatatttttttgtcccttatgacatttatcagaataagcactgaatgactgcagcacgaagaggtcttaggctgtttttatatcccctctcacaaaggggcctcacaatacagaatgcttaaaggttgtcatcaaagtcagaggcggaacagttgcaacaactgcagttttcatgctgaatcagaggaaagcagaaattttcagctggggaaagatacagtggaaataactgtctctgcccataactctatgtgtgtgtgcatgtgtatgtgtacgtatatatttaccaaggcctcgttcaaatcagaccacatacttgatatttgatatttgttactgtttccctttgattggttttacttttcttttttttttttatttttttgagacagagttacactctgtcgcccaggctggagtgcagtggcacagtcttggctcactacaccctccacctcctaggttcaagcaattctcctgcctcagcctcccaagtagctgggactacaggcacgcgccatcacgccctgctaatttttgtatttttagtagagacgggttttcaccatgttggccaggctggtcttgaactcctgacctcaggtgatccacctgcctcggcctcccaaagtgctgggattacaggcatgagccacagcacctggcctgagtgatggttgttttttgttgttgttgttgtgtttttgtttgtttgtttgtttgagacagagtcttgctctgttgctcaggctggagtgtagtggcgcgatctcggctcgctgcaagctccgcctcccgggttcacgccattctcctgcctcagcctcccaagtagctgggactacaggcacgcgccatcatgccctgctaatttttgtatttttagtagagacgggttttcaccatgttggccaggctggtcttgaactcctgacctcaggtgatccacctgcctcggcctcccaaagtgctgggattacaggcatgagccacagcacctggcctgagtgatggttgttttttgttgttgttgttgtgtttttttgtttgtttgtttgtttgagacagagtcttgctctgttgctcaggctggagtgtagtggcgcgatctcggctcgctgcaagctccgcctcccgggttcacgccattctcctgcctcagcctccctagtagctgggaccatagatgcccaccaccatccctggctaattttttgtatttttagtagagacggtgtttcactgtgttagccaggatagtgtcgatctcctgacctcctaatctgcccgcctcagcctcccaaagtgctgggattacaggcgtgagccactggatactatcaacatgctttggatgattgtcttttccagtaagatggggaggatctggatgtttaaaaaagaaatcaaaagaaaaccacaaaggaaaaagagagatgttgagggtttttctgcttaaggctaaaagatgcaagttgagtgagaacaacctaagaggtgtatgtttcattctttctccttacagaaaaagtgagcaaagagcacaatcatacaaaagaaaacaccatccggaccacgaccaggtaggcgactttgtgtgggttcctccagaacaccccgtgtgggccaccagcccgtactacatgttgaacgttgctccccaaacctctttctcccactgggttcaaaggagtcacaccctttaccaccatgttctaccagaatttcttggttggtagaaacaatacagacgtaaaggaggaagaccactaatatgtactaaacatctaataggtgtcactttgctgggaaattttccatatgttattgttttgtattcctgacaataattttgtgaagtagatgttattatcatcctctctgcagaagtctcctggcctgagagttgagccgggtggctcagctgggactgggggctgggtctgtatctcacgaaggcctctttctgtcttattgcaaccctgctcctgactgcctccatgactataggctgataatttgtcaccaaggatatcccaaattttttttaacctcccagcgttatttggaaggcaaagattttaaaggcagaaaaaagataatgctttttaaaaattgcaaggaaatttatatcattcaccactgtggacaaggaagttttttcacttgccaaaggcagtctgaggaggttagccagtgtgggctgcccaccgtccatctgccgttgtgagaagaggaggatcagccagtgctgctgctcccatggagctgcttcccatgaagtccacccaaacctgaaacgttgtaggtgagagccagcagatgaaaaccccaccactgcagaaaaggagctcaggggaaatgcattctccacctttgaaggaccattctccactttcaaacctccctccaatttctgagttagcccaagatatgagctttacaggatgatcaagagcaatacacatttttaggatgaacaactaggaacagtagaaactagctgggagctaccaagcagtctttaaatcaaggaactttgctttcctgagcaaacagagaaagattcttcctgatgggaacagttgctgggttttgtgtttctaattcttgcaacaaaaggtacaagatatttttctttttgatgtcttattaatcgacctcagagcatcatcaggcctgtggacagtactcatttaaacttcaacctgaggttttaaaaaaatattccattaattggagtttaggaatgtcaaatttcaaagagcaattaaaacagagccagcttgcctcacactgggtttattttatttatttatttatttatttatttatttatttatttatttatttatttatttgagacagtctcactctgtttcccaggctggagtgcagtggcccagttttggctcactgcagcctccactttgcaggctcaagccatcctcccacctcagcctcccgagtagctggaactacaggtatatgccaccatcctctgctaatttttgtattttttgtaaagacagggtttcgccatgttgcccaggctggtctcaaactcctgagctcaagcgatctgcctgcctcggccttccaaagtgctgggattacaggggtgagccaccgtgattcgctcacactgggtttatatagttttagggagaggaacctcgttctaatagaacagaagagtggtatgtattagtcttgtgtctgtatataagtatacagagagaaaatgagagtaggaagatggactgcagattgtattgggaaatggctttcgggggatggaaaggctattttgtatattaagtttgatgcccaaatagaagatgtgaactcccatggaatccatcctgccccctcctacatctaacctttaagctatttagtgtatgtgcttgtgtctgtgggtctaaacactgatgaaattggacagattagtagaccttgaaagacagcagactaaacataaaaaaatattcattttaatttgctgccataggattcttgaagtgttataggttaagtcccctagagatggagattctcgtggaagtgctttattgagggaatgctctcagaggaacctgcaaggaggtgatgggggcagaagacggaggaaagagaaggagaaggagctgagaggaaggatgtggttttagctggtttctaactaacttcagctgcatcccccaggaaggttcactagcttcaagtaatcccctgcaggggatgtataacctcccatgttagggggttccaatggggacagcggttctcacttatagttatcaggcaacacttacgcaaactccggggtaggtgcattcgtgccagagggaggatctgggcaggaccccactagcatgatctatggaggtttctgagggctctttaagattacataatatttatacaacaaaaagatgtgctgcaagaccatattattttatgctctttaggtgttctctaggaagaggtaagaggaggccccaagttggccccatacaaagattttaatgtgcctcaagcctaaactgccttggctggagctgaagcatgattataggatagaagagaaaaaaaatttttttaaccatttggcaaaaatgatgcaatccttaaattctcctctttctgggagattatgagtaagaggaaatccgaattagatcttttgcccaaagcaaaggaagaggttcttcctgtgagctcccggcatgatatggtgtttagaaatcagtgttaaagaattcttggcttatagttctacaaagtcctcggtgtggtttttttttttttcctttgagtagaggcagcttacttgattagcctatccataaatagatctcttttttacctctcgccttattacttcaggtggaatagaataaaatttttatgccaagaaatcctctttaacctgagttaactgatatcaggaacagaaaaaaaaatgccaattttctttcttctttcctgactcctgttttagaaggaactcttactctgcaggtacaagatcagtgtgtggattatgctttaaggtgtgatttgtaatacatttcaaaaagatttacatcaaacctctgaatttctgtatcttcagatttttaagtactaatggagtgtttatttagtaatcatatcttctgtgtttgatttcctagaagaaactgatcattcagaaggacggttcatgattggaatcaagttcagaatttttcgcactttgagaatagctaggtatatttaaggtagtttcgtttgtaaagggcaggcctgagcacagcactgagatcaaaccttcccttgcctttctcatgctgatgaatgcctacgctcctccactccttgccatctcctgatcctaggatctggatatccaaggacatgaggtagggagaagagacacaaaactgaagaaaggagctgactctatccctgcctcttataaacccacagcttccctcacaattgtttatcgttatttatctcgatgctcatttcaaccacaagactaaggaaaagtgtagcagcccaagaggaaacactctgtagcttggcattccaatatgtgcttgccagtgagtcatgggagtgctgatgcccgtgtcctgcaccaagagaacacgaagtccacggatgtgtgctgttaactctccatcccgtatgggttggtgactgcactttcctcaccatcaaatcctccctcctcacacctgtccagtggcagctctgccccttgttgatacctctgttatacgaaaggtagataaggagagtgaaaataatgggagacagtattctttgctggcaatttttttaaaggggtttaggtgaagctaaaggttgaaactaataactaccaagtttctggatcactggatctctacctcatttttaaaaactcttataatggaaaatttcaaacatatacagaagtatctgtcatccaatccaacaatcatcaattaatgatttatgatgttttatctatctccctcctctacttccccctccctgtagattattttgaagcaaatcccagacatcattttaagaactggtttgagaatgccatttttttgttttgttttttttttttatcctaagaacttaaactcagctgcttaaattaggataatcttcccaaaagtaaaggagaaaaacaatccaccaaggcacaccgtgtagccaggcagaaaaatcaatctacttagcagcttgaatgattgaatcatgtggtcctgctcaccagtgccttaaccttgtccctccacccttgtttgtgtcctcatcggggcacttcccattgaatcagtcctttagatgcaacttcaccgtaaatgctaaaacagcagtctttttccttgtttaacctcagagtctagaaaattcaatgcaagtgtaaagaaggctgtgggtctcctttgagatagtgtgtggactgagtgttgttaatgccactctatctgacaaatgagatgaggagagagtcccggccagacccatgagaacagaaggaccaaacatttcagactaataaaatcctgatttttctatttcctttcccagcacaagcctaggttctacagggagcagataactagctattatgatcatttggtagatgaaaatacatgaggcatgatatcataatcagatctcaaagtttaatggaataaaaagaagatctacatcctttgacatggaccatcacccagccagatgctggataagatcgagataggaaaatggaaccctagagtaagaatcagatagctcctggcaggtgaattggacatgctcaatgttgtgtaacaccatgaacttcaaacaatggctgccaagaaccctctcttggttatttgttctctcttttctccattaataattcagtgtccatgggggtataaaattgcaggcctataacaaatactttctcacacctggcttgctttgttccaaaagcaaggaagagtttgcctgaattgttcttttctccattactagacaaaaagcagaagtgggaaaatcagagaaagatagactcatatcgtgctgtgcagaccaatatttaatttgcccaattttcagaatttgaaatgcaggctatttttctgtgatttagataatggcacatagtgtttactaaaagacatattcacttggaatcatccaatgtaaaattttcctttgtgatggttcggatgcgtgtccttaaatatttatgattcagtaatagaaattgcacaaatttgtaaaagcatgatgtgttgcctcaattcgcacaattttccctttttagttctttggaaggaataaaagaataatgctatattaccttaaaaagtaaaatattacttttagagaacactgaattagacagaagcaattaagaaaagaaaccagaaacagagcaaatgaaattgatatctaaggaggtctccatatattctctttaccctttacatgttgtgactttaaaattaaatgcaatgagcattctatttccaaagaatggaaattgctactaatttcacagagtcccttcagttaggacattcatttctttttggtgaagtcaaggctgttttggggcctcatggtgccattgtacattttaaaaagactccctcccttagtacactgccatctactggaatattgtcacaataaatctgatgtctgtgacgttaatcatgcccctctagatgtggtgcttttgtgcagtgcacagcctacaccactatctgcagctgccctgacacacatgcggacttgagagtcttttcattggcaatacattctttgctacttatctttgagcttctatttttcaaagaaattaaaactgatccttgaaaacaatggagatacacacacacagagcctgaaattactttgtgcattgttgccatttggatttgtttttccttcccatttcaccaagccctttctcagtactttgttctattcctctactccattgtcctatagatatttgctctctaccatttttcctcccttcgtgacatctataccgaaatgttatattggaacgatatgcttccagaatggttctgtgttgtgttactcttaagaggcaaatttaaatctccttttcaggatctgaagagggctgtgcctttcttttcatttcccatggacactcccatctttatttctactggcttgcaatagtattctctcgtttttataactcctaatagtcaggaatgaagtgtaaattggtaagtctctgtcagtggacatccagagactgtgttcccctctagctgcctttggcaggttatgcaagaatgatataaccaaaaagtaggtgaggcttagatgctgttcttatctggaattttctctgaagagtgtcttcatgattgttagtagaaatatatcaagtctttcaagggttggcctctgtaaagcagccctcttgcatgatgcagtgggccaggagaccatccacatttcactagcatcgtctgtaacttccacatgacagaggcttgcatcactgcagagaagactaagttcatccgttctgagctcacctcagcagaaagctcaatgtctttgtttgtgtataaagtcagattcctgcgggagatcctccacaagctgacatttcaagtatccggatgtgcagggttcacttccttggtctgcggttggctctggcacccccggtctggcctctccactgcagcggccctcgacaaggcctggcattgtgctccttgtcccgagaagtttccgggctccacagtgcatgaatgctagagcagcagcaacagaaacttgttccttgaaaactcagtgttaggttgtacatactggcccacctgtaagacaatctgaaataggaggcatttatacttttcaaagaagaaaatactaaacatgaaaaatacgtatatgttcctaagatgctgtatttttcttctacaatattgcatacaacctcttccttccatagctttcagacttctgaaactgaagcagactgatactgagggtcataattgagatgtagttgtttctgcctgtgtcttttacaattgtccctcagagctttctctttaaaagaccgagtcttttcaaaagtaaaagatactaaacagtaaaatttaatggttgtttttaacttttaaaagtaacttatttccagataatataggagcacataaagaaaatgtatttttagtcctactacctagagacagccactgctaagttggtggtgtgtatccttgctggattttttttcatttataactgagtcctactacatatacagttttataatcttctgttttcacctaacaatatataagattgtccatttttccatggacattctcaatgttattcttttaatgtttgcatagtattcaggtttgcctgtgttataatttatttaatcagtcccttgttattgaatatcaagggtccccccccaaaaaattgttaatataaacaatggtgggataaaatgacttttcatgcgcgtccctgtgaagagaccaccaagcaggctttgtgtgagcgacatggctgtttatttcacctgggtgcaggtgggctgagtccgaaaagagtcagcgaagggagttaagggtggggccgttttataggttttgggtaggtaaaagaaaattacagtcaaaggggttttgttctctggcgggcaggagtgggggtcgcaaggtgctcagtgggggtgcttttgagccaggatgagccaggaaaaggactttcacaaggtaatgtcatcagttaaggcaaggaccagccatttacacttcttttgtggtggaatgtcatcagttaaggtggggctgggcatattcacttcttttgtgattcttcagttacttcaggccatctgggcatatacgtgcaagtcacaggggatgtgatggtttggcttgggctcagaggcctgacattcctgccttcttatattaataagaaaaataaaacaaaatagtgttgaagtgttggggtggcgaaaatttttggggggtggtatggagagagaatgggcgatgtttctcagggctgcttcaagcgggattaggggcggcgtgggaacctagagtgggagagattaagctgaagggaggtcttgtaaggggtgatattgtggggatgttagaagaaacatttgtcgtatagaatgattggtgatggcctggatacggttttgtatgaattgaaaagctaaatggaataacagaaggagaaaaacaggtataaaaggtctaagaattgggatgactcaggatatctgattagagagtgcttaaggagattcggcatagtcctgccagcaaagattatttatttacttcaagagtttagagtggcagtttggggatagcaccaggagatatcagctgtgatgccttggaaaaacagtgtaaaccggcagtgtaaacaagagcagggcatgtatgagtagttgagaacggtgaataggagtatgactagacagaaaatagtagggatgacaagtttttttttggtggggggcacagtctaagttggtctggtgtctggaatgagactggggcctaataaaaaggagcgtctatacaggagcttaaatgggctgtaccctgtagcattctgaggacaggcctgaattctgagaagggaaagtggtaaaagtattgtccagtcctttttaagttggtggctgagcttggtgaggtgtgttttaaaagacctttactttagtccattctacttttcttgaagacggaggaccataagggatataaaggtttcactgaatactaagagcctgaaaaactgcttggctgatttgactaataaaggctcgtctgttatcagactgtattgaggtgggaaggctaaactgaggaattatgtctgacagaagggaagaaatgactgcggtggccttctcagaccctgtaggaaaggcctctacctatccagtgaaagtatctacctagactaagaggtattttagttatctgactcagggcatgttgagtaaagctaatttaccagtactaggtggggcaaatcctcgagcttgatgtgtagggaagggagggtgcctgaataatccctgaggagtagcagaatagcagatggaacactgagaagttatttccttgaggatagatttccacgatggaaaggaaatgagaggttctaagaggcgggctagtggcttgtactatagcataacctgcctttgctggtgtgtggcgattaggcctggtggaaccgccatcaataaatcaagcgtgatcagggtgaggaacaggaaagaaggaaatttggggaaatggggtgaatgtcaggtggatcagagagatacagtcatgggggtcaggtgtggtatcaggaataatgtgggaggccggattgaagtccgagccaggaacaatggtaattgtgggagactcaacaaagagtgagtacagctgaaggagccggggagcagaaagtatatgcgtcaggtatgaggaagacaatacattttggaagttatgagaactgtagagagtgagttgagcatagtttgtgattttgagggcctctaaaagtattaaagcagcagcagccactgcacgcagacacgagggctaggctaaaacagtaaggtcaagttgtttggccagaaaggctacagggtgtggtcctggctcttgtgtaagaattctgaccgcgctaaccatgcctaggaaggaaaggagttgttttgtagaaggtgcttgggtttgagagatcagttggacacgattggcagggagagcacgtgtgtttttatgagaattatgccgagataggtaacagatgaggaagaaatttgggcttgattgaagtaacgggggctgtctgtgaagctttgcggcagtacagcctaggtaatttgctgagcttgatgagtgtcagggtcagtccaagtgaaagcgaagagaggctgggatgaagggtgcaaaggaatagtaaagaaagcatgtttgagatctagaacagactaatgggttgtagaggcaggtattgaggataggagagtatatgggtttggcaccacggggtggataggcaaaacaatttggttgataaggcgcagatcctgaactaacttgtaaaggcttgtctggttttaggacaggtaaaatgggggtattgtaaggagagtttatagtctttaaaaggccatgctgtagcaggtgagtgataacaggctctaatccttttaaagcgtgctgcgggatgggatactggcgttgagtggggtaagggtgattaggttttaatgagatggtaaggggtgcatgatcggtcgccaaggagggagtagaggtatcttatacttgtgggttaaggtggggggatacaagaggaggacgcaaaggaggctttggattgggaagaagggcggcaatgagatattgctgtagtccaggaatagtcagggaagcagataatttagttaaagtgtctcagcctaataagggaactgggcaggtggggataactaaaaaggagtgcttaaaagagtgttgtctaagttggcaccagagttggggagttttaagaggtttagaagcctggctgtcaatacccacaacagttatggaggcaagggaaacaggcccttgaaaagaaggtaatgtagagtgggtagcctccgaattgattaagaaggggacgggcttaccttccactgtgagagttacccgaagctcagcatccgtgatggtctagggggcttctgaggcgatcgggcagtgtcagtcttcagccgctaagccgagaagatctgggaaggagtcagtcagagagccttgggctagagttccaggggctctgggagtggctgctaggtgagttgaacagtccgattttcagtggggtcccacacagatgggacgtagcttaggaggaatcccaggctgcgggcattccttggcccagtggccagatttccggcacgtgtagcaagctcctgtgggaggaggttctggaggaacgcctggccgctgcggttcaggcgtttggaagttcttatgtgctggagatgtggctggggtttgtctcacagtggaggcaaggaattgcaacttttttctattattgtacaccttgaaggcgaggttaattaaatcctgttgtggggtttcagggccggaatttaatttttggagttttatttaatgtcggtagcagattgggtaataaaatgtattttgagaataagacggccttttgaccttttagggtctagggctgtaaagtgtctcagggttgctgccaaacgagtcatgaactgggctggatttttatatttgatgaaaaagagcctaaacgctatctgatttgggataaagaaaaaggagcattaaccttgactatgcctttagctccagccacctttttaagagtaaattgctgggcaggatggggagggctagtcacggaacgaaactgtaagccggaccaggtgtgaggaggggaggtgataaaaagattatatagggtggaggagcagaggctgaggaagaattgggacctagctcggcctggcgaagagcagcctggggaggaagggagaggtcagatgggtctgtagaaaaggaagattagaaagactcagcgacgcttggggttaatactgaggggacaggcgggagggaaagaaggaagatttgggacaagttgcactgggcacagagactaggaagggactgatgtgtaaaagaatgcctggatgtcaggcacctcagaccgtttgcctattttacgacaagaattatttagatcttgcaggatggaaaaattcaaagtgccattttctggctatttggaactactgtcgagtttgtattggggtcaagcggcattgcagaagaaaataaggcatttaggttttaggtcaggtgtaagttgaagaggttttaagtttttgagaacacaggccaagggagtagaaggaggaatggagggtggaaggttgcccatagtgaaggaagcaagcctagagaaaagagagagtagagaaatggagggaaggggttcgggggttcttaccttccagaaaagtgggaaaaggggttggggcacagagataagaggttggggcgcagagataagaggtcagggcatggaaataagggatggggcgcagaaataagaggtcggggcatggaaataagggattggggcacagagataaaagaggttggggtgcagaaataagggattggggtgcagagatataagaggttggggcacggaaataagggattggggcacagagatacgaggttggggtgcgtaaataagggattggggcacagagataagaggttggggtgcagaaataagggattgggggttcttgccccgtagaaaagcgggacttgccgctaagggtgaaggagaaggggttgagtggtacttgcccctcttccagaaaagcagagaaggggtagagacacggagagaaggggttggggtacttgcccctgccccaggaaagcgggacttgccactaagggtgaaggactaaggcaggcgtccctgcgtggtctgacacctttgaaacgtgggtgaataatcagagaggcagccctgcaatgattaaacaccaagggaaggctgccttcccagtccgtgactggcgccagagttttgggtccacggataaaacgtgtctcctttgtctctaccagaaaatgaaaggaattgaaattaagagaagggagagattgaattgtggcgccaagattgaaaggagaaagaggttgagggatagtgagggaggttggagaagagagtaaaaagaggccgcttaccggatttgaaattggtgagatgtttcttgggctggtcggtctgaggacctgaggtcgtaggtggatctttctcacggagcaaagaacaggaggacaggggattgatctcccaagggaggtcccccgatccgagtcacggcaccaaatttcatgcacgtccgtgtgaagagaccaccaaacaggccttgtgtgagcaacatggttgtttatttcacctgggtgcaggtgggctgagtccgaaaagagagtcagcaaagggagataagggtggggccgttttataggatttgggtaggtaaaggaaaattacagtcaaagggggtttgttctctggcaggcaggagtgggggtcgcacacaaggtaatgtcatcagttaaggcaaggaccggccatttacacttcttttgtggtggaatgtcatcagttaaggtggggcagggcatattcacttcttttgtgattcttcagttacttcaggccatctaggcatatacgtgcaagtcacaggggatgcgatggcttggcttgggctcagaggcctgacatgactcaaaacagtattcacatttttcaggctattggtaccaattgtcaaaatgacttttaagaagattgaatctgcagttctaacagttttcatgagagacagagacagagggagacagagaatatttcaaaggcccgatcaactctgtgcttatcattaaaatttttttaatgattggagggtgaaaaattatatcttccatttaaagtctttgatttattgattcctagtgctcttaagcattttgttcatggggagacatttgtatttgctctgtgtgtgtgtgtgtgtgtgtgtgtgtgtgtgtggttttgttttgttttttgtttgtttgtttgtttttttgagacgaggtcttgccctgtcgcccaggctggagtgcagtggcacaatctccactcactgcagcctctacctcctgggctcaagtgatcctcccacctcagcctctcatgtagctgggactacaggcatgcaccaccacacttggctaatttttgtatttttttgtagagacagggtttctgccatgttgcccaagctgttcttgaattcctgggctcaagtgatcctcctgccttggtctcccaaagtgctgggattacaggagtgagccatcatgcacagtcttgtattttcttttactgccatttcttattctgtttggtggcttgtctgggttggattttttgtttggtcgttgctattgattttttattattatgaaattttttaaccaaaatagaaaaaataatgaatcactatattcccatcacccatattgaacaagtatcaacattttgccacacttggtttacccgtcctttttcctcctgcattttaagtcacatcccagatatcaaacattcattcccagattctttggtatatatctctaaaaagtaaggagattttccatgatgctagttcacatcttacaaaattaacaacacctttagtttttaattgctacagtttctgtttcattggccacagccaagttatgcagccgcatcaacggaattggaggagaggaaacccatcttagcttccttgtcacctccaaaaattaaagaagaaaatctgctgcctatatgctagtagagtgattgagaacccttgagtcccctctgcccacaggcccatttagaaacacactgaatctgcaatgccagcctcgatttttagataaatgccccagctgaagcttgccaatgtataggaataatccaagttttattcacaactgcccctctttctttgaaaatgtgtgagcccaacatgatcaatgaccgagttttcaggcctaacccactggggtcacaggaggtccctgttatgtcccttgtatggtcaaatacagaattttctctttcagatggtcagggttgccttcagggctgagactcacagtcatttttaatcttgggcactcttgtccacccccacattccctaacctgccatccggggtccttttcgtcacaataaataaaatctttaggaacagggttcctcatttctgtggtattgaaaagggaagggcaatgttcatgcgtaccattaaaagtgttttctttcattatagattaccttttcaattgactgcaaggatgttagtaagacaactggccctgattgttatacgtaacatgttaatatctgggcacatttcagaagcaacagctctacaactgctcattcaaaatgaaaatgaggaagttaggaagaccacacatggtcctaggccacatagagtgattgctactgcagaacaaaaggactgtgtcagggttttcttctatatttcacatgatactgatgcaactgtatagagtgtttgcattttattttttaaagtgttcgaaatttttttacaaaaatatgtagaactaagcacttaatatatttcaaatacaattacttataaatatgttatacaacatgtacatatataaatatatgaaaagaaatataagcgtctattaagttattagcaaataaattaataaaaggaagtaatagttgagaaaaagaaaatcactaaaagtgaagaaaacggcattaatcatgaaaattaagttgaaaatgaaatattcttatttgatcttttcaaaaagtgaaatatgtaaaaataaagtgtttttgtttttcagttgtgaccttattttcatgtaagctattccagcttctcgaagaatgtcttctcaccttaaagtacttgaggaaatgttgaggaggtagttataactaatacaaagatttcctttattccttatctttgaataaacccacctttcttatttgatatgtttaagaagcattaaaaaaaaaacactttttttgtcttttggcaaggcctgtaatctgttattattagcaagctctagtttttgttcaaagaaaacatttccggtttgttctcatttcctttagtttcattatatgaaacacagacatggagatcccatatgcaagttacctgtattcattttaattctctaacatgcatattccacatattcaaaagatgtttgaactaaagtcagattaattattgagataactttcatctgttgcctgccttttctcgtggcttttggaaacatggaaaactattttctcaactaactgcttcctgtacacttcaaaatgttaatgccgtgtgtaactcctggagggtttctcaaggtctaagtgattcaaaggtcagagtttttaaaatactgacacatctgtggcatttcagttcttaaaaaataacatgatgtatcaacatggaaaaccagtattgcagtggcttaacaactgggtctgagtagagaagaggaagacactgttaccaggagggatagaaaaccacctggtgaggggcccaggggctgaggtctgctggggagcaggtagtggttagagaaagaacacgttggctcccacagaactgttgtaccccacgctgggacttccagctctctttttgcaacatatagtttctcagacatatatctaagtcagatagcttgtttttaaaatttccttaaagtaacacaaaagaaaattaaaaattaccccagattctttcagacatgttttatccagctctcgaaatctgtaaaccctgttaggtcacataatatatggctgaatatatgataatcgagtacttttacttgattaattcaccgaagaattttttttttaagattcactattttaaaaaaatctactaaggtaatttgtctctgtgcagatagaagtcagactgtcactttaggatgatttgccagaaactcttacatttaatagaatttcatgccaccctgatctatctagtcccttctgagttccaagtaaaaactcattacagtgcagtctttctttatttaatctttttcttttctatttgtcattcccaagtttagtcttgaaagttactgtctcttagaaaaaaaatctgtttcttctctattgctcctttaaaactgttgtgtcattaccaaagaaggtcttttccaaactttctctcacagtctgtactcaccttcttttctgttttcttttggttttgttattgctgtcaaaatgagaatccctgtaacgtttggtttcagtggtggcacttggggagggttgattttaagtagatgagccttctcttctgcatgagacaaaactctctgttggccctcaggtgttaaaggtggaaatactggtgtcacaataggcacttagcaaaatgtatcactatttagagccataatcctttatggacttttattatttattgtaagtcttttcctttctcagccctgtgctgctgaccccacatcccatgcctggcctggaattgtccactcactatgacacccctgccccttcatatcttagcccttagattttctacaggagaaaaatcaaaatatactttccacagccatttcacttgtatccagaaaagaaactcaaggagataaaagttttataagattgtattttcaaaacccagggaaattaacagggggcttgggctctttgatgtccataccatcaacttccagatgctgctactgaagagttactgaatatttatgaattatgtaagtcttccagctagcctgtctttgacccgggccaaagggaatatgttgtgatagatgatgattttgttgagtgaaaataagtgatgattccctccccattagctgttaatttccacctcctcctctatcaactttttaccaaaaatattaaccagaaataaacctcttttcttgcttttttccacttccttggcttactttctggatggaggggctttttcataataaaatgactgaagtctaggcagctgaggattcagaagcaagggctatatggtgttcacaaactggctccttttctggaacagttggtaactggctgaagtaaccagttggaggacagtacaaacatgcttcggggcacgtcgtaaagtccagtgcatttcatggattgttttactccctgggaagatgcagcccgcttcatcctgtgtccggtacctcctggaacttgcctctccgctgcccgctgccaacagtgacagtcactgagcagcatgaacgaggtgtcagcctcaccaccccttactgaagtgctttttccaccgcaaagctgggtgtcacctgagaacggatgtgcttctgtactttacggtcactggcacaggagaagaaaaagaacttacggaatatgatttcagcattctgaaaatgaactttcatgggacaaagttacacatggagtgtcttctgttttcttagttccttgtgcagagagttaaggataaccagtgttattggagatctaatcccatgaagcaagctctgctctatagggcatgctgcaagtttagttttttctccttcctgaagcatgaagctaatctgggtaccagaaggattaatacacagttgtgtatgtagccatagtgccaccatgtgctttacagctttggcgaaatagaagcttacaaacagctaacgacctctttacccttccttcttcatttacagttaatagcagagacaggcttgctctaggaagctgtaggtacagcagtggcgaatgtttagagttgcaaattgaccaggcccatgagtggtacaagttttaggaaattggggcatatcttaacttctatagggaaataaagacaaaaattatttttacttgctctatttctcaatagaaaagtctttcagcttccttcagtacctttatactgaaacgactggtccctactcccctccatcacccccttctctatctcttccttttctccatttgttgcaaggattcatgggtctctattgtccataaattccttaggtgttaacggaccaacgaaaggcagtgtagctgagcgggaaagagtgcagatggggaagccatcatgctcaactcatgggcatgggcaactacctaacttctttgtgcctaagtctccacatctgtaaaatagggataatgcagtagtccctccttatccacacagggaatatgtttcaagacccacagtggttggcagggcgtggtggctcatgcctgtaatcccagcactttgggaggccgaggcaggtgggtcacatgaggtcagaaaatcgagaccagcctggccaacaaggcaaaatcccatctctactaagaatacaaaaattagtcgggcgtggtggcacacgcctgtaatcccagctacttgggaggctgaggctggagaattgcttgaacccaggaggcggaggttgcagtgagccaagattgcgccattgcactccagcctgggcaacaagagcaaaactctgtctcaaaaaagaaaaaaagacccacagtggttgccggaaacctcagatagtactgaaccctatatacacaatgctttttcctatgcatacatatggtaaagtttaatttataaattaggcatagtaagagattaacaacaataactaataataaaataggacaattataacaatattctgtgtaacattattcttattctggattaagagttatgtgaatgtggtctcgctctcaaaatatcttattgtactgtactgtggataactgaaatcacagaaagccaaaccatgggtaaggggggactactataataatggtggctactctcatagggttcttatgaggaccaagtgaagttaatacacacaaagcaccttaaatcagtgccagatacttagcgtttgttgctgttttttattgagcatgtactatgtactgagaactttaacatgaaacatctcatttgaacccttacagcacccctctaaaagatggcgttgttaaacctctttttcagtgacgaaactgaggctagaggggttattgattgtccaaaggtcccttaactatgaagtaaccaatatgaaattcagactccaatttttctgattccaaactctctgcaaaactagcacacttgctatctcctggcatgaacggatccgaatgcagagcatggcagctgtgtgtttggtctgagaccgattccctgttaacctaatatcttctctctgtagctaagacttacaccagccttaagctgccttgccttctgaaagtttctccattgattctttgcccgatagaaacattggcagcccttttgtgcatttttagtatccagcaggactcccttctaattctctgctccctcagaagaaatcttttcttttctatgcaggataaagctggcatccagggtagaaaattattttgaatgttgtttccctcggtgattgtctccctttcaattcaatttcttctgagcagctcagtgataatagggctccactcctcacatcagcaggaatccacacttttgaagacagcatgtgaagacgcagtgctagcccattgccactacttagcaagacccagaagactacttccagcacatagcacagcagcctctgctcgcttcacctagaaagctaggtgaaggttattctcaaatgtacctgtggtgttgaccagccctctcctttaaactcttcttcgacctgcaagtgtcgctgctggctggcgacattggccaccagcatcaccacgtcccatctggactgctgcactggccacacgccttgtcttctgcaagtcccccaggccgcactgcctgctgcagccacatggagctttctgaaactgaagtccagttccctgacccccttacttaagacactgcagtgccctcactactgttgggacaaagccatgatcactgcacacagggtccagactcatttgcctctaccatgggccttcctccagctctgcaggctttctcacagtgctggggccgccttccccagctccttgaaaccctaatgaccctactgtccatcccgcccatggtggcttttgcaggaaggcccttcctgggctccctggccaggccccgtggtcacactgtgtcccctccttcacggccttagccacccttgcaggttatgagatgtttggtagaaagcgacatatctgccccttcgcttctccccaattcctgcctcctactagcctatagccagtgttcactttttaagcctgtttaaattgttttgtgtttaagatacaaagaaaaaccatggcatacaaagttgtgttaaatctagcctaacacagtcatgtaaaactatattatctattaatgtatgttttactttaaagaaagtgtcttccattttcatcttaacattctctttttaaaattgaataatagcaaccatagccttgtggcatgtttagcaaagcagcgctagtcctgggagtcctaggcttggtctgttgttctgctccagatctgctgttttgcccaggggagtggtggggggtagtgatccctcctggctgcgtttccctgccttccagaaggttcagccaatcagaggcactggtgagaggtagggggaggggattaaggtagagcctgggtattctaccactccctctctgtctcccatggcagctgcatctcctctggtgcttcggctcccatgacctgggctccatttatctcctccttttgtccctccagcctcagggtggcaatggcttcctgcccttcctatctctgggctgtgttactaccccctggaacttccactgtctgggtacccagttcctatggttgaatttcgtctgttgtaaataaatagggctttccattttctaggttggacactgatggatactccagtattcttatatgtgatcgcagtacttattcacattttattttagaggcctggaagatggaccctgtgaccgagttagagttctctaattaaaaacattcaatcctttgtgttcactgtggtcatggttttagagggaaccctggcaggatgtctggtgaccctagttctagttctagctgagtcactaggggaccttaggatcactcaggtcagggcctctctttcatgttaaatgagggagctccctggggtcccttctggcagccccgttttctgactttaactccatcagaaccaacacaatttcaagttgcagttttcgtttctgtggggaccagtgacatgtttccttcagtgtattggtccctggccccagccatctgtcttgatgtgtgtagtgggtccctgagggatcaggtgacagaatatgggtgagccagggcaattccatctctaccgggaaaaccacagacaggccctttctgattctgacccaggcagggcacaacacacagaaagaatagagcaagaggaaaatgtactgcacagctgtcctcctctacgggtttaacagtgtttcaaagatgatgtttcatttattccccccaaatataaaacccataggcagaaggtacagctggcacttgtctgatgtaatgacttttctttttctccattttaagcacaatcttcttatattcactaaacaccgttgcaaacagcaacaccttatctaatattgcgtatatatgtatttgggaccaggtgctctgggtgtcttaaataactttaatttactaaacttcactccccctcccccaccccagccctttcttttcagaagacacatttagacaatcaccattcacctccaattcaaaagaactgctgcccagtgactccgtgctgcacggaagaatatcagctccaggtatggaaacattgttggctttgcttctactgttgattgcttaagaattacttttctgaaatgtgtgaattttcagatactttcagcttacggatgtagttattcatataaggttaggttttagaaaagaaggagaaactcaatttaagctacaaaagtttattaaaataaaatgtttacagtaataagcctcttcatctttgctttaagagcttattgttctttacctgctgatatttcacccacataatgaatttctttttctttaaaataatgaagtataacctgaaaataatttgctttacatgttgtatttcaggccggcagccaggaatataggggagggcagtggcgaagagtgctagtccccagtagggcaggtcatgaccccagggggtgtgggccaccacaaagaccacctcagtttgcatggaaacgagacagctcactgaggaaaccttgccacccagattttgtctctcttcttggccatagtatctacatatatccatccagtgctctgttttgccatctcagccatcagtacatcattttttatccgttcttccttttttcatttctcctttcctgggtagaaggaaggatgtgcttactgttccttatccacagcatggccatcctggagggcttatgtgtgtgttctcagagttattgggaaatgagaacatctgagaaccgctgcactctagttcatactccctacccatacccaccccgcccaccaccaatctagcagccaggaaacttctgccagttgctaccttccctcccagctgtggagaggatctcagcagcactcggtagcctccatccacattcatttgtccaggaaaccgtggccacctgtgtgcagggcagtactcacagcagggttgttggccccgcagcctcttcaaaaataaagtccaagtctcctccacatactcaaggagccctgttttacagggcactggagaactaattaatttgcaatgcagaaagaatgcagtgacatctgaaatattggcctcgggtatcacaggtcattggaaatagtttgtgacaaactggggtggagggtgggggtggggaaggcaactctttgtcattcttgagtctcataagggtagttccatttcttctcatctccccacattcagccaaagaatccagatacctgcatgctttttagctttgcaggcagggcttttctattcaaacaccagaaataatgtgcttacacaaaaacacattacataatggctggttctagaggtggaaagaaattttgtctagtttatgtcttcatactcaaacaggggttcttggaactactgtttacttcccacagtgtcattttgaatagccatctccctggtcccaaaattattgccctgctgttaagttgatggattgtgactttctaatgtcaaaataactgcccaggaattgcctgtcagaatgctgtgacccatacggccagcatcccatgatatatatacaaaccttgcactgctggctttatgtttggcttggcagtatttaaagcagggtttattggtcaagttaaaacttgacctaaagagtgatttcattatatgcttaactgtgcatcggggggttttccgtgatttgcttgataaacttacgttagacattagatgaactcacactttaaaagcttaactcttatttgggggagaaggtcagcataactgagatttttaaaatgtaaattcgccctgctgaaagataatcaatctaccctacttcaccaaaacctttctttaggtagagaaaagcaaaatgactacatttacattttgttaaaataagcagctaaaaaaaaaagactttttttgttttaataagcaaggtgaaaatgctttgggaatggagttaaaattagaaaaaaatttaaaatgatagggacaaccttgtggtcatgaagttctcataatctgaagacagttttgtaaggaaggcctcaataatttggactaattgtggaggagaacagcctgaattaatcaaagttaacggtgtggagacttttaaagaaaacttaacttctttcaagtctggacagtgataaatggccatggataaatatacctactatacattctcaatctcttaatcacaattctgaaatccaaaaaaccccacccaccaaaatttttttgaataaatattttgtggcaaaacctaatgggaggctatttatttattgtctttatttattacaacaaggggtgaaatttatacattttgttgaagaactatgaatgtacttgactatgaagtgttgcttcaggtccactgggctgttacataaaataggttttatgcaccatattgtgatcctaaaatgagaaagaagtatgaatgccaaattacatctggccccagggagttcagataaatattatgaatctacatttattttagtaatctgctaaatgcagtgctgggagcaagaacactgaagctacagttgaggatcttaaagttctggagtataagagtcatgggttcttatagaacatttcatctgggataataagattggagtgtgaaaggaaaaaatgaaaagaaatttttgaaagaccaatccggcagcagattagtgaatcattggagaggattgggggcaaatgacaggagcctagctgggatcctctagttctagggcagctttattaatgagggcctgagttagagagaaaaagaggagtggggtgggaaaagcagacagaggatgagttggctggttggagactggttagctttgctaataagcacgttgaattaggaaatgatagtggctgtgcagaaatagggaagccagaaaggagacagctggctttagtgactaggtagaaaataatttgttgttagtgtacaaatgaaagcctcagaatctttagaaatcttctcttaggtagtttaaacactaccattaaaaaactttctaccttttatttacttagcaaacgtctttgttcagcagataatgcaaaaataaatgtcagcccagagaactctctcagattcccaattagtagagaccataattaatgagatataatgtgcctagttccatttcccttgcaaatgctgaaaatacatagcattatttcaacaatatatacaacattggtatatagttatgtaccttctaccaataggaagaagagtccagatgccttcagattaagaccacagggtaaggaagtgctagaagagaatatcatttagggtgtaacagctgctgggccaaggggatccatggtagcttcagtgtgttgtgcttgtgtttcaggcctgttggagaaggaagccagcagtgagggggattgcaaagtagagagaggttggtagaactgtggactgtgaagagatcgagaatagcacagttaactaggcatttgccttcggcagatggcatctgaaactcacagctgccaccgtcccagagaaacagaataaacacagagcttcacggtgtcctggctgcggttgttgccagtatttctagactgactttcctgagaactaaagaatgctcatgttagccaagacctaacattttcacttgctgcgaatgtcttaggcagaggtagcatcaggaatctttaataaaatgatgagttaaaaactgctgtcaccttctgcgggagggatgtggggacagaatatccttagagccataaatagattactgaatgtaccctgggtggtgatgttgctgctggtgactttacaaaagaaataaaagagctttcctatcatgggggagatagaaattacagactacgtgaaatttaatgtactttatttaatttatagttgtttcactttgtgcaagatttacatcaatagaagaaagattccgaggtcaggtgattttcagggcatgtgggtgattctgtattaaaagcagacccattgccattgtacctgcagctgtccctgtttcccatcatcttgctgtaagcaaaggctgttaagagaagaatttatatcccagtactgcttttaaacaacgtggagcttccattctgtgttattatgatttgaagtcacagtatgtttgctctgtattaagccaaaaaacaaaaacacaaccagggcgggtgtgaaggaaaatgtgggtctccgtggaattctctccgagtgtttggagtccccgatgcttccgtgtgttatttcagatgcagcctggagtgagataatgtaaagcacatctgcaattatattcatcaatcccttccctcattatttcccctaacttgcatttaaaaaaaaaaaaactcacgttgttggttttatttataatgtacaaacaagaaaagatgaacatcagcacccctcacaaaaacaagctttttttggtaggcagggggaagttttagtttctttcaggacctgctatgccagtcagaatttgatgttcaatcaaaaggctggtttggaattgcctgccttgtcctcagtcttgttcttgatccattttcccttctctggtctgcctatcaatctaatatactgtgtcatatactttcctgaaatctgaataaatgatgccttgtattagaatgccacctgcaactagctctcagcctgacacacccctggtcagaagtgaatgacctctttaagaccgttggcttaaaaagatacgtctcaatgtgtgcatgtcaccttcctttgtgttaagacttcccaactcaggcctcgagagagagacacacgtataaatctatcttggattatattatagcaaactattttcttcagtccattctcaaacacagcagattctttttcaatttagacaaagtcatagataaacaatagaacattggatgttagtgtatatcgttttgtaacttgagctcctttgtgatgagacaaattcattttgtacagagaaagaagctagcagttttcaaggatctattaaattgtcaggcacaggacatatgtcatctcatttttaattctggaaacaactcattgagacataggaattatccacaatttacaaattactacctggaggtgtagagagatttaataacttgttcaaagtcatacagttgaggaggggcagcacaggaattcagacccagaactgcacagcacattttctctctttctgccctatcttgctgcctgctaagtcagataatatgtcaccagacactgaccaaaaggaacacacctcccagtgttgcccacatttaccgcagctgttggcattttaagtattactgatgcaccgtcttcttttagctagaaataaaaattagtcctttaagtaagatacttgaaataatttataattacttactgttgattaacagaattctaattgtattctcttctatttctatctttcctctcttcctttaatgctttgatatctagtaatatcatagtcacttggaacatttctttcagttaggatgtcagtagtttttaatggatcatctggttcatagaaatggttttatgaagctgtgttaaaactctcagttagataaaatatgtattgctgagtttagtgatgatctggtcagcagcatagaagaaacatttctagactgggaatcaggagaacttgggtttggtcctagcccagtttcctatagaaagagatgagaaggtctacaagctccttgcacatcccctgtattaaaagttctgtcatcttgatatggtttagctctgtgtccccatccaaatctcatcttgaattataatctccgtgtgtttagatcatggtgatggtttctcccatgctgttgtcgtgatagtgagttctcacgagagctgatggttttaagtgttcggcagttcctccttcattcactcacccttgtctgcctccatataagatgtgcctgcttccctttccgccatgattctgcttcttgaggcctccccagccatgcagagatgtgagtcaactaacctcttttcttcgtaaattacccagtctctggtagtatttttatagcagtgtgaaaatagactaatacacatctgttatggcactgtaattttagcccagactccttcattttctttctagggccaaaactatatgctagcacaggagaaaatcagtctagtctaggggctttactgctaaaattctcccacctacagtgaaagttgggaaagggaaaagtcaccataagtagttcttgaaagacacagtactggggagaggtagtgactgggatggggatgagaagggcttttaggaagctggggcattctctttctttatctgattactcattatgtatataggtaattttgtgaaaattcatcaagctgcatacttatgatagtatttctgcatttgtcaaggctaattgcttatttacaaataggtaggtctagatgccaagtggacaccttcaggctaataggagtgcacatttgcttcagactatgacagtgataatgatgacaacagtttttcaattatgccacttctagtttgcaggaacatttctatttgtaacacaaactggttgccctaaactaatgacatgtaggttgatatatcttctcctgttgcatttcaaatccaaaaactattccacactgcttatggcacttctttgatgtacttgcaggagataagctatagtctgtgcagctgtttactagagggagaaagtttcgtagttatggattttcttgatccagacaatgttacttgaggctaaggattgtgtgctccttgttagccccatctgtcccccaccagcctagtttggtcttagagtataggtgtatttcaaaggggagctgttgactctattagaaactagttgtagagaaagatctttcattaggcactgtcagctatgtgtctgagttagctcttctcagtaattaactaattaaattaagttgtcagcccctatagaccagcatttataggttcacacactaaagtacacgcatacttttttaagggtggtaacctttctaaaggagaaatgtgtatcctgtttagatgccttacctgaagaatctgtagaaagccacaaagataaagaaacaactgtgattgtgtggccacgcccctttatctctgcccatatggtttgagtctgcccagataggttgagtcacttggtattaaaaataattatcaacactttcatgtttgtgctttgtgggaaatggtaacatccgaaagcccttataaaacccagatccaagtcaaatgtggtggcccacacctataatcccagctattcaggaggctggggtgggaggatcagttgagcccaggagtttgagaccagcctggacagcatagcaagaccccatctcaacaaaatccaaattccatttgaggactttgtttctcaagtataggttatccccagggctgtggccactttggccttggcctggtttcttcctctgaacagagcaaatttatcaaatttatatgtgctcacataatattccaaacaccctttataaggcctcagcagtgcctgtggttgcttttttacttttgcaaagactatttagatgcctcgagaatgaatagtgctataaaaggccaaattcttgagtatgtgtaatggatgatggagagtatttgtttgaaaattgcaatgcagtgaccctggcttcagtttgggactggctaattcaatctacaaggccttttctgtatatacaatatgttcttccattcctttgctatcaaaaatacatattctcatttcatgcaatttcttctttgtgtttatttcttttcagggcagcaactgccctctggtaaccaggatagaaaaaagaaaagtaattccactcataaactagaccatctattttcattcaaacaaatctattctgtattctcttacctaggccaaatgagtgcctctctgtggtaaagaagacactcccacatcacaccatggctgtctcctgatgtagtgataggaatgatggtccaggacttcatttttcattttctgctattctctctcattcattgtgtctcttagcaagatacttagcttttctattttcactttatcattcagaaacaaaagatgttcactagaaatgcaaaagtgtggccagtgtttgcattcgcatgatatgaggttcaccacaccatccccagaagttccattcagacatcccacatcaaggtccctggagctctttcagtccaaagggcttcaaactgaagatgtcatttcccctgcctcccactttcttcataccactcctccaaaaacatcaatcagtgaattaaaaccctcctctcctatttttctgtcttaatagatggcatcataatcatcacccaccatggcacacaccataagtttggacaccatttgtttggatttccccagaagcggattgtgagacaaatttgggtgcaatttttgggtttttttgttttgttttgtttccaagacagagtcttgctctgtcgcccaggctggagtgcagtggcacgatctcagctgactgcatcctccacctcccaggttcaaggaattcttctgcctcagcctcctgagtagctgggattacaggcgcatgccacaacgcccggcaaattttttttttttttttttttttgtatttttagtagagacagggtttcaccatgttggccaggctggtcttgaactcctgacttcaggtgatccgcccgcctcggcctcccaaagtgctgggattacaggtgcgagccactgtgccaggcctagtttttgtttgtttgtttgtttgtttgtttgttaggaggtgagaccaggaaacactggtagcaagatggaaaaatgagccaagcaaaggaaagcagccaaacaggttaccaatgtggccaactggagattaatttccctggggacctctgggacacaatgtaggatacacacttcagagtttcctacctcaagagtgagacagctgggatgtgtatgcagccagtcatcagttaaagctgctcccaggagacttaattcccccaatctctggtctaccatacatgtgggccaaccaggtttcagtggccagagaaagcacataggaaatacatgcaggtactggtggtgggaagtaaggcattgaagccgtgaaggaaaagtgatacaggttgagtatcccttatccaaagtgtttgggatcagaagagtatttcagattttagatttttttatatctagatagatagataattttcatgatacttactggatgagcatcccaaattcaaaaatctgagagcatttcctttgagcatgatgctggtgctcaaaaagcttcgaattctgagcatttcggatttggggtttccggatttgggaggctcaacctgtaactggggagggacatgaggaacaacactatctgctgcaccatctttcattattacctcttcttcaccctccacttccattcagttaccatgtccttctacatcgatccctcctcctagatctctcctaaccctaactgcagtaacttttattctagtcttcatcactagttctctggattacagtggcctctggctggtcttcctgtctccagtgtcaccccctcaaatccctgctgtccatcctgcagtccgactatctttctagactgcagatctcatcaggccactgccggcaaggggggcttcctgttgtcatcaggataaaatctaaactttgactgatgcacatgcactcgtaagactgattataatacgggtctgtttttgccacaggttaaaatggatccacttgcaaaaataaaatgtacaataaagccttttataaatagaattggtctctacctaatgcggtgctcacactgcattagtccccactcatcctcaggggatacattcccggacccctagtggaggcctgaaaacacagatggtaccaaaccctggaaatactatgttttttcttatacacacatacctatgataaagtttaatttataaattaggcacagcaagagattaacaataataatgaaatagaacaatttaataacaacatactataataaaagttatgtgaatgtggtccttctctcaaaagatcttcttgcactatactcactcttcccgtgctgatgtgagatgatgaaatgtctacatgatgagatgaagtgaggtgaatgacagctgctgtgacgtactgtgaggctgctactgaccttctgacactgtgtcagaagaaggatcatctgcttttggtgatcctggatcgtggagccatgataatgttgatagatgtcaggagcagaggatgtcagtgactaatgggcgtttaatggaatgccggacaaaggggtgactcacgtcccaggtaggacagaatgggatggcaagagatttcatcaacttagaacaacacgcaattttttttaacttatgaaatgtttatttgtggaattttccatttaatattttcacaccgcagttgaccgtgggtaatggaaatcttagaaagcaaaaccacagaggaggggacgactgtcccatgaagtaactctccttttagaataaaatggtttaggtcaggcgtggtggctcacacctgtaatccgagcactttgggaggccgaggaggatggatcacctgaggtcaggagtttgagaccagcctgaccaatgcagtgaaaccccatctccactaaaaatacaaaagttagctgggcgtgttggcgtgcgcctgtagtcccacctacccaggaggctgagacaggaaaatctcttgaacccaggcggcagaggctgcagtgagcctagatcacgccactgcactccagcctgggtgacagagcgagacaccatctcaaaaaataaataaataaataaataaataaataaataaataaataaatataaaatggtttaccttgacagtagaaagactgcagggctatattcgttttttcaccttagatgccgagctgattgccaaccactaaagaaacgttaaggcatttctggaagcagagagtgggagatggaggcacaagaagactttagatggtttgatgtgagagtccaatactcaacatgaaaactgaagactgattttctcatgtgataataaatctcccagtcataaaaattccctctgtcattagtctcatattaaaaagcttggagttggtctggtgcagtggctcacgcctgtaattccagtactttgggaggccaaggcaggcggatcacctgaggtcagggtttaaagaccagcctgaccaacatggtgggatcctgtctctactaaaaaaaaaaaaaaaatgcaaaaagtaaccaggtgcagtggcacacacctgtagtcccaactacctgggaggctgaggcaggagaatcgcttgaacccaggaggtggaggttgcagtgagctcagactgtgccactgcactccagcctgggtgacagagtgagagtccgtctcagaaaaaaaaaagcttggagttagttcaagtagaatttttttcccatctctgagctaacagatgttttaaagaaccttttttatcaaatgagcttcttttcaagtataaattattttagcgatggccagttttatattttgatcccaatcaggcaaaagttcacattggagtctctcatcaatacttatggtaaactgtgtatgagacagatttaaattcaggcctaaatcactaaggagtttgggcagcccatgaaaaggatatatctgtatttcttttaaatgattaaaaaattgtgcgtggtttttccctcttgcttgggaaacatgtcccacaaatctcctggcacttccaaggtcttgcacatgaagagagaaacaacattctacagctgtcaagctgcacacctccctagttgtagacctcctcacccctacgagaaacaacagagacagaccttacatttggaaatcaccacatgtacatagccatttctgtccttagcttcctacactctcaagtgcttttgcattccatctcccaatctccttctctgtgtctactgtgagccatggtgaggcttacataatgtaatacttacatgaaatactctattaaaaatataaaccagaaatgaggggccaggcgcagtggctcacgtataatcctggcactttgggaggcgaggcaggccaaacatttgaggccaggagtttgagactagcctgaccaacatggtgaaaccccgtctctacaaaacaaacaaacaaaaattagccaggcatggtggtgcatgcctgtaatcccagctactcaggaggctgaggtacgagaatcacttgaacccaggaggcggaggttgcagtgagccaggattgtgccactgcactccagcctgggcaacagagtgaaaccctgactcaaaaaaaaaaaaaaaagcgaaatgagttctcttggttgcagagaagtataacactccatgttagtttgtgagctggacgtcaatgtctcgttctaggaatttaatctacaaatagacttgaacaagtaactttaagggatatggacaaaaatacactttgcagcataaagacctgaaaacaaactaaatgcacataggtaggaaaccattttcaataaaccatgaatattcagtgggaaactccacagccattaaaaaagaatgaaggagatctgtaggaatctctttgaaaaaatgcccaagacatattgttagataaaaaaaggaaacactggctgctgacaacatgcgtgacatgatcccattatgttttaaaaaagaggcagtacatttatgtgtacataatagcttgtatatgcatggataatttcttaaactgtgactggtgattaccactgacaagtggaaaggacagggattgggagaaggggacagtagtgagaggcattcttttatttttgagtttatatcctttgttctatttttttcatcaatttacattacacttataatttctaaaagttaaaaaagtaaagtgggaaaccattgtgttcaagtcactttttttttttagaattggcctttactcatataataatttggagccataatgaataatctctagatcaagtaaactgctaaaaatataaagcaataattcctagccgtcttccttcagtaagctcccctaaccagaagccagagttaaatgagtttttcatacagtttgtgaaactataaagcaggttacaaatccacatgaatggtatgattccatgatttgtaaaacggtgggcatgcaggaaaaaaagagcagaaagaataaatctagaaatgttagcttttcctcagtttagttggcatgtcaagtaatttatacttatattttatgaatttccatttttataagaagtatatgttactttcataatcatgtaattgcctgatgggtccttcctgcctgctgcacagacaaaaccaattcactgagaccctgttattgcagtaaagagtttaattaatgcagggcagcctagcaggaggactggagttatcactcagatgagtctccccaggaactcagagcccaggttttttatggataatttggtgggcagggggctagggaatgggtgctgctgattggttggagatgaaatcataggggtatagaaaatggtcctcatgtgctgagtccacctctggatgggggccacaggactggttgagtcatgggtctgggtggggtcagtcagttgccagaatgctgtctgaaaaacatctcaaaagaccaatcttagatgctacaatagtgatgttatctatagaagcaactggggaagacacatcttgtgacctctggccacgtgactcctgagcagtaagggattatagaaactacaccttcattttagaattcagacccttctcataatcctagtcttgtggacttttattagttttcagtctgtgagccagaagggcattagttttagggagggactattatcatcattgtttcaaagttaaattataaactaaattctccccatggttagcctgccctaggcccaggaaaaagcaaaggcagccagtctgtgaggccagaagcaagaatggagtcagccatgctggacttctctcactgtcatcatctttgcaaaggtggtttcaatcagaaaacaccaataagttagtttcattttgaacaaaggagaaaatatcttttcatactattctcatactgaatgcttgacaccaactctctctggaagtttctatcatgaggatattcctggagctttggacaaaatccactttggcagaaccacatttaaatatgacgctaggctgggcacagtggctcacacttgtaatcccaatgctttgggaagccaaggcaggaggattgtttgaggccaggagttcaagaccagcctgggcaatgtagcaagaccccgcctctgcaaaaaatttaaaaattagccatgtatggtcgtgtatacctgtagtcccagctacttgggaggctgaagcaggaggattgcttgaggccaggagttcaaggctgcagtgagctattaataagatcaagccactgcactccagccttggtgtcagagagacactgcctctaaaaaataaaattaaaaaacaagcaaatacataactgtgactccagaaaaatggtagacctaaaagcagctaaagtaaatggagatattttcaatgaaaatgttgggaaaaaatcttgtaaagtggtatttgcaaagtagaactcctctttaaggtatcaaagtgcttcagactaaggaacactatttgaatgttctgcgtttatctgtacctactaccttcataatttccccatcctctgttgtatgcactctacagaacctctttcctatcggggctttccagtcaaaatgactcatccagctgcagaatctagtttctccgccctaagtatctaggaatgagtcactcaaatgagttgcttcttttttaacttcaatggaattaggcttgaaagattcatgatgggggagggtcctgggaaaggggcctgtgctgaggttatcagggaaatcagctgtattataggaatgggaaagaggccaggaaacaggataatgagggagtgggatagcctggaggtagaatgatttataaaaaaagattagatccaaattctggctgtctttgttagagtatggaggcaggaattaattggttatgtggattgtaggtaaccattttgtggcaagatgacttaaaaggtaaggtgactcatcctaattattttttttttgctcactaattttctatgtactgtatagtcacttgcacccacagaaaaacaaggggaaagtttactcaggaaaaaaaaaaaaatgtgtactcttgcaaatgcttttaacatgtaggcaagctttcggtatgtgaaagttatttctgacacaatttttggtcaaattgtttttcatttttatgaaaatgttaatttttaaagcactctggtctatctcccaactgttacttttatcactcgaaaatgtgttattttaaaaatatcatcactggtgtcatactaagacttgccatgcctttcatagtaattaatgttttttgttttttgttttttttttgtttttgttttttgttttttttttttaaagcagcctggcacagtggctcacgcctgtaatcccagcactttgggaggccaaggcgggcgaatcacgaggtcaggagttcaagaccagcctggccaagatggtgaaaccccatctctactaaaaatacaaaaattagctgggcgtggtggtgggcgcctgtaatcccagctatttgggaggctgaggcagagaactgcttgaacccaggaggcgttggttgcagtgagctgagatggcgccactgcactccagcctgggcgacagagcgagactatgtctcaaaaaaaaaaagcactgggacatgaaaaagaaaaatgaaagttatctttgggtgatgatgggaactctgattgagggttttagttttgtttccccctaccaccaccttgtctctcttcttctagttttctataatgagcatgaaacacttctataaagaaaaattaaatgtttagagggagtaagatgttaaggaacaaaggtaagattcatggtgctctgagttaataggccgtaagcttaataattatggttatacacaggataggtctttgtcagagactgctaaacatcttgtacaacaatcttgtgtaaacaacagtggtcaggaaaagactccccagaaggtgaaattccaacaaattttggcagagtcatttcagaaacgttaaagttacacatcctgtaagttattaataaagatgtgaaatccttgtatgaaatacgactatgatcacagtcatttccatttggaggttcacgaagcttactcaaggaatgattgaagtttgagggtggttacttatttttaaccttgcaagggagattcatgaattaaattaatcttagggcaccaggtgtgatagaagaactgcacgccattttctctatcttggttgttgaaaatagagtgttcaatgggacagtctgttgtactgtctcattgcatcattggtctcataagtatcagtgacttaggtataattaataaaataatagctgccgtgggagggtattttcagtcgttatatcaaaatgtataataagcattctaatttctgttatatctgtttaatttcctaacaaaggagttcagttagaaaaaggatatcagtggctcctgacaaacctgtccttaactttccccttagattattttcattcttctctgccagtgtcgaagaatacagagatgttgcagaatgaggattaaattaaaaaaaagatctgagtatcattaaatatttgatgagcagtatgagaagattgtgaggtgtgcatatcactggggtgaaaagaaagttcattcattcatggcccagcacaatgtctcacacctgtaatcccagcactttgggaggccaaggcaggagtattgcttgagctcaggagttcgagaccagcctgggcaacatggcgaaaccccatctttaccaaaaatacaaaaaaaaagtagctgggcgtggtggagtgtgcctgtgatcccagttacttgggaggctgagatgggaggatggtttgagcccaggaggcagaggttgcagtgagcccagatagcaccattgcactccagcctgggcaacagacccagaccctatttcaaaaaaaaaaaaaaaaaaaaaagttcatttattcaacatacttatgagcagcttttgtatgccaggtacttcttaggtcctggggaacagcagtgaataaaacaaagcccctgtcctcatgaagtatacaccctagagggggaggcagacaataaactagtactattataggtaacatcatgaaaaaaaataagcaagggaaagagggggtttgggaaggggtcacataaggtagaatggtcaggaaaagactccccagaaggtgaaattcaagcagctacctgaagcaagggtgggagagagtcctgtattgcctcgtggggaagaaagttcatgtaaagggagcaacaaggccctgacgtcagggtgagcttgaccgcggaagtgacagcaggaagggaggtgaggctggaggggagggagggagccggcccccaggtcatctgaaatagcatggacttgggctttcattgcaagtatgccaggaaccattggaatgctttgagcagaaaagtgacatgatcttacttccatttaactctttcctgtttaatctttaaagcccaaataatgtcctctgaaaggcttaatgggaacagagaggccctgcataaagataaaagaggcaaagaaaggtaatttgctgagcagaatttttatagtggatggaatctgtgcatgttcctttaataattagttaattattgatggtgagtgttgcccaatatttttctcattaagttatcacagagggattctattttgttacatttggttgaaatttggggatttttttttcctaatcagttaaaaatgactatctagatatttaactgaatacttatgggaaaaagtctacaaaacttgttctagtaacaaaaagaaagtctcagaaagttaaagaacatgaaaccaggattcttttttagagacaaatccattatttagaattccttctagaagagggaatgccttcatcagaaaggtgaattttgcttcacacaaatgcacacacacacacacacacacacacacacacacacaaaaggaattgctccggcattatttataaagagacgtgtcagggaactatgaattctccaataaaactgcaaattactctaacagatgcatacaaaacatgcctagaggctgttgtgtatttgtattttgccagtactgccattgaagaggtgatttacaatcctaaagccaccaatgatggcattttctaaatgttatatcaaattatattgtgtaagacagtaacatctgtcacttagaatggaattcttaaatatttgttatataaatataatactgacaatcaaaaaagctcatgtttgctaatacataataggcatcttttagagggagggatttgcactgtccccactcatggaaatagtacctaataagaaatttatttgcctcccttacttagaaacactactaaatattaaatcatcaaaaacctggttactaagtaaaatgaccacagccactgaagggttcaggttcaagatgagttttcaactaaatgtaccagttcccacctaccttcaataatcttcagatgtcaaaatcactttttaaaaacattttctttgttactcgtaatatctgaggaaatgtagattcttcatagacttttcaagacttggattatataaacccattgttcagctagatgtttgttttaaatgttttttagccaccagaaaaaaagtgattatctagtctagacttgttcttgtaccattcttcagccaagctgttcagaggcagtttgctgagatagggagtgagataatatgtttcagtgaaaaaataggcagtccactccttgctggcaggctatgaggttgattacttaatgcctgagccagagagtgagtccaaattacagtttcctctggaatgatgcaagcttcaaaattcactggagtggggagtagagggtggagagaggagaaacctttacaagtgattggattacatcaattttcacttctgtgtgtacacacgcatatgtatatgcgttcatttccttttggcatgtaagaataaactagtccagatttctaaaagggctttgctgtttttaatagaaatttccaccgaagagactttagagttaaaaaattcttggttgactgaaatgaacagattgctatctggcaatggtggcccctcttctgggttgcacaagcatataccagaataagttataacaaaaaaaaaatatgaagttagggtaaactacatccattttgagaaactgaattctttttgtatgcataaataacccaaccaggaggatctggtgtggttagcacactctgaatgcgtttaagtcattttcatttgattggagaactgggataaagttggagattggcctttgggaaatcattactggctcaagctaaatgatattgccagctctattaaagttctagagtcttggggagtcatatacaccaatttataaggaatcctttgatcaattggaaaaactcctctccacctaaaatggaggaagaaaagatgtctccctggtcagattgtgtggttgatgttctcaagatgataatattagctctgtgcctctcagactatatccatgacagtttctaaatccttttgcaaacagctagattccaaaatcactgcctttatttgtgcaattgaagaactaagaatgatcctgatacactgtttgctagcaaagaagtgatttccttagcctcttggtggtaaccagcttgagctcatttttttttcaaattgctgagtttaatgggattaaagagatctctaaagaaggaattttaaatctgcactaggaaaaggatatttgtcattgttttgttttggttttaatagacttggacttttaagatcctttgtcataactaagtaggtgaaatgatgtactgagttggtggcttttaaaattttttgaagaaaacccagatacagttttacctgtttatatgtgtgtatgcatatgtgtgtgttaaataacaatgcaaaacatatagagataggtgtttaggtaaagtagataagtgatgacagataggagggaaggaaggagagagggagagaggaaggaaggaagaagagaggatagatagttacaggtaactgaaacaatcctcacacatgtaccatgtctgcaattttttaatctatcctattttatttcactcttttatttttgtgagacagagtctcaacctgtcacctgggctggagggcagtggcgtgatctcgactcactgcagcctcaatctccaaggctcaagtgatcctgcctcagcctcccgagtagctggggctacagatgcataccaccttgtctagctaactttttaattttttttggtagagatgcagtttctccatgaactcctgggctcaagctattctcccgccttcatgtcccagggtgctgggattacaggcgtgagccactgcgcccaacttatttcacccttttaaaaaatgttggttgagatccactaaatcaattttataatcggctggcgggtcacaaccagaaatttgaacatcactgggctagctagtaagaaagcctggagtccccagctttgagttccctcaggaagacctgagaactccctcatgcacccctgctcccacctttgtgccagctgctttggttttgactgaacaggctggtttgtgccaaacaccttgtggatccaaactcccatccttattgagatgattggattgttcctgaactagacctttgaagttgtgcccaacaggagtgaaaacaaataaaacaaaggaatcaagccttttcccagtgtagtctggtgatactctgctttgtatctgagtggaaagagaaagtaatggtgttttacatttgagtgaatctcattgaagaacagtgtctctgaaatgcttttcagagtcttaaagtaatgataaagtgaatttaagtgggaggaaagagaagaaattttttaaattctgcatttagccatttaattgaactcttagagctcttagtatctgaaacaagtctttagttatgtactttcacagatacaggtaactatgacaatgcccagccttcattcttattcggtgtattagataagggacaaatgaccctctctccccagtgtgttgcctttatttccattttctaaaatgatcttttcctatgaatagcagacccaccttcctgccctccccaccctccctgccatgagtggtagaatgctcacgttgaaataatggagcttttggttgctggcagcaatcagctaagcttttaaaagcatacgtattgaaagggaaaagaagttatgtcttggattccacccactccagaagtcagcaaaaagaaaattctctcaattaaaacataatgtaatttccatcccacccttggggcattacttctgctaatgttgatgaaaatgaacatcaaattgattggcttcccacgccctgacaatcattaattatgccaaaggtgctggggatgagtgtagtgatttgaaagaaacacaagttgacagcttcttcctgactctagagtcccatctcaggacaggtgacgggcctgatgtatctttttagagtacacttcttccccactctctctaaaaagaaagagattttgaggattttatttgctttgaattagctgatcccatggaatgtagaaaggtttccgtcaaaacagattcagtgctgtctgatggggatatcaaggtagaagaacatgataatggggctttaaaagcttacatgtttgaaaatgtctgcagatgattttcttttattatacatatataatatctgaatatctgcaagtacagtgctagcaacatacaactgctaacggaattggaagtttaacagggcaatggtcttgattctgaaagggtcaaattccctactaccattagagattctataaaagaatcctattcatacatagaggattttttttttccttcacataggcaattatttccatcttaaccttggatagaggaagttggactaatagttaaatgtgcttggaattatgcctatgacttttttactaccttgtgaattttcttattgaaagctcagtgaacttcttaatttaaaaaataagaattagctcatgctctttgcccttggtaatcaccagggcaccactatcatccaaagtacattaaggacctacctgcctgtatccctactagaatttaaatagtcacagtctctgctttctcaaaatctgcaacccaggatacattagatgtatggttctcaactgggaggtattttgcccccaaggggacatttggcagtgtctggtgttacttttcattgtcttaactgggggaagtactgctggcatcttgtaggtggaagctggggatgctcttaaacatcctacaatctgcaatgcacagcacaggccccacagtagggaattgtcagtcaaaaatgtcagtagtgctgacgttgagaaacaccaaattgtgttggcagatgtgtacataaagggcatgttaaaactaagactcagggaccagctgtacaggctgggtgcagtggctcacacctgtaatcccagcactttgggagaccgaggcaggtggatcgcttgagctcaggagtctgtagtcttagctactcgggaggctaaggtgggaggcttgcttgatccagggaggtagaggttgcagtgagccgagatcatgccactgcattccagccttggcgacagagcgagattctgtttccaaaaaaaaaaaaaggaccagctatccagatgaaatgatattgcttcactatgtttatatatgtatttctggaaacttctcaagtttctaacttacagtttggttacttaatagttctattaatactggtacttgttttataaaagacaactggacaactgtgacatgcaatttcattgtaacagtggcctggaaaataagcatcaaacatgatggaatcttgctcatgaattattgaaatctcaagaaagagaacatatgcattatagagcaggggtcctactctctataaactaactaagcatactttacatgaaaaaattattgtatgtattagttgtgataaaattttgatggctgtaaaaaaaaggccaaaatagcaatggcttaaataaggtagaaggtgatttctctttttatgtaacagccagagtataagcagtccagagctgatgtggcggctctaaggctccttctctcttgttatcctgccattcttggcttacatcttccatcttatggtctactatggctgctcctactcccaccatcacatccacatcctaaagagcaggaaggaagtcgagggcatgaccctctttttaagggcatgtaacacatcacttctggtcacactgttgtctagaacttgatcacgtggccgtacttagctggtaaggagattgacagtgttttgttgggcagccatgtgcccagctaaaactcggggggttcctttattaaaggaaggagaaaagtatggatgttggagggcagctagcagtctctgctcagatgtctggttttaggttaattcttttaggttaaaccaaagactggttaataattccaaatggcctttggtcaggatagagttcacagactgtgacagtgtctgtgatggcctgttattttactctattacattcatcctgaatagtcagccttccgtgccagacttccttatttgtaaattgccagtaatacctaactcataggcttatggtgaggattaatgatgtcatatatatgttacacactcagaacagtccctagcacatagtgagctccactaagagctataaatattattgttatgggtgattgctgtgcccgactagctgatttgagccttaacttattcagcacacaaatgtctgttaatttcatttggtttgtaaatctcaatatttgttgctctgatctaatttggatttgtagccacaaccccacaaccccaataaagtatcaaaacgggagatctgctttgaatatgaagataatgctaaattggaattgatgtgggcacgaaccagtagactgccagcttcttacatcagaacattggtggccaagctagaaattcagtgtagttgtcaactttagataacattgccttgcattcatctgtttttcaacaatgtcagagatttctggtttggtcccatagagatcattaaatttgtgaacattctttctttacttctcaataaagacatttacaaactcacagtggaaaaagtgcaactcagatttacaaatggcagtagctctcttaccttttacattatttcagatttcaacatcatgtagcggataaccttccctgaaattctgcctcatctgttctaatatttaacatggctaaagataaggttagaacatctttttaaaaattattattattgttgttattattattattgagacaaatcttattcttgtcaccccggctggagtgcaatggcatgatctcggctcactgcaacctccatctcccgggtttcaagtgattctcctgtctcagcctcccaagtagccaggaatacaggtacacgccaccacacctagctaatttttgtatttttagtggagacgaggtttcaccacattggccaggctggtcttgaactcctgatctcaggcgatctgcccacctcagccttccaaagtgctgggattataggcgtgagccactgtgcccagccagaacatctttaaatttccaagcatacatatacatgtagagaaaatcctctattgatgtcagggtagcttggcccctaaaccacacatattcattcttaggtcatttcatactttttactagtgtaaattttgaaagcagggcaatatcttacttgcatgtaaagtgacagaaatgcaaaccatatatattgcttgaaaggagcaggctgtcttttctataggttataacccactgtcatgtgaacatgaagtccgtggaggaagccacactccagtatgcaaacctctgtcttgcttttcttctcaaaaagtttctcaaagtccctttggtcctcacaacatgaaacttagtaggatgattctgtatccatttaatcttaaattcggtgagggagaatgatggtgactcatttggcaattcatattatttttatcaacagaaaatgataaaacaattccatataatcatatggaaatgaacattattcagactaacttgggccaaaatattttctaggctggctaaaaatgtaagcactcagagggagtaagggtttagcaacaatacaatgagaatttccagaataaatcatttccatttataccacagaagctttagtcttttaaaactcaacatattatagtataatgcttaaaaattattcaacgacttgacgaaacaagccttagagtgttaattcctccaacaagaaaaacaaggattctactcatatcatcattttctttttaaaataaatgaatgcaggaactagaaagggagagaaggagcagatgggaatgagaactgatagcctctcttggtgaacaagctccagagaaggtcaagtccttttcctgtcaggcagcttttgtgagtaggggagatttcacaaacctgtccttggcataagactcatgtgagtgaccaggtgaacagctgtaacttgatagaaagattaatcctctggctgttattatagaagagcagtagagggagtgtctgtaaaggtcagtgtgaagcttcctaaaataatttttcctaaaggcaaagagtttacctttaagagcaagatctgaacttactttgctctctagtctcttctgtcctacacagaggaacccaagttcggattcgagcctgataggatctgacctctaatttttcttttaggatattaaattatgctagaacatcattgatcataattatggcagatgtagttccagaattgtgtaagtcagagccactggctctaagagaccaaaattctttgtaaaaccttaacaccttgcctctggtttggcatgaccccaggaagccccccgaccgcccacattacatgcatccagtacacgcatccagtacatacatagtcagtgtatgtggttccctttggtatctatgaaatgaaggtagtacctaccacatgggttgttaggaggaacaaatgaggccgggcacgctggctcatgccagtaatcccagcattttgggaggccgaggctggtggatcacctgagatcaggatttcaagaccagcctggccaacatggcgaaaccccatctctactaaaaatacaaaaaattagccaggcgtggtagcgggcatctgtaatcccagctacttgggaggctgaggcaggagaattgcttgcacccgggaggcagaggttgcagtgagctgagatcgtgccactgcactccagcctgggcaacaagagcaaaacccctgtctcaaaaaaaaaaaaaaaaaaaaaagaggaacaaatgatataatttatgtaaggttcttagcagagtgcttgactcatcattagctctcagtaaattgtattattgctgtcaccgtgtttcctgcacaggggttaaggtagataagagaggagtgacaccaaattttcaaaattggttagaaatttgatttgcaagtgaccagataaggtctcccttccacccttccccaccaacaattcactgctccttgctccgctaacctaatctctctctaccccaaactctcacccttcccagtgttcccagtttcgtgtacatccttccagagatattttatgcacaaacaagtggaaacatgtctgcgtgtgtttgttttaggaacaattattcttaagcagctctgtacttgaaagagtgaagaacctcctttcaagctgataatcgaaatggggaaataaagtaaaagtttcttccctccgtagttccaaatggcaagtttttcacccggtggaatcatgtggttacatccttcccaagttaacagaatatgaaggatattagcatcgtttcagtagggtagacagtgaaacctgaaagaatggttcagtggagtcacctgggatttattactgcttctgataggccattctatctcactgtagagacacgatcgtttaactatgtgggccaaatatatgcgtgcccagaatcaacagctagttctcttttgcatattttatatgatttatccactgactggctccaaattaaattcaaaaggaattagaagccttagctgaggagccactgataagataccctactctggctaggcagatacagcaaagattttcagaaatagtacaactgcttccacttcccttttaaatgttacctcacacacgtgaatctaatgtagggatttagctcttacatgttctcttgtttagggcaaaacgatcggctcaaaaggaaatacttctcattatcgtgttgcctaattcatgcagtgagatccaacacagaggaactcagcttctgttttgagcctgatgggatctgacctctaatttttgttttgggatattagattatgttagaatgccattgattcataattattgcagatgtagtcccagaattgtgtaactcagagccatgggctctaagagacgaaaattcattgtaaaacagaacaccagccgggcacagtggctcatgcctataatcccagcactttgggaggccaaggcgggcggatcacttgagggcaggagttcgagaccagcctggtcaacatggtgaaaccccatctctactaaaaatacaaaaattagccaggcgggtggtgggtgctttgtaatcccagctgctcggaaggctgaggcatgagaatcacttgaacccggtgggcagagattgcagtgagccaggatcatgccactacactccaccctgggcgagggagtgagacttagtctcaaaaacaaaaaacaaaacaaaacaaaaaaacacataacatcttgcccctgacttggcgtgaccctgtgaggacacccccagtacatggatctcgagggaagaagcagattcacctgctgtctgccagccactgactgattcttgggtggtctggcaggtacatgtggttcagcagccttggctagacagcagagtttgccatttttcaaaatcttcactttggaagaagaaataaaggtgccagtctgcttgaaagccctgtctttgaaaactcactttttaacccatggtttcttgccaaaccaatatttgggatatggtgttatgcagtgttttgttctgctgtggatgttgctggtttacttaacagtagaaacagctctgtgaattaggtcttgacaagtaaaaaccttttccatcggcctttactggtgttgggtatgtatgtgctatttttttttcttctgagacagggtctcgccctgtcgcccgggctgaagtgcagtggccttaacctcctgggctcaagcaattcccatcccatcccatcctatcccatccccaccccgcccagcctcagctttctgagtagctgggactacaggcacacaccaccatacctggctaatttttgtactttttgtagagacagggttttgccatgttgcccaggctggtatccaactcctaggctcaagcagtcttcccaccttggcctcccaaagtgctgggattgcaggctatgtgtgctttgaaagtgacaaatgtaaatatctctagatgttttacctgacattatctcctgtaagactagaatgtgaccacattttcagctcagaagacaccaacaggacattgaggcaaattcacacgctgaaaaagcagccatacactgttgaaatcagaatgtggcacacttccaactggagaaggaggatctgtgagttcccatattagtattaaatgcaaaaatctttgttcatgcaacattaaggttacaaatgttcacaggccaaaatcgggaaatagcagaaaataagattctcatggtgacatctgttctccgctctagtacacgttccgtaaaacagtgtatggttgaagaccgattagttctgcaaagcctttagtatgtagtgtgattaagaacctgaacctcagcatgtggggaggcagggggatgaggtgaagagggagctgagctgagactgacttccccccagtcagagtttcactggaggaccttaggcaagcaattagcttatccacatctcaagttctctatgaactagaaggaatactatgccttcttccagttctccctaattcaccaaagatgaggcaaagattctgctgagggaaggtctccaaagaccttttgaggttgaacttttaacatcaaagttagaggtaacagctttctgttatggggtaggaaagtgtgatggttaatactgagtgtcaacttgattggattgaaggatgcaaagtattgatcctgggtgtgcctgtgtgtctgttgccaaggagattaatatttgagtcagtgggctggggaaggcagacccacccttaatctggtgggtacaatctaatcagctgccagcaaatataaagcaggcagaaaaacatgaaaaggtaagaccagcctagcctcccagccgacatctttctcccatgctggatgcttcctgcccttgaacatcagactccaggttcttcagtttcgagactcagactggctctccttggtcctcaagcttgcagacagcctattgtggaccttatgatagtgtaagttaaaacttaataaactcctctttttatatatatataagatatatattatatataagtatatataagatatatatcatatatatattatatatatataagagatatatatatatatatctcttagttctgtcactctagggaaccctaatacagaaagggtgcagtgtgcacaggctgggacttctcagccttgtctatgtggaagttattgacattaaattacatatgtcatgcatccatgcatgttttctcttgcctatagctagtggaattttaagcaaatccacaaatatttattgtctattatatttaagatctatgtaatgagagagggtaggaagagacactttccaaggtggccaagtcataatgcatgagaaaaatcaacacacaaacaacctacagtaacagggcacgtaactagaatgtattgcatttccacgcaagagtaaagtagtcctgccatattttgcagtttattatttgatctttctctagttttatttgtagccaaaattttacattgattttttaatttaatttatttgaattccttttcaatttgaaaattgaaatggaaggaagacatcttttttaaatacaggtacttcttttgctcaactactttggagttgaattattgaatattatctgttgcttaaaaatatcccaagccaggcgcagtggctcagacctgtaatcccagcactttgggaggccaagacggacagattgctcgagcccaggaattcgaggcggcagttagctgtgaccatgccactgcactctagcctgggtgacaaagtgagaccctgtctcttaaaaaaaaaaattatatatctattcctaggcttttggatatatatatttctggtttgtgagccaaaagtccatttctcaatcctgaaatgacaaacagaagtagcttagatttttcatttatttatattgacagtagtaatgccatttcttttttttctttttttttttcttatgacaactgaaaacaataggatgccctgactttcatatacaaattcagtagttcaaactctttgtcaataggagtaggagtaaatttgcatcagaccttctacactcttaactccattccattctattcttcaacaggaacgttgtgttcacagcagctaatgaggttgtattttgatctgaggccatgaaatgcagcagcacttgccacctaggaaagagaaacatttaacacatggtattggcctccttagcaccaggtccaaaacgaggtcaccatctcatagaaatcttgaggccagaagctcagcctcaaggctatcagcctttatctactttgtcatagaaagcagaggtttttgcaaagaggaatgacacatcccatggacacagctagaattgtgtgcagtataagggaagctgtagagtacatacgcttcctagttgggcatcctgggtttaatcctggctgtccctcttaccagctatgtaagaacaagctgatttcataatcaattctgtgccttgatttgtctcatctataaaatgaggataataatgaggccaaccttaatcttttgttaagagagttaaatgaaattatataagtaaaacctgtagccttagcacggtgcccagagtaaaatcagtgctaaataaatcttagctattcgtatgtataattcctctttcagctatacctaaatccaaagttttcttaaccattaaagaaagtatatgtgtattcaaattattgagaatgatataatagagatggcctattttatttatataaaaaataaaatatttgccaactatgctacttattattactggtaactaattatcagtgctgccaatcattatgacatacgttcacaggaaaatactaataatccctttcctcctctcctagctaacaaagtggtatggtctaaatgtttatgtccccccatttcaattcatacattaaaatcctcacccctaaagtgatgctatgtagaagatggagcctttgggaagtgcttaggtcttgggagtggagccctcatgactaggattagtgcccctataaaagaggcccttataaaagaccccttgcctcttctgccatgtgagggtggagtgagaaagatggctgtctgtgaggaagcagggcctccccagacactgaatctgccagtgccttgatcttggacttctcagcctccagaactgtgagaaaaacatttctgtggtttataagccatccagtgttttgttatagcagcctgaatgaactaagacacacagtatttcccagtcctgtgtctgtgattccctgcctgaggaaaaataattacataaaccaacaaacagaaactcccatcatataaaaacatataactgcctaatcaaataggtaggatttctggatgaaggagaaaaaatatttgtgaccactgttgccttaaaatgttaaatctgccatcaactaacaaaaatgttataatgtgctaaaacccaaggtcaggagaaaggcaaagtagaatagttatatttcctgttaatacagaattcaataggttaggagcagagaaagaggaagactgaaaatttgaaactggatgtagtcacacaagaatattgcagtgtctgggagctgataagggctttaaggaaatttagaaatctttaaaggaatgattgatatgatcaagacttgtccataagaaaagaagactagaataattgaggataccagtggattccaatcttagtgaagagaactgcagaatccctagaggcttacttgaataatatctggaaatgactgtgacttgaattttaaaaagaaatatattcagtattctaaaaactctataggtgtgatgcatagcacattgcaacatttcaggagtaaattaacattaaaattttagtattttagaaagtctggatttactttctaaactcagagtatttctagaatattagagtattttagaatcattaaatttttaattatagtgatctgttcttttcatttagtttattcctttcctcacttattcagtaagtattaatatatattgaaaacctagttcaatgacaaacaagagaaaagaggaaattcttatatctgcccaaacaatgataatgtttttcctcaaggtgttctcatatgtgcccatattttatagtaaattatagaagataacttttgaatttaaagatttgctgtcacctaatacagtctttaggtaactctgcacttgaatgcctgttatttttcttcactgggaaaagttgaaagaacagactataagggtctcattctggagcaagtgaaagctgacctgaaataagttttatgattaaaatttacataattggtgctcagatttttcatatgcagcagctcaccagatgtaaagatgtaaagaagaggccaaagaggagttgggtaacagaaaagaggcagagcctccaaattccaccattctctctccaggcaggccctgggggaagcatttaggttgcctcaataaagctctctttagatttatgtgatcatggatgcttcttctttatggttggtgaatttacagtggaacaaatcgagattgtaacagacagaagatctgtctctggtgaaataaattagaaccattagattttcctttttggtcttctagtataatgtaataaatggttgagagtatgggctttgtagtcagacagattcgggtttgggaaaggctatcacttaccagctaggtgacgttgagttcagccaccctgagcctgatactgtttttgcttttgttttgttgtgttgtaaaataagaatgataataatagtgtctaatacatagtgctgctataaggttaaatattaaatatgtgtgtaaaatgcatcatatagtgactaatgcagtggtcagtcctccataaatataagctattgttttaattatgtactgtctccttaatatacttttaacaaactctgatattgttttgcataatggagataaactgccaaaattggatgaaactatttatgcactttaagtctttatctgttggaatcatgttcagcttaaccacagagacttaaccaattatggatctgtttttcccccataataaagaattcagaaataggcaatgtaaggctagtatagctgtttgaggaaaatatcgaggacccaccatttaattttctgctcctccacccttatcaatggctttcatcttcgtgattgaaagaaagctgtggtaccttcagacagccaagaaggaggaggcagagtgaagggcaaaagtctttataggaactaccacctatatctcattgtctagaactatgtttcatgaccagcctctaatagcagtggaagctagtaaggaacgtatgtttttaactgggcacattgccacctggaaacaaaacaaaaacccacatagttctgttagacattgagtaaataaacatcagtttctgccacaaagccaaacaaacaaaaaagacatgattttcaggcctgattacttttctaacaaagacttataaatggcctcaacattgggacattctgagggcccattgctaagaccttaaatcttaccatcatcattaagaagagaagtggtcactggtctgtgtaatgggcaagataataaccaggtcctttagacatgattcctgaatcaatattgtcagtttgcttccatgttgtaatataaaattaggttgctgttcagtacaacagtcctgatcttggtgatgtgattatatcatttattcaataaggttttatagaggatcccactaatcttggaagtacaagtacagggaaaacatagaagcaacatccaacttttcatacatggattttgtaaaggattaagttatatagttttcttaaaatgattattgttataatggcagccatcaattggcctggattctggcagtgactatctacatttggaggcttagagaaggtccctatggtgctcaagttctatgtgatcagcctcactggaattaggggcacctagtactagccatttctgttacccaaggaatcaaggtccagttttctactattgatttaatatgacctgcataaagaaccagatatagaaacacagttctttacgatacaaatcaatcagtaagtattttttaagctgttacctagcactaagcaaaaaaaaatggttatccagttttcctgggatgatttttcagaagcagctgtttactaagcagttagcattgatttcatatggcttagaggagcaggcagactgtgggtctgtctctgctctcccagagtcactaggcaggttacctggggtcattactcagtttctctaggcctcagttttcttatatgtaaaacagcaactttgaaaaaaatgattgttaagattcctccttgatcttgggtttggggcaggatggagatttaattactgtggaaacggttacttgaccctgtgcaagatgtggggtgccctggggtctgagaagtcctggagtgtcaggcttcatttttgccctcctgaaaatgaaggagttggattggaagtatcagagtcctctacttgatctaatgctctgtcaaacagagtttgatagaactgtcacctgaattctatcagatgggtttaattaataaaaatttttggagacatgcttgacaggtttcatattcccagggcctgtgcatggaccccctgaaagtagtaatgcaaaattctactttactaagtttgttaagcattggaggttgaaatgagcccaaagaagatcaaggctgttaactcttacatctaaaaagaatctccacccagtgtttctaactgagcacagattgacaaaaactatttcttttttttttttttttttttcctgagacggagtctcactctgtcacccgggctggagtgcaatggcgtggtctcagctcactgcaatctctacctccgggttcaagcgattctcctgcctcagcctcctgagtagctgggactacaggcgcgcgccaccacgctcagctaatttgtgtatttttagtagagacggggtgtcactatgttggccaggctgttctcgaactcctgaccttgtgatccacacgcctcggcctcccaaagtgccgggattacaggcctgagccactgcgcccggccgacaaaaactatttctcaattcttctatcttagcagttcattgaggtaacaccttggccagcagaaatctttgggtgagtgtaatggtccttaaaggggaagttggttctgccaagacctgcagagaggtggtcatagggagcctagtaagtctgttaggactggcatgagcaacacttctggcatcttgtgcagggtcaccagtagtaaatgaaatgatgggacaggtcaccagtgccagccatctgcattgtggctgctgttccagtacagctgtgacactgcaaggtagatcctctgagctggaaattctaaaacggtagatgttggcaagtaaccctaaattgaaatgactctgaaaaaattaaaaagggatacagacgagctgcaagcactggaacaaagatattaacccccaaagagtcataaccacagctgactcttagcttcacaagcagccctcagaaggtggtagcttgttttaagcagaggccatgcagaacccatgaaaccaaaggacagagccagtagggctggagtctgaccagaaagttccatgccctctgctttctgcatggaaaatgacctggtaggttttaacctatccaagactacagaggatttcagaatttcagtttgaggtatgcctcaaaacattccagccttgatcatgaaagaaagaagtgatcaaaataccatatgtcacaatggaaaacccaagcggccccagagcctcttcttcagtaatgagatttagttgatctgaacagttatttatgcattgaggtcatattttggccaatcttttgcttacagctgtcgccaaataaagccttctgtcttagcatttcttttaccaaaatcaggttgagagatggttctttgagaggactgttttgtcagggaatacagggatcttttcacacagtaaaatgtgcccacaaagccaaacaatacaccaaatatagggtcaaattatgttaaaattgaaaggaaacaaactaaagtctttttctttgtccctgttgttttttgaggttttgcttatctgtttgtttgtttaattttaccaaaaatgctccccaaatggcaatgaaaggttcaagggaactttcttcagtaataccatgtttacctcagagaggattggctgttaggacttccctagttgatcttcctcttgttccttctttattgtaagttttgacatattacactttctaacatctctgtgcctggaaatattctaggcttatacttttaataacagaaatggagaaaagtgctagtgtctggattgttgctaaatctgcacatgtgtaaccaagagtattaaactcagagccaaagaacaggaagagaagaaaaatccctcctttgtttgtttgtagactttggcattgatttcatgtggcttggaagagcttgaatgacaccgtgggtctgtctctgctctcccagagtcactagccaggttacctggggtaattacttaggttctcttggcctcagttcccttatatataaaacagaaaacattgaacaagatgatcgttcaggttcctccttgaactaagatttggggcaggatagagacttagttactgtggaaactgttgcccaaccttgggcaacagttgtgggttactctggggcaggagaggtcctggaatataatgcttcatttttatcctcctgaaaatgaacaaattggatctgaagataactgagtgctctacttgataataatgtattgtcaagcagattttgatagaactccttcctaaattctaccgaatgggtttaattaaggaaagtttttggaggcatgctggatgggtttcatcttcccaggacctacgcatgaaatgagacatgtccccttgaataactaggttataagaagcatagtttgctctattgtattttggccaactagtcctcatcattatggatgataggcctcagttcaccattaacaggaggagctgaaagccttgttttgggattgctaagatgagatcgttctccttacactgtgttcctacttttctagccatactgtaaggacaaaagtgcttaatcctacacacctatttgcttcatttaaaacaaaaacctatataaggaagaggaaaagcccaaatgacattcaaggcaaacatcataggtggaaaagtagagaaaaaacatctgatcacataataccgagtagccaggaatttctggaagcaatttatggttatcccagggatcagaatataagagtgtgaaatgaaataaaatgctttataagagacaaaatcctatgagactctgtacaaaaaaagaggttaccattagacaagtatttcaaaaagaaatgaagagaatcttaagtatacattcaagctatgtaaaataatgaaacaaatgctaagggatgtgggaatcaagatgaagaagagcaaaaatttaaaaacagtacccatattccaagctgttttgtgactttggaactaacttaaaagcagttattgatatgtgcacttttcttttacaaatattatgcttcataaaaagtttttttaaaggaaattcctgagtaatctaaaagaagttttaaggtttttctttcccaacagaagaagataattaagatggaaatgtgttcagctgggtgtacacttgttgctgttgataatgaatatggagagttcttcacaggatgggggattttgggaattaaagcctgtcaaaaggtggaacctaatgttcaaagtcctaagaccaagaggaaccataggaggagccttcagttaagagtgttataagtaatagaaaacccaaccaacggtggctgaaacaaacagggacttatttccctcacaaaacaaaaagtccaaaagtgggtggttgctggcgttcactcagctactgagaaatgccacagaggactgtattactcagttcctgcagtgctatcaagaaatactgggtaatttacaatgaaagggttttaattggctcacagttccataggctgtacaggaagcatgatgctggcatctgcttggcttctggggaggcctcaggaaactttccatcatagtggaaagtgaaggggaagcaggcacatgttacatggccagagcagtaggaatagagaaggggaaggtgctgcacacttttaaacaaccagatctcgtgagaactcactatcatgagaacagcaccagagagaccatgctaaaccattcacgagaactccacccccatgatccaatcacctcccacaaggccccacctccaatactgggaattataatttgacatgagatttaagcagggacacagaaccaaaccacatcaaggacctatacttttcccatctttccctttctccatccttgggagttggcttttgtcttcatgccttatattcacaaaatggctgccagagtcccagccatttcttctgtgatcaaggctggaaaagagaaggggtcaataccagtatatccttcattttaacagaaaagcaaaagccttctcagaactttggcacatggctacccaagccgcttccatggctggagaaggcaggggataaggaaagttgagaatgactgttgggttaactgaaaatagcaactgccagagttcatcataaagagaatcatcttgtggcttgatgctattgggaagaggtaagaatttagagcctttaggagtatggctcaggactgcaaacatttccactaatagaatcatgaaagcagttagtgaattgagttaaaacagcaattcaaaaggcaggtagcctgatttttcattctgaattggccataggccttaatgaatgctactaaattattagtctttcctactataaaataagaataatgtctattcacctcacttggacccttttattcagtcattcatttattcaacaaatatatactaagcacctcttatgtagcagagattgtgctaatgctgaggatacacaaataaataatgcaaaacctttaccccagggaagggaggccaggggacgtgttgactgagtactgcttcacgttggactatgctgggtgctttatatgcagaatatatatatatatggcttatagaagatatgtaaacaagtgatataataggaaaagtggtacaacggaaatattcataaaagttccctgggacagagcaggggaaatgactaactctaccttgggaattgggcagggcttcaccaaggagataaaatctgagatagggcttcaaattgagtctgagtttattgtacagaagtagttgcggggagtagcttttggtggaggaacagttgattcaaaagcaatgacacttaaaagggaattgtttgttcctgaaaagtcaagcagtctactttgccaagcattcgggtggtgggaggtggccaaagccaggccatgaaggactcagaagccagaagtttggccttgaggagcctttgccatacagaacaagacatgatgagatttgtgcctcggaaagatcattctggaatctgtgaggtgaggaagggctgttggaaggggtctgatagcagagaacctgttttggaggcttttgccacaatgttggtgaaagatgatgacacaattaaggcagtgaggtctagaaagacctgcataagatcaccagcttctggtgactgattggatgtgttgaaagagagtcgggggaggaatcaaaaaagattccaaagtttctcacatggcacttgggtggcatcattcacaggagatgcaggagagtgtggcatttgctgagccccatttcagcttcatctcatctcagctcctggaaaaaagaacgggcctttgcttcaggtcttgtgttgccacagtaatactcctcccccgactgcctcttccgccaggccccacccagccgtgatttcgaggtcatgttctgggataagactccaaatggcctgtggttgccttgttcctgtgtgcaaaataaaaatggattgctgtagcaaatgcaaacatgaggtggggagagcagcgattcctagacgaggcttggagttgggcgtgggactgtggctgagcagtcatgggtgccccgtgacaactgcctgcctcactgcgactccggggattcttcccactcagctgcagcacagcctcggtagctttcatcattttctaagaccagtggacggaatcagacagttcatgatgcttcagcttctcgagtacatgattgatacttgaaggaattattaaggtgcttatctatttttaattgcatctacttatttgatatttgacccaattcattcattcttgttgtgaatgtattaacagaccctgtaccctcttgacctctccttataattattaccgttattgttctttgaagcactgttttgattatacacttaaaaggagctactgatatactgaaattcatgcacagctgaaatgcccactgcgtggactcaaggacagctgtttaagagtagttcttgtcctcagaagttcatctccctttttttttacttctcttcacccacatttctgccctcttcccctttagaggtttttagtcacacatttctactttaataagagcaacccttcttcctgaggccccaagtgctatgttttaacaaacacagatgaatcagttcatgtgctttatcagtgttgggattgctggcaggtgcctcacagcgaacattattgcaatttcaccatcatttcccctcctcccatttccagacatatattcatatttgtttcttcttccctatctggcaaatcattccagtgaaaattgatcccattgatttagccacatacaggtggaagcctgtatttgggaagcagttttagccaaattgtgtgaaataaagttttttcttctgatgttatctctgacccatgttgtgagcattttctttttttttttttctttttttttcttttttttttttttttttttttgagatggtgtctcgttctgttgcccgggctggagtgcagtggcacaatctcggctcactgcaacctccacctcccgggttcacgccattcttctgcctcagcctcctgagtagctgggatttcaggcgcccgccaccacgcccggctaaatttttgtatttttagtggagacagtgtttcaccgtgttagccaggatggtctcgatcttctgaccttgtgatccccctgcctcggcctcccgaagtgctgggattacaggcttgagccactgcacccagcgtgagcattttcatctgcgtggattaggagaagttcttaccaccattcaattatcaccacatggtgtccagttctataatgcagtactgagctttaaggagatttgcaattatttactgaggtaaaagacaagatattaacttagtgtgtcatttgtcttggtcttcaaagtgaggtgaaaagcctatcagtggcccattcaagtgtccttttagaagtgtctccttctctctttctggtgttctctgtcacctattttatgacattatcataggaggaatgtttgtataatctggtacagttccacaaaaagaaacatggattagaaaattaaaggtaatcctagggataagaatgagaaaataaaaactctttaagatgattagagaatgtattaaagtccatttatttcattcatggctatgaattatgggtagataacttgtggcactgttttcccaaatatgagacctttgggggaaattctggttcattcttgcattagggaattttctgtggcacagcgtgtggtagttatcactgattctacttagcacaaattcctcattaaggattttgcacaaactggaatgaagagcaaagctttcttcttaaagagaatgaaagcatatttcctttcaagggataggaccatttattttcacatcagaatctgagatttacaattcttttttgtttgtttgtttgtttgtttgtttgtttttgagacagcgtctcactctgccacccaggctggagtgcagtggcgtgatctcagctcactgcaacctccgcctcccagcttcaagcgattctcgtgcctcagcctctgaagtagctgggattacaggcacccgccaccatgcccagctactctttgtatttttagtagatacaaggtttcaccatgttggccaggctggtcttgaacttctgagctcaagtgatctactcgcctcagcctcccaaagtgctgggattacaggtgtaagtgaccaagcccagcctacaattctttatttactgccttgtggcaagagcctacatttctggaattttaacatgcaactcaggcaactcatttaacaagtatttattgagtatctgctgtatactgggcacagtgctatcaactgactagagggttagttggctggtctttagtgaagaaagagagaaaatactgaagaattgacaggggtcggaatccacttgccaccgcagctttcaagaacggccttcttagagacaggaaatgagcaggaaaaccagttacggagactcatttgcaattactagccacattcttcagagagaaggctctgctgaaatcctgaatgttgactaacagaaaatgtattcttgttgccttatttctcatgatgctttgttcttttgacccagaaacagaaaagatagtcctagaggcaggaaatggattaccatcctggaaattcaatgaccagctttttccctgtgacgtgtgtgggaaagtgtttggccgacagcagacattgtcccgacacctctcgctgcacacaggtgagtgagtagggcctgggctgtcagccctctatgctccatcaccaacttctttactctccggaaactgagtttctctaagagaggcattacaggaagtgctgggaatggctgaccttttcaagccattttctctggcatgtttaaagaagaccttggaaaggcttttttatttgtattgaaagggttcattgagttccaggtaggaccgatgagaaaatatacacaatttaggtttattcaggtaaaattcctaaactctgttaaaaaaaatgtattgagttcatcttgaaagtgaaggacagggggacacactccatcttactggttttatcttattgttgtgggtgggagcagccagggaaaaggcaccttggtggagaaacagcttctgcctttatttatgtataattgtggagaaatatggttggttctgagagttgggaaagggaaggcaaccaagttaacaaggaggaataaatagtaacttagtccacacagcaaaaataattgaagacaaaaagacataaggtaaaatcagtagtaaacataaagcaagatggaaataataaaatcaaacatttccatttttacactgaaatcaggtttttaaataatccagatatatcttatttacagggaacacaaaaacaaaatgataaagaaaagttcaaaataaagatttcgtacatcacacaaaatttaaaaagcaagacaggaagtattaataagacaagattaattttgtcttttttttcccccaagatagggtctcgctctgtcacccagactggagtgcagtggctgcatcccagctaactgcaacctctgcctcccgggttcaagtgatccttccatctcagctttctgagtagctgggactacaggtgcacgctgccactatgcccagctaacttttttaaaaaaaaaaggtttttgttgtcgggcgcgatggctcacgcctataatcccaacactttgggaggccaaggcaggtggatcacctgaggtcaggagtttgagaccagcctggccaaagtggtgaaaccccatctctactaaaaatacaaaaattagacggatgtggtggtgcacgcttgtaatcccagctactcaggaggctgaggcaggagaattgcttgaacccaggaggtggaagttgcagtgagccaagatcgtgccactgcactccagcctgagtgacaagagcgaaactcagtctcaaaaaaaaacaaaaagttttttgtagaaatggggtttctccatgctgcccaaactggtgtcttttctttttatatttttaatatttttaattttaaattcgactaaagacaaaatttaggaaaactttaacatgttcaaaaaagtggagttttataaggtcacattctctgagcatacttaaatgaaattttaaataagtaagggtcaataaaatgtcctgcctaattggaccaaagaaaaagggagaaaataaaaattcaaataacagacatctaaaaggaatgaaatagagaacacttcatacataaacctggagcaaacagcaagagctctagtcagaggaaaatttatagaggtaaacattttaattagagaaagacaaaaataaaggaacttaatggtcatcttaaggaattgataaaacaacaaagtctagaaagaaatggccataaaatagataaatcctgttaagcctgattaagaaaatgaagcaaaaatactcaaagttaggaatgaaaaaggaaacctaatcatcaatgtggaagatgttaaagaattattggagaataatgaagctctaagaaaaaaagctgaacacttagatgacatagatcatttaaacagaatgactaaaattgacccaaagtggggagggaacttgaatcagtcggttcccaaagagaaattttggaaaaattatgaaggacataccgtttataaaggcatcaggtccagaaattttcgctggtgagttctttctaaccttttgagaagaggaaattccaatgttattaaacctttccaaatgatagaaaaagatttaaaaagctccacagtttcactttatggaggatgcataaccttaataacaaaacttaacaacctcacttattcatacaaacacaaaacttctaaagaaaggacacattttatctggacagtggggctcctcccctgaccctgctgagcccagatgccagcccttcaagatgttggggaccacctataacaataatggtctcatattttgtagagaagaacttttttccatgttcttctctgtgaactaaagaagacaggtatttcctttaagccaggcacagtaataccaagtaagcattaaggatagaacactggagttgttctttccttcatcttctgctattacctttatctgtgtgatgaaagcaaagcctgctccttttactttaatttgcttgattaatcaaacgaattcagaatgccactctggaaacgatcctgaaacatttgtcagttttatgagagggtttccattaagaagttaattgaaattctttatttatgtaaaatgaaatttccaattaaattatttcacacagcattttttccccttaatttcattagtttttttatttcttggccgacccaggccaggagcttagggaaaatgatgaggcctcttttacgctgtagtcctgcaaatgctgtgttttattccccctcccctgctcagcactcacccatgactgacacatggggtacacacacacacacaaacagacatgcacacttgctcactcacagaatattcttttgccctgtgtggggcttaccttatcaggaaaatgggctgtgggtgtccaggaaaaaaaaagcaggttatctattctagttgccctgggacttttttttttttttcttttttttgaaacaaggtttatctccgtcacccaggctggagtgcagtgatgtgattgtggttcactgtaaccctgacctcctgggctcaagcaatcctcccacctcctcctcccaagtagctgggactacaggcacgtgccaccacacctgactaattttttaaaaatttttttgtagagatggagtctcgctgtgatgcccaggctggtctcgagctcctgtccttaagtgatctttctgtcttagcctcccaaactgctagaattacaggtgtgagccacagtgcccagccggagattttcttttatatttagaagtactaatacaggagtgacctgctgggtaaagacttttagatacttacaattcctaggcattaccattgtctccatctgaaatatgacttgaaccattctttccttgatacctttaactgattcttgcaaggtgttgggacttccttttttgaaagcgatttgggctttttcctgttccttctcccccagaggaaagaaaatacaaatgccacttgtgcccctatgctgctaagtgccgtgcaaatctgaaccagcacttgaccgtccattccgtgaagctggtgagtacagacaccgaggacattgtcagcgccgtcacctctgaaggcagtgatgggaagaaacatccttattattacaggtgagttgcagatggaacatgctagtccgcctttctcagactcttgacttcaacacttcctacctgtctgctgtgggcatacatcacgaggccccttttctcagtcatagcctggccttcatttgagtaatttctttgctcagattgagccctgcagttgcacagactcctctcttggtttgggtgcccctggtggtattaattgaaagagaaatggtcttagaggtggctctctggggtggagctccagacagagacgggctctggggatgatgaatttttaggtctgttcagctcagaagctccaacctttgtaactgagtgtgttgctgctccctaagaattgtttaaaaaaaaaaaagctgaggaaatataaatctgagaaccccagagaactagcccagaaggcgttacgtatttccccatggttgtatcacactttagtatgtggattttatgtttcatttctgtattcaatcatgaatcaatattggtttgattgccataaaacccccaagtttctggctgtcaaatcttgtcctagagagttgccatactgattggtggaaacttgcttttgcaggaaatgtctctagcagtgggtggcttctatcagaagttgtcccggatagagtagcctcttgcttggagtgccatacaacaaactgtaggtgctttcattgctactagggaaggtttccagagccagagagaggttcctggactatgaggtgctctccgagtttatcagtggaccggcaccactaaataccttggcaatgctaccccacatctctttgcccaaaggaaatcaattaggtgatgtgcagcatctggaatccatagttttaaattaactttatgattatttagcatcattataacacatatgtgattgttacatgatgctggcccttagtctctttggcacagtgactactttagaggcatcccagaaagcagaagaattttctaatgcaaaaccttttggtggagagacaaatgtgtttcaaattccagttttcttgagtgtactgtgtataaatggacagcctacatttagaagtatgtgtcacccttttctctccccctcttttcttttaccctttcatgtagttgtcacgtgtgtggatttgagaccgagctcaatgtccagtttgtcagccacatgtcactccacgtggacaaggagcagtggatgttttcgatctgctgcactgcctgcgacttcgtcaccatggaggaagcagagataaagactcacattggcaccaagcacacaggtgaccattcctgtctgtccttctcacactccttctccatcccctgcaccccagagcacctgccacctggccgaagcatccccactgccctgagacattgcccttttccttccatggaaggaaggactttcccaaggcatgaaagccacatttccctgtagtcataatactgtttcctggcatgccttgtgcctcactgctctgaaagactcccaagttcagatgtggttgagaggtgccgagctctttgcttgttgctcatcctgatcctcttcctcatcaccatatgtgacagtctttcaatgccccagtcttatgcctttgcacactggctctcatttaagccccatagcaaccctctaagtgaatactattattatcacactgtacagtacaggtgaagaaacaggcttaacagaggtgagatattccatccaaggtcagcaactaggggttgctgtggtcactagtttcagtcactagttcagtagtcactagtttcagtgactactgaaactcagcccagaacagttttcattccagagcttgctctctgtatcattgctgttctgacagccccgagaaacacttggcagagctttgaacctttctgttttcccatgccagggcactacacacctacttctgtaggctctgttcctctccagtgaaactgcagccctgacgctctccttaatgacgcatggcatgtgtgttcgcggccaaagaaaaccagattctcctgaaacaaacccatcactgtctaggccatggccaaggcttcaccagtgctcgcctgttatttaagcttcttgccattctggttaacttcttccatttattgatgttaacattctgacttcaccatgcaattatactctcacaagtgatggttacaaatgataccagcaaggagtcattaagtgagaatgaggaggagctccgtctgcatttgcggggcttacaaattaagagctgatgttgctgattgccagccctgggtgttgggtcagcccctcacatcatcagcacttgaaggattcgggaaggggaatttccctgacagttgtgctgacgatgtacacagcagaggaggatctctctgtgtttctctggccactttggctcagtggtgccaacagtaataaaagcttgtttttgtcagtaaattgagcagctatgacttggaggtctgcagagagccgttatgccaagtgagaaggtgccatttttacagtcagttgtctgactgtaaccacattagcctgtgggcagcaggtgagctgggaaacccatgttgaagacaaattaaattcagcatttctggagtggctaatggaggaaaaggccaaactcttttccattaccactggcttttcagatagtcttttttttctcctttctgttaacctttgttctaaccctctttactccaaagtatacctgaacccagttgaaaaccttcctccctcccatcctgctccaaagccccctccacacccataccaccatagaaaccatagaaaccatatggctaggcagaagctggacttgtcatcatttaattgtcgtgagtggaaacttcacaactaaccagtgcaaacacatacctcgtaattaccacagggaatgaagcaaagatcttgttctctctgatgtagcaggattcagggctcattgtctagcaggaaagaatattcttgtttgttagtacagtcacccaagagtgaaatgcattaaagaagtttcttttttaattcagtaggagcctttaatgctgctgctctaagaataaggttaaaacctattttataagccagggtcctgcaagcttttttcaaaggggcaaatagtaaatattttaggctttcaggtcatacagtttctgtcactactactcaactcggctgttgaaacttgaaagtagtcgtagacaatatgcaaatgagtgggcatggccatgttccaataaaactttatttataaaaacaggaggctcatttgagcccaaggactgtagtttgctgacccccattataagctaatggtctcacagcaagggtttcctgtatttagtatagttttgagatgtttcagtttgacccaaaatagatcaatctaaatctgtaaattagtaagttggactattgcaaagttagggtataaagcaatatatatgttatatgacatatatagcagtatatattcccaagaacagggagcttatctaagtcactgctgtatctcagcacctggagcaggccctacacagtacaagtggggaatcaatgtaccttcagtgaatgaatatatttgtgtgcaagctcatctgtgcacatttgtgcatgctaagtaagaaaactattcagatgtggcccttgcttgaaccttagagtcctagtgacttatttctgtaatctatgtggaagttacttggcatggaggaaagcacacactgaattctcgatccaggttctagaccctatggtaccataagtagtattgtgaatgtaggacctcagttaacttctctggacctccatctgttccctatattttcagatgcgcagaagatgcccttaggcctaagattctctaattttatgagccttgttctctaatttgattttcctgtcttaggaaaaggcccctattatttcagtaccttaggaaatctgccacgctatcttgttacctaagtgaagttgtgatctacaggataagctctaatcaacagcacgcattttgtttagtctcctacagaacccatgctttctcacattttcttatgggttggtgttactccaggcatgcctgtgagtggttatgttaaagggatacctgaggaactgtcctctcattaggcatttccgcttagtgatccctcctcaccttctttctcccactgtctggcgtcttgtccctgcagagaatatcaacaaggggaaaatatcccctttggtgcttgtgacttcttcagtgcaaattttgctgcaatttctaaatgttgcaataaatggcattgaggaatctgaatggctatttggaaaatacaactatcaatacctcacctcacattgacaccaaaataaattccagataacttacagaatccctattaacaaatcagccctagaaaagcctgaagaaaatagaatatttatcaagcttccagagctagaaggatttgtaaaagcttaagtgataaaataaagcacaaatgaaaacaatcgagagatctgacacataaaaatttcttcagtttgcaaaataacagaaaaagagaagcaaaaccaaaacctgggtctgaaaaaatgtgtttacaaaaatgacaaaaggttaatatatttactacatagagtattcctataaactgttaagaaaacctttaggcctctaattgaagaattagcaaaggatatgaggacatgagcagtcaattcacaatgaaggaaataaaagctaaccacttaccataaggaaacacatacagctaaaactcgaggcttatattccacctgttaagttaggagaacatttgatattaatactcactgttgctgggatgatgctggtactcacattgctgttgccctgcggagttgtaaaactccttggaaactaattaagctgtatataccaagaggcttaaaatgtaatgccctgtgacccagtaatcccatctctgggaatttattcatgggaaaatattcaattagtgaaatattaattttacctttaaatttaattttaaggtactatttaagtagaataatcccctccatggatataatacaatcatttaaaacaatgcaaatattttcaagaattttttgagagccaactctgtacaaatatctaaaatagcatgggaaaatacaaagtattagttatcattattattatattttattatgtatgttttataatagaataataatattttctataatgcttaccatgatccagacattgttcttaatgatttacatataaaaacctatttaagtatcacaaccaccatatgaggcaagtgctgatatcatccccattttatagatgagataattgaggcacaaagttaagtgtcttgttcaaaataatacagctactaagtggtagaagtgagattcaaactcacatgttctgatctattttatttatttatttatttatttatttatttatttatttatttatttattttaagacagggtctcactctgttgccgaggctggagtgaagtggcgtgatcttggctcactgcaacctccacctctcaagttcaagcaattttcgtgtctcagccccctgagtagctgggatcataggcatggggcaccacgcccagcttattttttggtatttttagtagagatggggttttgccatttggccaggctggtctcaaactcctggcctcaggcaattcacccacctcagcctcccaaagtgctgggattacaggcgtgagccacggcacccagcctggatctagagtctttattcttaatcttaatggaaacaatttaaaagtagaagtgcttactttgttaagaatgaaaagtactctaaaatgtaacagtgtctgtattgaggaagcaagatgattggtaattttttttatggtttcaatttcctaatttgtgctgtttaaaattgtgcaatatttaggggttttgttttgttttttaagttctcttcagctggttgtcctaatgtgtgaagttgcatcacctgtgcacaggtgtccttcaccaagatctttgtgatgctgaagaaggtaaatgaccacttgggtcacagttagccttggacttggctggcaagggcaccctggctctttccacagacatagcaaaacaagatgaggacagaaacaggagaggctgtttggactagggattacacattgagcaagctgggctgcatcacagagtggctggcacagcacattgtatctttatacatttattaatttaggtatttctgcctggtgccttaagcctaagggtacttgaatctatgtttagagatggtagttgaaattaatatgttttaattctaaaaatgaatttaaaagaatcacttgcaacaggtgaatattagaagatggagttgcagtatcagggattcagggtctccgctaaaaatgttctacctagaaaatgtaactaagctggttaaatatatactgataagcaaatggcaataatggtactagttgtcacatagctttcttgtaccaagagagaagtctgtagtctaaagtcatataccattgctcctcatggtcagtgactgaggtcacatacttgcagttctaataggagcaagatttttaaaattgtgaactgaagtaagagttgtctgccctggaccctaagtgcagttctgacaggaaaaggatttgaaaacattgtaagtgggtacatatttcttcctttctctttttaaaaacttttaaaaatatggtcactctagaaaattttgaaaatggaataaaagtaaacaaacatgacaccaataattttacactctagatgtaacccaccattacagctctatttccaaactttgtatacctaatatatatatatatatatatatatatttttttttttttttttttttttttttttttttgagacggagtcttgctctgtcacccaggctggagtacaatggtgccatctccactcaccacaaactccgcctccatgggttcaagcgattctcctgcctcaccctcccaagtagctgggattacaggcatatgccaccacacctggctaatttaatctcctaataaaggaagttaggttctaacatttacagtcactagattgcttaatgaactgatttgaagataattggagaacagtctccctatattttctcccctaacctaaaacgatggggtcatgttgaatctgtaaatcattctgtggataattgacatcttaacattcttaagtctcttgaaccaggaataaagtctagctctccagttacttggggtttataatgtacatctttaggccaggtacggtggctcatgcttgtaatcccagtactttgggaggccaaagtgggcagatcacttgaggtcaggagttcaagaccagcctggccaacatggtgaaaccctgtctcttctgaaaatacaaaaattagccaggcatgatggcacacacctgtaatcccagctacttgggaggctgaggcaggaaaattgcttgaacccgggaggtggaggttgcagtgagctgggatcacgttactgtactccagcttgggcaacagagtgagaccctgtctccaaaaaaagagtacatctttagtttatcacagtaaaacttcaaatgattgattaaaccacttcatatgttgtataagaacctcacgcaagtagacttccatttctctcctcctagcgtttatactattgtcatatgtttacttatatgttttataaaccctacaaaacagttatttttgtttaaacaatgttacttttatcttttaaagacatttcaataatttaaaaattatgaatttatccatgtatttattatttccagcctcttcattcttttgtgtagatcagttttatatctggtttcattttcttctgcctgggctttgaacatttcttgtaattcaggtctgctggtgatgaattccttcatttgttttaatgtgagcttttgtttgttgccttcatttttgaaatatattttcactgggtataagattttaggttgacagtgtatctttcagtactttaaagatgttgctttacagtcttcttacttgcatagtgtccagtgagaaatccactgtcatccttgtttttgttcctgtgcacataacatatctttcttcctctggctactttcaggattttgttctttagcactgattttgagcaatttatgattttttttgtataggtttcttcgtgtttcttatgcttgaggttcattgagcttcttggatctatgggtttatgattttcctcaaatttggaaaatttttggccatttcaaatttccaccctccccaccccaccagggattccaattaaacttattttaagcttcccaaaggcatcccacagttcactgatgctcttttcatttggggagattcctttctgtttcatttcagatagtttctatagctattatcttcaggtttactcatcttttcctctgccatgtctaatgggattactgctggtaatagacactgcagttttcatcagtagaaattttatttagatctttttaatatcatccatgtctctacttaacttcttgaacatatgaaatacagtcaccactgttttaatgtccttgtctgcgaagtctaacaactgtgtctgttctgggtcacctttgattggttgattattctcaattcgaattgtgtttatctttttgcacatctgatcacctttggatgcagacattgtggtttttaccatgttgggtgcttaatattttatattcctatacatactcttgacctttgttttaggatgcagatagctacctggaaacctcgttcctttggggtcttgctttcatgattctttggcgggtctagatcactaggcagtgatttatctaggtttaacccactactaagagacctttcttagttttctacctaatgccctgtaaattgtgtttttccaatctgactggtggaaacaggcattatttctagccctctctaagtgccgggcactgttctctaagcttttcaggtggcttttccccctccaactatgggtagtctcttcacccccgtgctctgatccatactttgctgaatactcaagggggaccctctctgtgtctctggggttgttcttctgtgctgccccttcctctctgatactccgtcctgcaaaatctggtcagaccctcagctctgtatccgccactcggagtctgtcaggttccacctggttccttctctctgcaatgaagcctggagagtctcaaggcaggaaactgatcagtcatatggctcacctcttttgtttcctgtctctcaggggccacttttcttcattgcctaacatccagtgatatgaaaactagcatttggtatattttgtctgatttttttcagttgttagtagtaatggtaaacccagtccctgacgcgctctcttgagtagaagcagaagtcttctgacactagattttaatggtctgctgacttgtttgtatctggctttgagggagagggtcccgagtactgatgaagagcatggaccctggagtcagacgaactcaaacctcttctccaccacttcccagccatatgatctaggccagattaacctttctgtgactccattccctcatcgtaaaatggggctgataacagttgtgccacacaggatttttgaaaaaacaaaatgagataatttaaagtataatacagttcctggaacgtggtaacatgtttagtatgtcttagctattactgtcgttttattttaattcatgtaagaccttaataaacacttgtcaaattaatgaatgcctgctcttggcccccagtaccacaaaggaggtaggtgccttaggacctgggatcccccagcagtgggggagctggggacatgagcctgtgcccccagaatgatgatgcatccatgagactcaactcgtcaccctcagttgctataattctgaggattttcatctcattaacagactgggttatttgcttatttttcaggggaagacaggaagacccccagcgaatcaaatagcccctcttcatcctccctctcagctctgagtgattcagccaacagcaaagatgattcagatggctcccagaaaaacaagggcgggaacaatctgctggtcatctctgtcatgcctgggagccagccctcactgaacagtgaggaaaagccagagaaaggtaaggaggaggtgggtgtgagcctgctcaaccctccgcacccaggatgacccattcttgagaataagccctgcacaggagcgatgtcaaaaactgataataggcccaggatgcagtatgctgggcctcacctaaaggttgtatttcttttggcttaatttgaatccgagtatggggtggaaggatggggagggtgacattgattccgatgtttgtacatttaactccttttagcacagagatatggggaacagtgcctggaagggtatagctgtcaggcgtcggaggaggcgggaggaagtggggaggagcttggctccactcctgccctcctctccccgctgccctgtgcacctctatacccagcttcggtccttgcagggttcgaatgtgttttttgcaactttgtctgcaagacgaagaacatgtttgagcgtcatctgcagatacacctcatcacccggatgtttgagtgtgatgtgtgccacaagttcatgaagacccccgaacagctgctggagcataagaaatgccacactgtccccaccggtgggctcaagtaaggaaagcaagtacagaaccttttactgcgttgttattaaataccctttccccttccctaccccgtcccttcccgtgaaggttttgggagtcatggagaaggggagcttggtatgagaggagttagtcaggaacccctgctgcctttagctggattgaattagacctgtccccctagggtgtcaacagatgtcagtaggagaatccattttgcaaataccccgggattcagggcaagaaaaaagacacgttgaaacaacccagcatgcaagaatagactacactgcttgagttttgttcagacttgattttaatggactcagggcttagtgtccccaagcataaatcatactgtgaccgagattcaccttctctgtttttccgatggcttgctacatatcctttaagtaagcattgcaaccaccccaccctccaaaattggacagtttgaacaggcaggaagcaacatttttcatgcaacgatcatgtgcttcatgatcctcctgcaaacatactgatgtcttcttcccaagatctagacaacgagcatcatctttaaccagtattttcaagaggccctttggtctcaagtgagaccaatcaactaatatcaaacgtactgtgtgtctggcttgataacaggtgccaacaggcacacaggaataaaacaccatttccaccctcaagaaatgtatgtcctagtactacctcatctgcacagtgaaatcagagtccctgttcacaaggcacttagggtctggtaaagagaaagcagcacaggtaggaggacacagaaagacacagttttcaaggcataattactaattctcagctaaacgatcatgttgaatgaaaaattacattttacttaacacaagggggaaaaaaccttttgttttaaaacatgttcgtcattgaaacgcacaacctgccagagaggtggcatgactcccctagatgggtgaggaagggagagatggaaaagaccctgggagtggagtgttggggtcagtgcaggttgggtccccccaggcccctgcctcctcaaaaactcccccacatagaagagtcagggaacaacaggacctccgttgaactccatttcgtttcactcttgggggagggggaggggagggcagaagggattggggagggggtgattataattcaaggaaaccagtagatgggaaatgcctaggaagagcttatttggggatttgatttggtttgttcccactgtccctttataaatatttgtgtgctctcattttaaaaagagaaacaccagaaccatgtttttctgtggttggaccagtgctcactgcccttcccagtagcccagtcacacccatgaacattgcagcccctgccagttgtggctttgccagttcgcctttcctcagggacctccaaagtccccagcctctgaagccattggggagaatgcacagtgaattctgatgcttttgctggtacagacacttcccgtgcggtgctaaccgtcccctgtgtaatagtttatgttctaggatgaccaagtagaagaatactttgaaaaaattgataatgccttctggctatacagtgagtctttgttttgttttgttttgtttcctttgccatatcagagaattaatttgcctgagagagtgtctttaagaaaataacgggagcacggaaaacccttagcactttgcctgagcagtgaaagaaagattgagctgtgggtcacagaaatgtccttaaaatgaaacagactgctgatgtctaaattgcttttctgtgatggaactgcttgtactctatatcctgttcataatgcagatcaaataagattatactattatttttcttttgccgtagctcaggacagtggtgagtttcagactcctctaggtaaggcccagcttggcgtaggggttgtgtgtgcacctgacctgggaatgggctttatatttctctcgtgtgcactcttctgtgagctgaggttcaaaggctaacggcgagcttggcgctgaggaggccgtgcacggtgcacttggttgtgttgggctctgctgaacacctctccagaccctccgaggacagtccactcctgagccctgccctgcaggagccaagcaagagctgaggcagccacttttgcatctgcattctttgtggaaagagagcaaacacactacagttctcatataagccactgactccagcctggcagcttctaaaagagaggctcagcagagtttgttaacatggcctcaccactcctcgtggcccctctggacagccaggagggttggtggtagcgtagcctcactgcaaaggatggagaaaccgagccacagagaggcccaggctagggtgtccagctccagcctgacaaggtgatggagctgggaccagcatccgcccttccagaatctacctaaattgcctgtagagaccactcaaataatgaaccagtatgtcctgagtgcttaccgtgtgttaagtactctaccaagcactgcagagaatgcagaggaaatgtaagatatggtcctgccctctgagaatttccaatccagttggattattatcctatctccggcataatcatgtattaataatgtcttcgagctccagatagcagttgtctccctccctcctcccttcctcattagcagatgggccgttgggtgggcttccttctcctcccatgcccctgccatagtcctcagcttcctttcctgacaaagagctagtcctgtagggagatatgttttacgagtacatagatatgtacacatgcacacactcacacagagagacacacacaggccttctcatcctaacaaacccttaataagcacgattctgacccctgtgactttctgtttgctggaggtagcgctccccctataagctgttctttaaaacctcttagcctttctgcgtgtgcttggtgtggtgcatgaaaagtcgattctttgtgttgctcccatctagaggggaggtcaggaggtttagacctctgcgctgtctggtcgggagtggggagggctccgaggggccgggcgggggctggaggggagcaccagcaaattgattcctggcactttctctgctccccttggtgagggctggccttgcctgtatcggccaagagacccagaataggctgagcggaccttgccagagctgcttgtcagcggggactgctctgtcagcagggagagccaaaaagggccgttccacccctgagaggcggcagggctgggctgggctgggcaggccaggcctcagacactggggggtggtgtgagggaaggctggtgaggcggcgagaagcgcggctgcctccgaaccttcccggctgaacctcccttgcgttgctttccccggcaggtgcccattctgcatttattccaccaaccgccccgctgccatggagtgccacctcaagacccactacaagatggagtacaagtgccggatctgccagacggtgaaggccaaccagctggagctggagacgcacacccgggagcaccgcctgggcaaccactacaagtgcgaccagtgcggctacctgtccaagaccgccaacaagctcatcgagcacgtgcgcgtccacaccggggagcggcccttccactgtgaccagtgcagctacagctgcaagcgcaaggacaatctcaacctgcacaagaagctgaagcacgccccacgccagaccttcagctgcgaagagtgcctgttcaagaccacacaccctttcgtcttcagccgccacgtcaagaagcaccagagtggggactgccccgaggaggacaagaagggcctgtgtccagcccccaaggaaccggccggcccgggggccccgctcctggtggtcgggagctcccggaatctcctgtctcccctgtcagttatgtctgcctcccaggctctgcagaccgtggccctgtcggcagcccacggcagcagctcagagcccaacctggcactcaaggctttggccttcaacggctcccctttgcgctttgacaagtaccggaactcagattttgcccatctcattcccttgacaatgttataccccaagaaccacttggatctcacattccaccctccccgacctcagactgcgcctcccagcatcccctcacccaaacactccttcctggcctatctcggactgagagaaagagcagagactgtctgagggcagccatgttctgtaccaaaaacagagagacaaaagacaaaaaaaaaaaaaaaaaccacaaaacttaaacacaaccccagcaggtgtatgttgctgcaaaacctacagaccccgatgggtctggaacatgtgtactgtatatctttagtaaggaatagaaaattggctctgtgtgtatacctattgcattgacctgaaagctgctttatccaatcttcagagaggtgacctactgcatacttctaccttcagaggcatgcctccccagccacccactcccactctcagcccttctccgtacttttctctgaaaggaatcttgtcttgttaaaccctaaagagagtgtccttaatagcaatcagcacttgtaagcttatatactggtgcatttggttttctgttgggtgaatgcggtgtgtgggcgtttgtggattctgaaagagaaagccgtgtgtcgtgtgccatgacatttctattgcacattctttgtactggcttctttaacagcgatgaacgttcttttccctcctgggttgttcatccacgacagtctctccctgtgctccttcatcacctttccctctctctttgatggctacagagtggtagggcctggtgcttagtcgatgaaggaatggtagccatctacagtgctgctggagatttccgccagagcgctggagaccttgcgctcagatcttctctggtgatgaagaggcgaggaatcaagtgactgatctggaagaaatatctcgcagcactgcagctaacatcacagaacttaagtgtgttttgtgtgtgtgcccacacgtagacaaatgtgtacggtgcacacacacagtgcatcattttttaagggcagattatatatatatatgagatgtattaattcagtggttaccatttgtttgcaggaaaaagaaatgtatgggtgaaaaaatttatggttgataaatccagccaaggagattaaaaggggtttggataaattctgggtataaatgctcagactaaaaaaaagaaatggcagttttgcacagtgctatggtcttgcactagtttttgtttctcatctgaaaaaaaaaaagtaaaataaaaggaagaaaatgtaccttttttatggaatgagtagactgtatgtttgaagatttagccacaacctctttgacatataatgacgcaacaaaaaggtgctgtttagtcctatggttcagtttatgcccctgacaagtttccattgtgttttgccgatcttctggctaatcgtggtatcctccatgttattagtaattctgtattccattttgttaacgcctggtagatgtaacctgctaggaggctaactttatacttatttaaaagctcttattttgtggtcattaaaatggcaatttatgtgcagcactttattgcagcaggaagcaggtgtgggttggttgtaaagctctttgctaatcttaaaaagtaatgggtgatttaaaaagaaaaaaggaaaaaaatctttggctgaatatgttcattgcttgtatttttaaaacaacagaatttccagtatgaaacaggctgaaagagcaggaagaaatgttctttgtataataatgggaagtttggaatataaaagtttatatattatttatctattggagaactggtgtacaggaggaacattttcttactgtgttgctgttttccatcatgtgttatcctaagagttggggttttttaaaatctgtttcaccaggggaaaataaaagcatccctaatgttcttcctctagtcagtttgctttgctgaaagctccctggaaattagtacagttctacaggaagccagaagactgtactgtctgtccacaccatggtctcctcagtcccctccacgccagcccctcttccccacacctagtaggtgtgctacacctccctttgccagtcatcccgccatggatggggagcctacttggtgccctggcaaacctgtttacactaaggagatgcccacagggagcgggaagctcccaaaccctcagtcattctccagcagagacctttgctcttggccaggtttgaaacgatgttcaacctcgccacgtcaatgtctcagtaaaagacactatagatagttatggacaatacactccaagaatactgggcttatgggtgggttggttttttgttttgttttgttttgttttcaagtcatgtctttatccccatataatggagaatgtgccacttggctaataatgtgttttcaaaactacaagttcagtgatgacaggaaagagggctaaagtagtcccacagaggctggtagaaaaggcgaatcacacttaagcaccagcaggttaaaaacctgaaagggtggccctgacaattcagactataggttttacagcatgccacttgtgcaataggaggtctagggttgaaactttcaagaacgagaggaggtgaaggaaggagacgtttactgctcaaatgccatgcatttcactgcttgccactgaacttgtatttgaatgacttagtaatgcttaatataattgggcaacttttttagcactttggaaagagtcatcaatctttctggtaaattataaaagttttctgagtgagaaaaggtgtgtttggagtttgtttgactttttatattattattgttattaataaagaaaaaaatctacagcatttttcagactccaccctagaaaatatgtacccctgaatttggtttgcagtttgatactcagggaaggatgtattccatagatatcctttccgtataaaacactaacatctttgagaaattcacctaccaactaacttcaattgttgtcactatgcattcttcaatgaaaactagcttatttttccatatagtaatgcagttagggttctcagcactttctttcttctatcctttttttaactcttcatattatgttcagatgatcatactgtcaaggtttgtgtacattactgaaaatttgtattgtataaagctttttgcattacgaggctgtacagggtcattttgacagtaactggtatattcctttgcatcttatgttgcattgccaatttctagtgtatccagtttgaaagtataatatactctaattaaaaaaaaaaaaaggttggctata

SEQ ID NO: 602 - DNA, 39516 bp, Homo sapiens
cggattggctgttcggagcggcgaggggcttggcgggagcttccagtcgctcgagagcggagagcggcaccatggccccgcgggggcggcggcggccgcggcctcacaggtctgaggggtaagtactgccgaccctcgggagcgcggggccggagaccagcttgaactgcttcctcgcctgccgtggtttgcgcctcccggcgctgttggtgctccactgtggaggtcgcccgagtggccaatcgcccgggtccccggcttcctcctcagtctagtggggataacagtgatcccacctgcacgggcctgtcggggcctaacactgcctggcgggtgggagagacgtcagccagtgtcgtgtcgttttgtggggagggggagtgccgtccaaagtagtgagtctcaaagtgctagcttgaaagcaaaatattcagcaaatacgtattgcctgcggtttgccagactttgttagtggagttttattctctgactgggaatcagttttcttattttgaagaccctggtgttttcttactgcaaaccacagaccgtaaactggagcataaatccggctgggggaccgagctgccgcttgcggttctccaggatggctcgagcggtttttgtttaccaaagaaagcgagcgtttggtcggttgcaaaacgcgctctagaatgctggtcgctgattcgttggcgaatggccatccaaggcccggcctggatctggcgggaagggtctcggcttgctgcagacggtgcacaaagccatacgccaagacgatctgaagagaacaggagttcccccgggcctgggaaggctgcctggaggaggaggtgctggtagatgcggggttagggtggaaaagctggagcaggacaccgcaggtgggtggggaaaccgagaccagacttctgtggccagtggaggagaatgaagactcccccagtgcaaaaaaggattagaagagaatgtcagccttcaatgtcagctgaaaagagtttatctgaaaggctagtggtttttgttgtctttttttatttttatcttttaacatttttgggtttgagactcatgaaatctgttcatgcctcctcccaaaacacacttacgcacatacaacagaatttttttttttttttttttttgagacggagtctcactctgtggcccaggctggagtgcagtggcgcaatctccgcctcccaggttcaagcgattttcctgcctcagactccagaggagctgggattacaggcgctcgcccccacgtccagctaatttttgtatttttagtaaagacggggtttcaccatgttggccaggatggtcttgatttcctcacctcgtgatccgccctcctggggttcccaaagcgctgagattacaggcatgagccaccgcgcctggcccagaaattttacctgtgggttgtcacagaggtttctgtctctcagaagccccaccttgactccagcgtaaggcaaggaggaaccttgactttttttcccccccaagaaaggacaagacagctcaaagagtttaggttaagaagtttatgtggtctagtgtgtagctgggtttctgttacctggctatgtgacccttgataagtcacttaaattttctgaatcccggaatcatcatctataaaattgccataaaaccaatacttgtcttacctgcttccttaggtttcatgaattaaataaataaatcgtgaacttgttagaaatgcagaatcccagacctcaccccagagggactgaatcagacactcctggggtggtgccaagcaacctgttcaacaagccctcttgagaattttgatgacactcaagtctgggaaccaccgctctgaacagttttctaactttttttttttaactgtgattcacagtaatgatgttttacatcacacttagtacacgtgtgcacacatccacacataaaacaaaaggcttgtgaacatagtatatccagtgcaatgcttcattttatattttccttttttattgtttgtttttttaaaaatgctggcctggcaatcttaaaagacattataggacaattgatgtgatttgggtatggactgtagattagattatggtatcagtgttaaatttcttgattttagaaattgtaccatgaatatgcagtataatgccctcttaggaaagacatattgtagtatttaggggtggaagtgcacagtatctccagacacacacacacacacacacacacacagagcacatgagtaaagggcatacagaaggtccttgtgctatgtttgcaacttttctgtgagcttgaaattatatcagataaaaggatactaaaacattggtttagactaagctgattttgctgtctacaaatgagaaaaatatggctgcaatctgcatggcatattttaaagtctaattatgtactgtattctcctggagtatcccccccgtacccttgtacgatgcctggttggtggaggatagtctgtacatattcactgactgctggcactattattagtaataatgatatataatcctgccactgttatttcccgtttttattcttgtcaccattgttacatttgttttcttgaagcttgttgaagatatatatacaactttatcatttgaagctgtggtccaactgagagagtgtcaagggaggtcgagggcaggccctggatttgaactgatgtaaattttaatgcaggcttgtctccctcctggctccgtgttgctgtgggcaagcacacatctgtaacatgggattcacttctaccttataggactgttagaattaaatgagaaaaggacgtaggagagccaggcaccggatggagcaggtgtcggggcttagcgttagcctacctcccctttgttcagctgtgcagagaaagtcaatcactgctgattgattaaggcctcagggaaaaagttaacagcaggattccaacttttccatgtccctgagggggagaggtatgttattttatacattggtgataggatttgacctataaaaaataaatttgtggaatatgggttcttgtttttttttttggtaaaaatgcgcggaaagggtcataactatggtgtttcctcagttattttaactatttcctaactcttgtgtttttttgctgtttaatagcgcaagacgttcaaagaacactttagaaagaacacattccatgaaagatgtaagttacctttttgtgttgtggttttctcaaaattgacagtacaaaataacattttttgggtacctcagttttgtagacttcacttggcaagttcaatgtttattgtagtgaaaaagtgtgttcattttcctcacactttttccggtatagtggataaaatgacttttgttaatgttttagaatttcctttatttctgagccgagtttggttttattttcgtttagataattgacttcatgtaaaaattgtacagtgctgtaagcttttttcacttaaagccatttctcctcattgtacttttcaagaattgttttatgatttcatgatactccacttagttcacattacaggtttacttttctttagagtcttagaataaatgtatgttaaaggcatgtgcatttctttaacgttcttgatagctaattccagtttttttttccagtggcttgtgtgattgacattgtaatctcacattaacagtgtatgacagtgccaggcaccccggaaggagttccttctgcttgttctgccctgggctttctctgtcctgcatagtccttaaccccagcctgcagacgatagctctcttcccctctgggaaaccctgggatccccctgcagggttttgctcagcgctctgctcccaccccggcattacttcacgggttctttgggtggatttctctcagctgtcctgccttgcccctgccattggtagccaaagtacagtgtgcctcggagggatttctctaagctccagccttagctggaagcccagagtgcctggaatggattcagctttcctgtccttccctctgcaaggcagtccctggtggaggccccctatgccttgggaggggctggaagacctgccagctctctccacattccacccccaagcactccaggaatgattctttcactgggggcatctgaatggtcaagtttttatatggtttgccaattttatttgacctcctttataccttccagaattttcttatttttgtatctgttaatagtacccttccacattttctggaactaccatgaaagtttttctcattttatgtatgttttcatgtttcattagatttggggtagcagacttcatgggtgtatcagtatattgaactctaaaccctggtgtcctttagtcaggagtttttacacatgtgtacccttaaaactgtttatgaacttttgggtatatgggcatatttccggagacaggacccatcactttccctaggtcagaggtttaggcaaactggcccatgggccaaatctagcctgccacctgtttttgtatatccctgcaagctaagaatggtttttaccttttttaatggttgaaataaaataaaaagactatgtcataatatgtgaacatgatatgaaattcaaattgcagtgttcaaaagtcaaattgtattggaacacagccatgctcattcttttctgtgtggttactgtctgcattcatgtgacagtggctgagttagtagtcaaaacagaaaccttacggcctgcaaagcctaaaagaatttactttcttgtcctttatagaaaaagtttgccaatccatgccttaggttatcaaaaaattctatgtccccaaaaagtgttagcttgcttctttctttttattttaactgaaacattgtaattgtacacatttgtggggtctgatttgatcttgccatacatgtctatgttgtataatgacccaatcagggtaggtagtgaatccatcaccccatgcataaggattgcttccttaggcagcagtgattacaagaatattcttgctgtataaatcaacctattgttctttgtgagagccaactcaatgactcaactttattcacttttagaaagctggtcaaaagtgcaagcctattgacgtgttcgactttcctgataattctgatgtctcaagcattggcaggctgggtgaaaatgagaaagatgaagaaacttatgagacctttggttagtactttaaatctttatcctaacataactctaaagcaacaacatttaggccagatataataaaaaatagaagtatcttcaaatataaaaattagttgcctgcatgtaaatataatgttctctggggagtacttgataatttgaattaattttcctcacttacgggtacattgaaactaagaacattatcaaagcggcactcgtctagtagtattcattaacaatctggtcacatgaggacgcttactatagtactctgtaataaggggaacatagcatacatttctcacttcactctaccatttgatagagccattaatttagggaggagaagagtatgggtaattttcctttgtcctaaactcatggaggcaggggatgcttcgggagagccagtgggagagcttcacctgtgttccttggagtgtgaggtaaaaggccagtaccaggctggccaggagtgtgtgagttgtcagggtgggctgcttgtgtcactgggcactccagaagccagaaatgacagagaaaatgccatgtgtccccacatctagaactgcagtagtcaggcatttttgctggaataagttttaagagaattttgaaggcttttggtttaattttttgtttaaagaaaatattatacattttataaggtgaaatgtattcaccagaataatgtcttttattatgacttgataaaaatgtcctatttgtctaaaatctaaatctaaaagatctgaacctaaaaccccataattttaaaaatggaaatgaattcacataccataaaattcacccttttaaggtgtacatgtcattggtttttaatttattcacaaggttgtacaaccgtctgcattatctaattccagaaaattgttatcctgtagagaaccctgtacccatgagtggtcactccctcttcccccttccttcaagcccctggcagccatgaatctccttcctgtctctacagatttgccatttctggacatatcagtggaatcctagactctggtcctttgtgactggcttcttttacttagttttcagggtttgtccatgttgtaacgtgtatctacctcattcctgtaagtttttatagctcagtgatactccattgtttggatataccgcagcttgttacccatttatcagttacatttgggtggtttctattttttggccactgtgaataatactgctgtgaacatttgtgtaagagtttttgtgtggacttttttcacttctcttgggcatatagtgggagcagaattgctgagtcctatggtaattctatttttaactttttgaggaactgttttacaaagcggctgcaccactttacaattccatggcagtatatgagagttcccgtttctgcacaccttcaccaaaacttactgagttttttattctagccatcccagcacctcattgtgggtgtgagtgtgtgtatggggtatgggtggtaaaatatagtttaccatattaaccttttttaagtgtattaactctgtagcagataaatacattcacgttgttgtgcaaccatcatcaccatccatctccagaactttttcatctttcctaactgaaatgctccacctattaaacaacttcccattcttccctcccctcaactcctggcaaccatcattctgttttctaggaatctgatgtaaaaggaaacatagaatagttggttctttggtaactggcttatttcatttagcataatgtcttcaaggtttatctgtgttgtagcctgagtcagaaattttttttttttttttttggagacgaagtcttcctctgtcacctaggctgaagtgcagtggcgcgatctcggctcactgcaacctccacctcctgggttcaagcaattctccctgcctcagcttcccgagtggctgggattccaggcgccccccccccccaccccccaggaccaccaccaccacgcctggctaatttttgtatttttcagtagcgatggggctttgccatattggccaggctggtgttgaacccttgacctcaggtggtccacctgcctcggcctcccaaagtgctgggattacagacgtgagccactgcgcccagccagaatttcctttttaagctgaagaacagtctgtatgtaccacattttatttttatctactcatctgttaatggacccttgggttacttctgctttttgactgtgaataattctgctattaatactaacatgagtgtatcaatatctgtttgagtccctgctttctcctcttttggacatttacccagaaatggaattgctggatcatatatattttatattttcaggaatcaccatttccacagtgcctgtgttcccaccagcagggcccaagggtttcagtttctccacatccttgcctacacttgctattttctgggtgtttgtttgggtgtgaagtactatctcactgtggttttgatttgtatttccctaattactaatggtgttcagcaccttttccgtgtacttatggctgaccatttgctttttttttccctttgaccttcttatgtatgattattggccatttgtatattctttgaagaagtttctgttcaccctttgcccgtttttaaattggattatttgtctttttattatgaagttgtaagaatccagtttatgtgagtggttatctgtggacgtttgggattgttctatttcttttttccccccttgttattcacagcaatagagtaaataaatccctttgcctcgtggagggcaatacaaagtatactactaacttaaaaattgtgcagttgatatgttcattatttaagcagctgtttagttgaaaaaatgttgaagtttgcactgtcatgctaaactttgagcatgaagaaatggttgcttggctcttaccaggcccccttacagcagttcagctctgtcaccactggccacctcttcttctccaagctctctacccctgcgttaagtcctgggtctctcctgttactcctctttcctgagcacccgctaggagcatctttctcctcttagcatctcctttctgtgcctttccaccaagttcatttgctctccttctcttttatcttcttcctcattcaaggtatctttttatgttatctaaaggctctggcatcccagagtaaagcagagaggaagtaagggaggcctggaatctccccaaagggcttttcattcaaaaatactgagggcccactatatgcagggtactttgtgaggtgacctctctaggcctgttgagtttatagtttaatgcagtggtctctcatgcagagtgtatgacgcctgacagggatgaggaaagaaaatgttggacttccgatttatatttttatttcattaaaatttccccaacctgggcaacatagtgagaccctgtctctacagataattaaaaaattagctgggcatggtggcatgtgcctgtagtcccagctatttgggaggctgaggcaggaagatcgcttgagcccaggtgcttcaggctgcagtgagctgagatcgcactactgcactccaggctgggcggcagagtgaggccctgtttcagaaaccaaaaataattccatgtaagtgcagtaataaaggtttattattcataaatattcatgtatttattggtgatagggtttacaatttttattgttgaggtgtgagatcaaaaacatttgggaagtggcctgtgtaattgattttgattttgttagttgaacaaagattgttttgtactccattgtaagggaataaactacagtactgcccaaatagccagacttttaaagttgtgcttcttttttgtcttttgaaagatcctcctttacatagcacagctatatatgctgatgaagaagaattctccaaacattgtggactgtctctctcttcaactcctccaggaaaagaagcaaaaagaaggtactggtgtatttcaagcaattgtttattcatggttaatgggatttctgagaaactctttaagatagaagctaataaaacaaaagcatttcaagatcctttgagccaacttgttatgctttttctcaagagaactgaggcataaaaactttattaataattgacacgataattataatagctgtgataactgacagaattcacacctgattatcctagaaatcatgcctgggaagatagtttagctttgagtcaaataagaaaggagggaaagattttacaagcatagaatgttaggtgatttttgggaggtctctttcatttacaaattctctataattatcacaaatgagatgtttccttgtatatggtaggtgataattacaaagcaataaaaaggctgtttcagatgcactgtccctgaagtgcattggtttgagtctttgagatttatgtgaagctataggtccagaaaatctctataaaaatgatttcatagagaaaacttgggagcaagttatataatgcagaactcttcgataactgtagtactcatttaaaattatctagagcagctctttgacttagggacctctgttgggtaacaggtcagttctagttactaaatgtatttagcaagtatcaaaagtgcagtgtatttttgtttggttgtttgtttgtttgtttttttgagatggagtcttgctctgttgcccacgctggagtgcagtggctcaatctgggctcactgcaagctccacctcccgggttcacgccattctcctgcctcagcctcccgagtggctgggactacaggcgcccgccaccatgcccagctgattttttttgtatttttagtagagacggggtttcaccatgttacccaggctggtctcgatctcctgatctcgtgatctgcccacctcggcctcccaaagtgctgggattacaggcgtcagccactgcacccggccaaaactgcagttttaaaacaaatatcccagctgggcagaaatctgagaagtcattttgagattgtctacactagggaagttttatagtacttggttattttggagactccagcttatttttttttttttttttttttttttgagatggagtctcgctctgtcaccaggctggagtgcagtggcgcaatcttggctcactgtaacctccgcctcccaggttcaagcaattctcctgcctcaccctcccgagtagcttggactacaggcacgtgccaccatgtccagctaatttttgtattttttagtagagatggagtttcaccatgttggccaggatggtcttgatctcttgagctcgtgatccgcccgccttggcctcccaaagtgctaggattacaggcgttagccaccgtgcctggctgactccagttttatatgttactgaaaatcagtaaaagtcatacatttggaaaacgtgctctactttaaacagtggtgaatgtaatttttaaacaggaatattttgagtaggtaacaccttcacatggtttaaaaatataaaaaggtgtatagtaagtcttcatatcatgtctactatccatctagctcctagaacccgattcttccctctcccttattattaatttctcatatgtccttccagaatttcttggtgcatataaaagtaaatatgaatacacattttaacccttttttgtctacaaaaggcagcataggttgctacctaggttttttcacttactacatcttagagatctttacatatcaatacacatggagctttctcattcttctaccctttccacagcatgggtgttccttagtgtgattatccagttctgtatagatgggcagtcaggctgtttccagtctgtgctgtcactcccagtgccactgggagtgccatttcacacttgtgcctgtgtatctataggatatagtcataaaagttaaattctgagtcaaatgaaacgtgtttgtcctttttatagttattgccacattgccacctaagtgagatcaaacttggatttttgccaatgtgataggtcaaaaatgctatcccagcctagttctaatttgtattcttaggaatgattgagcagcaatcatttaaaagctcttgaatttctctttctgcaaactgtttatatcctttttcctattttctagttgatgttggtcattttcttcatgacttcatttaaacattagtgagattagccctatgttacagtttttttttgttttgttttgttttgttttgtttttactggttcatctctcttttgacaaaacacctaatggtggtggttttttttttcaacatagaaaatgttcagttttatttagatgcagcgatatatttatcacttttagcatttagggattttgagtcataggaagacatctcccttcgtgttttcttttagaacttctatgatttatattaaaatccttgatcttttctatatataaatgcagcttttctcattatttttaataatgacttttaagagctacttgttaaaagcaaagttgctatctttattgggttgaggtaaatttatacatttatttataaaagctgatctttattagttttggatttggtttgttcttgcttttctacttcttcaagatgcatcattaggttatttatttaaagtttttctttttttgatgtaggcgcttatagctgtaaacttccctcttagtactgcttttgtggtatcccataggttttggtatgttgtgtttccattatcatttgtctcaggaaaattttcagcttccttcttaatctcttaattgacccactggtccttcattaacgtgttgttttatctctctgtgtttgtataacttccaaaattcctcctgttattgatatctagttttattccacagagaagatacttgatatttcggtttttaaaaaatgttttaagacttgttttgtgacctatcacgtggtctgtacttgagagtgatccatgtgctgaggagaagaatgcgtattctgccgctgttggatgaaatgttctgtaaatatctgttaggtccatttggtctacagtgcagattaagtctgctgtttctttattgattgtctgtctggaagatctctccagtgctgaaagtggggtgttgaagtctccagctaatgtattggggtctgtctctccctttagctctaatattagcttcatctatctgggtgttccagtgttgggtgcatgtatgtttcaaattgttatatcctcttgctgaattgacccctttgtcattatgtagtgaccttctttgtctcttcttacagtttctgtcttaaaatctagtttgtctgaaataagtatagctactctgctctttttggtttccattgacaatggaatatctttttccatacttttattttcagtctgtgtgtatctttataggtgaaatgtgtttcttgtaggcaacaaatcattgggtcctttttttttttttttttttttacaatcagccactctatgtcttttgattggagaagttagtccatttacattcagtgttattgctaagcagggacttactcatgccattttactatttgttttctgattgttttgtggccctctcttccttttcttccttcctgtcttccttttagtaaaggtgattttctctggcagtgtgatttcttgctctttttatgtatttgttgtatttattatttgaggttaccatgaggctagcaggtactgccatataacccattattttatgccattaacaacttaaccctgctcgcataaacaagcaaaaagaaaactaataaaaactacacctttactttgctcccccactttttaactttttgtttttatttttattgtactgtttatgttttgaaaagttattatttttgattggttcatcttttagtctttctacttacaatgagagtagtttacatgcatcagctacagtgttatctttttccgtgtacttcatattaccagtgagttttataccttcagatgatttatactgctcattaatgtccttttctttctgcttgaattactccctttagcatttcttttgggacaggtctggagttgataaaatttctcagcttttgtttgggaaagtctttatttctttttcatgtttgaagggtattttcaccagatatattattctagggtaaaagtttttttccttcaacactttaaatatgtcatgccactctctcctggcctgtaaggtgtccactgaaaagtctgctgccagacatattggagctccattgtaagttatttatttcttttctcttgctgcttttagattctttgtctttgacctttgggtgtttgattattaaatgccttgagggagtcttcctttgggttaaagctgcttggtgttggttgtataaccttcttgtacttggatattgatacctttctctggtttaggaagttctctgttactacgtttttgaataaactttctacccccttttctctacctttctttaaggccaataactcttcgatttgcccttttgaagcttttttctagaccctgtaggcatgcttcacgattgttttttcttttttctttcctttcctctgactgtattttcaaatagcctgtcttcaagctcactaattctttcttctgcttgatagattctgctattaagagactctgatgtattctttagtatgtccgttacatttttcaactactgaattgctgcttgatttataaaattatttcaattctttgttaaagttatttgatagaattctgaattccttctctgtgttatcttgaatttctttgagtttcctcagaacagctattttgaattctctgtctagaaggtcatgtatctcctgtttctccaggattggtccctggtgccttatttagttcatttgatgaggtcatgtttcactggatggtcttgatgcttatggatgtttatcagtgtctagacattgaagagtcaggtatttattgtagtcattggagtctgggcttgtttggatccatcatttgtgggaaggctttccagatatttgaaaggacttaggtgttgtgatctgcattagggggtctcatgaccctgactggtgccctatgctactgtggctgagctcgtatccaagatggaaaacaaagtcctctccactcttccctctcctctcctctcacagaagaaaggggtctcttttggagccatgggctgtgctgcctgggcctgggggaggggtgatgccagtacacccttagccacaccagttggtgtctcagtaggtcacatgcccctacagtccactggctccaagcccagctcagcactaggagttgccatccttgtggcctagactgcccgtcaggctcacctagggccccagagcactttagcccatagtggcaaggcttgtcagagctcaagctcctgctgctaagatgggcgattcccctcacaccaggactagtccaaatgctccctctgtgtgtgggcatcagtttagttcagcctggttctgctttccactgttacaggacagcactgaattcaaagcaaagcttcaaaatcactgtgctctcctcccaagagcacagattctctgtgccacgcagccactgctgggagatggggaaggggtggtatcagcgattgtagactctttcctaccctcttcagtgcctctttcagcagtgggaagtcaaaaccaggcactgtgagtactcagctgacttttgtttcctgtgaaggtgttccctttgtgtagatagttgttaaacttggtgttcctgcaggggacaatcagtggagccctctgttcagccatcttgctcctggctgtttcctctcctgtttttttctttatgtgtaggtgattctgctgtcagccccctcttctccggccctctcttctccatccaaccccagttcacgctcatggttttaactacctgtgtgccaccgtttctcaagtttcttgtccagcccttctcctgagttcccggatgttttgcacattggccgtatttctctaaatgcccacaggcacctcactcaacaaaggcaaaactgagcttcatccttttccttctcatctagtgtcagtgaacttctttggtgttctctaggttaatagtcttgccattcacccactcccctccgatccagcaatctgggcaatcagtcttggtttgttctgtctggccagtcctatttttctggcccgtgactgccttgaaaatccgtttctcctctccacacccctgccacctccctgtggctgccatggtttggggacctcactctcaccagcgttcctgcggtagtttcctgtctggcctccttgtcccttatgccagctctctctggcctacccgcccatacaccttccagagtgatcttttgaaaccccagtctcatctcactcctacgtccacctcctggtagggctcccctttgcctgtatgcatggcatagagggcccctgtgccagtttggatcctggggtgagtagacactgaggcagttaggaatggaaggggtttattagtgttacctgtgaagggtaaagttggaagaagcaggattgggcagaggtggcctcagactgcactgcagtgcctacggttctgaacaacccactgcggagctctggaggaatgagggctgttaaaaggaggcctggcctgtattgggcagaaacgtcgaggccccagacccttgctgtgcttacttgttggctagagactgcccacagctgtggcctctgcccagctgctgcagtggatccagaaggcgctgcagtgggtgcagaaggtgctgcagctggaggctggcactgaccataggagatccatgcagcatgcctatgtgggtgccctgcagcccgtcagtcatagcctttgactcttccctagcgttcgttattttctcttagaaaatacattctatctgtgctctgttgcatgtttcttgaacatgctgggctgttttacaccaccaggcttttacattaacttttccatctgctttaaatgtccttcttcacacttgttttcctgaaaaaggtttttttacctgtcagcgccaagtgtcataactgtgatgcttttcctaataccccagctgtgtctccacatcatcttctctgtcagatgcttgccaggtcatcactctgcaccatctttggccttcccactagacagtgaaccctttgaaggaaagcctctcaattttaaagtaattttattcactgtgctttgcattttgaggttggtgttaaataaatttgttgtattgaacagaatgaaaagatgagttttcatctcccatcagaagttagggctatttttttcctctttaaaggataaaagaaggtgttcccttttctgtcacctaaggatgggcctagtggattagcttttagtacaaatgatggcccgtattcctgggactggtaacttggagaaaagtgcagttctcagacatcaccacaggtgctgcagtaatggaacaggttacttgcttgcctgggataaactcatgtggcctgggtatgggaagatgtgggaggcagcagtaaacccaggaaggtggcagacttgtatgtgacaaataggatatttcctcattaaattgagtctgttttcatgttgaatgagcaagttagagaagacatgtgaatataaatggaatgtgtacaagatattgatggcttgtactttttacagttcagacacttctggaaatgaagcaagtgaaatcgaatctgtaaaaattagtgcaaaaaaggtatgtaggagtattcactcttctactttaatttgtaatatagtttgattggatgcaagtacagaaaatgttctgtaaaatatttcatttcctctttagattggatgcaaatagagaaaacattccgtagcaccatttttcataaagttctatttttaggatatacttttatagtaaaaaccaaaatatttttgtaactgaagtgtttttcattaaagaggtctcacatctctatgtactttgtcaattttcatagcattcttgtactgtggttaggttgtgattttaaaaggcagagtgaattgctgggagtgattattgtaacctttgatttaggtttcctgtcctatccactaattaagttgccgtcttcctattatgttcaattttgaagtgtagaagtgagaaatgtggactatatatatggttttctactattacagtaagaattataagcatttctattttctacataagtactgctgttttttctttcacacagccaggaagaaagctcaggcccattagtgatgactctgaaagcattgaagaaagtgatacaaggagaaaagttaaatcagcagagaaaataagtacacaacgtcatgaggttattcgaaccacagcgtcttcagaactttcagagaaaccagctgagtctgtcacttctaaaaagacaggaccccttagtgcccagccctctgttgaaaaagagaacttggcaatagaaagtcaatcggtaagaacgtctgccatcccctaggagggcaaaaaaagtttattgaaaaattttggggaagaaaatgaagcattttctctttccttcagatcttttcaaagataaattttatattttccttaatgtaataaagatgtttgttttagaaaatctagatggtatggccgggcgaggtggctcatgcctgtaatcccagcactttgggagaccgaggcagggggatcacctgaggtcagaagttcaagaccagcctgggcaatatggcgaaaacccatttctactaataaagtacaaaaattagctggatggagtggtgcatgcctttaatcccagctactcaggaggctgaggcaggagaattgcttgagcccaggaggtagaggttgcagtgagctgagattgcgccattgcactccagcctgggtgacagagcaagactccgtcttaaaaaaaaaaaaacaaaaaaaaagctagaaggtatggaaaagaagataaaatcatctgtaattccataacccaaaataaccaccatgttttttggtctatgctgttcagtcctttcagtgagctttaattaccctaagtgagatcatatacttattattaagtattcaacaatgcataacattccattcatggatatgccatagttaatctcttactaatcaagaattgctatttaaaaaattataagtgctttgatgaattttgttgtagctaaatatttgtgcattccttagatcatttccttagaaaaaaactgctgataagaattctgggtcttaggcgggcacggtggctcatgcctgtaatcctaccactttgggaggccaaggcaggcagatcacgtgaggtcaggagttcgagaccagcctggccaacatggcaaaaccccatctctactgaaaatacaaaaattagctggatgtggtggcgcgtgcctgtaatcgcagctactcagaaggttgtagcaggagaatcaccttgaacccgggaggtggaggttggagtcagctgagaccgtgccactgtactgggcaacagagtgagactctgtctcaaaaaacaaagaattctgggtcttattggtgctaaaattcttgacatataatatcttttggtcaagttcttaatatgtgattaattcatttgggcttaattgaataaataatttatgctaatgtttgaaaactttttgaagtataataagttgtccctgccaccctgtcttcttcacctttccacctgctaaacatacacacaggtaaccgtatagtttcttatatatccttcaaatttccttttgtacatgtaaacaaatatgaatttttttaatttttatttcctgtctttacacaaattgaagcaaactatgatctctgttgttgatctgtcttggtgaacatcccatgtgcacttgtgttctgtaaatgtcagttgaggtcaagttgattcagagtgtagttcagagatttggtctccttacttactgttttgtttttggtgatggggcatggtctgcttgatctatcagttacatagaggaggtatttttttaacttctgctaaaagtccattgacttttgatgtaattttaaatatggtgaggtttacatctaccatactgtgttttccatttgctcctattttctctttctcttagaactcattttgcattagttgaatgttgtttttgtattccattttattttctctattggcttcttagctataccttttaaaatttttttcagtggttgctcctgggttaaaaatatacatccataaattagcaaagtctctttagaatcagtgtgttatcacttcatacattctacttaacaattaactaccttccactacatacatgtaattacataacaatattatgtataattctatttatccatccccatcctctgtgctgttttgtcatatgttttacttctgtgttacaagtctaaccttacggtattgtcatttctgcttgaaagagttgtttttttaagaaaagtatgagaagcagcagctctatagtcttttacctgtccctctctccagttcactgattgcctgcctgtagatactagtttccatttgttatctttttccatcagcctacagaatatcttctagcatttctttcatggcaggtctgctggtgacaaattctctcagattttgtttctctggaagtgtttttatttcaactctgtttttgaaggatatttcactggccgtggaattctgagttgacagatttatttcccagctctttataccattctgttgtcttctggttgccatggtttctgatgagccgtgagttgtctctttcccatgtacctttaccttgtcctgtgcccccattgctgcttgtcctttgttatcagttatgttgttatccccatgatagtgcttctggtaggctttatgtggtctcaacctggcacatgggcagtactcagacaaggactcttaggacaccccccacaggcacctgtgctctcctgagcagcttattccaggtgcctctcagctgggtaggattgtcatgccctgcttagacttcagctcactataccccatctagaaattgtatgtgtgtggagtgggggtggtagtcatggggttcaccttccaagtttcccctttctccaggaactcagtcttgtgttgcctactgtccagtgcctgaataaaattgccacccatattcccccattttatggttgtttatggcaagagagctagtttggaagctgttacttcaccatagctggaacagaaatttgagctgattccacatgttgttatcttaagtaataaaagttcagcttttccatcaaggcaacaattgttaaaagtcaactgaaagttttattttctcttattttgtgatagttttgtttgcaatgcttccttgtattactgtagataatttatgtaactaatctgttttagaactaaatgagaattgtagctaaagttttttttcttcttgagacggagtcttgctctgttgcccaggctggagtgcagtggcgcaatctcagctcactgcaacctccgattcccgccaggttcaagcaattctcctgcctcagcctccccagtagctgggactataggcacgcaccaccacaccctgccaatttttgtatttttagtagagatggggtttcaccatgttggccaggctggtctggaactcctgacctcaagtgatctgcccgcctcagcctcccaaagtgctgggattacaggcatgtgccactgtgcgcagctaaaatattgaatgacagtttggtgacagtcttaatcctaatgttttaagagaaagaaaacttttcttaaaaacttaatgctttttttttttgtagaaaactcagaaaaaagggaagatatctcatgacaaaaggaagaaatcaagaagtaaagccataggctcaggtagagaatgatgttttatactttgtcactcattcaggaatttcataagagaaataagaccctattcttaatttgttatagtagtaaattgtaagtacataaaattgccacttttaaaaattaggaatatgtgactttggagtaacatttttttctaacgttttgtcatgaaaattttcaacatgcaactaaggtgaaaaaaatttatagtatatattcatatacccactacctagattttacagttaacattttattatttactttattagataggtagtaaagcaagtattaatccattaatccagtttttaaggcattttaaaataatgtagacatgagtacttcctctggaatacataagtatgcacatgattaactggagttcagtgtgtgtttacagttttttctttgaatgtaaaatgtacatacagtacaatgtgtaactcaagtcactgtcaacatgtaaagtctttactccagaaagttcccccatgcctctttcatgtcagtccccaccccattatctccagaggcagtggcttcagggatgctttttctgcccatggattagttttgcctgttctgggattttgtataaatggaatcacatagtgtgtactcttttgtgtaaggcttctttcactcagcatagtttttttgcaatccatctatgttgtttggtgtcatttttattactgagcttattccattgtgtgattacactacagttgatccagtctcttattgatggacaactgagttgttttcaggttttggctatttgaataaagctgctgtgaactttttttttttttttttttgagactgagtcttgctctgttgccaggctggagtgcagtggcttgatctccgctcactgcaacttctgcctcccaggttcaagcgaatcgcctgcctcagcctcctgagtagctgagactataggcccacgccaccatgcccggctaattttttgtattttagtagagacggggttttaccatattggccaggatgatctcaatctcctgacctcatgatccgcctgccttggcctcccaaagtgctgggattacaggtgtgagccaccgcacccagccagtgaacatttttatacacatttttttgcgaacgtatgttttcatttctcttgggtaaatgaaaaggagtgaaattgctgagtcatagggtaggcatatgttaaattttacaagaaactgccaaactttgcaaactgcattcccaaagtggttgtataatatagttttatactcctaccagaagtttaaatgtttaagtgcacagtttaaatgttgctaagaatataatgaataacttcatgtgaataaatttaaaatagttaggggaggctagtggggagcaggggagagggggaggctggtcagcaggtacaaagttagataggaggtataagttcaggtgttctgttgcacagtagggtgattatggttaatattacacatttcaaaacagctaaaagaggatttttagtcttcttaccacaaacaaatgataaatgtatgaggtgatggatatgctgaataccctaatttgatttttttacacaatacatacatgtattgaaacatcacaccatacccataaatatgtacaattactatgtgtcaattaaaaataaaattttaaaagtgaatccacccacccccctaaaatagaggaaaaggagatattaaagaaggaattaattacggaagaagagtagactatcctgccaatggcttatgttaacatacagaaaattgggggccgggcatggtgggtgcacccgtaatcccagcactttgggaggctgaggtgagagattgcttgagcccaggagttcaagaccagcctgggcaacatagtgggaccccacctttacaaaaaattttcaaaactagccaggcatagtggcgtacacttgtagtcccagctgcttgggaggctgaggtgggaggatcacttgagcctaggacttcgaggctgtaatgagtggtgagcgtgctactgcactgcagcttgggcaacagagtgagaccctgtctcaaaaaaaaatttttctaagaaaaaaaattagggtatgctttgcaaattgataacaccttacagatgtatagtaatttatagtttttgtaaatgcattcacagatattttcttgcttgagtctcaataaaagggagagcattgttttattccatttatcattgaggaaacagcctctggaaggttaaatggcttgcctgagatcttagactagtaagaaagaagctcaaactagaaccaaggtcttcagattcctgtctggtatattactgtatattactacaattatttaaattaatacactgagtaatcttgctgtatcctacaagtggcctatcagatagattaaaattcagaaaatacagctaacaatgaagagcttatccccagtaatgttaaataacagcacaatactaaataaagatgcagtaaggtgattaaaaggcagcaatgcttttggttgctttagcagaaataggagaaccagcgagacagcagttagagtgaaagtgtatgtaggggtttgcgagactgtgcacagggataagaagtgagtacggcacctcctctctgattgttcagctgtagctatcttttacaatttggtgagactatttttgtgtcaggctttcagaaccctggacctacagccaaaatatgaataaccagcatgttaacttatcttaatattttagatacttctgacattgtgcacatttggtgtccagaaggaatgaaaaccagtgacatcaaggagttgaatattgttttgcctgaatttgagaaaacccacctagagcatcagtaagtcttttgatgatgtgctatatttacctaataaatttcccctgaagcaccatttttgctcatcctacagtttttgttatgtactattttcattgtcattgttttagatatttttacattttattataattttttctttaattctttgaagaattcatatgtttttatttgtcccaaatatgtagacttttaaatttatatttttgtattaaccttctatcttaaatatgttgtggtcaaagatcatggtccagtgatacctttttttttttttaaattttgaggctttcttcatgacctggtacatgatctgtgtggaatttctaatcattagatctagatagaatctctaattattggatctatgttcagtttttcttggtacttctattcatttgtgctgtatatatttagagactattaggaaaatcatgtttaaaattgctctgtcttgcaaattgaacattttagttggtcacccactctattcctaaacatactttgtcttaaaatttattttacctgatactaatatgcatcatagttttcttttgctagcatttggcagattttttttttttttgagatggagtctctctctgtctccaggctggagtagagtggagagatctcggctcactgaaacctccacctcccgggttcaagcaattctcctgcctcagcctcccaagtagctgggactacaggcatgtgccaccccgcccagctaatttttgcatttttagtagagacagggtttcaccatgttggccaggatggtctcgatctcctgatctcgtgatctgcccacctcagcctcccaaagtgctgggattatagacgtgagccactgcacccggccagattttacattctttttaatttcttttacttccaacctttttgcgaccttaaattttaatttccttattagtctttttaaatacagtgtatcagtctttgaatttcaactgtttagtccattaacatttattgtaatatcgatatatcttgaacaatatgttgatatattgttacttctttaacttttttattctactttttgatgttctgaattttttttaacttaaaaaagttgtatttataactccccacctttaattctaaattaaggtagatagaatttccccttctgttgtgtgtgtctgtctctgtttttaagacaacaacaaaattcacttaggtatttgatcacttttatctcatatattttcttgcaatatcctgtagataagtattttctcatatttaagcatttcatccaacacctcagtgtgactctttatgttgcaaaacttctaaaccttctgattattttgattatacccttgaatttgaatgacagcttagctggatataatactttaggttctaaattattttcttaaatactttggaaactttgtattcttttacatcaagtgttgcttttggaaaatttgatgtctatctaattcttatttctttgaatgtgatctgttctttagctctctaaactgttattttttttctttgatattcttaaatttcactatattgagtctgaccttttcattccaaggttttttaattttttatttttttattctattgctgctgaacaaatttttttaattctaagaatttaaaatatttttatcctgattttcttttttgttctcttatcctttgcttcattcactgggagatttcctcaatctaagaaattagatttgctaatttattcttagaaatatccattctgccatttgtcccatctgttgagttctttatttaacttagcttttatattaatatttctgcttttttttttttttttttttttgagatggagtctcactctatcacccaggctagagtgccgtagcgcgatctcagtccctgcaacttccacctcccaggttcaagcgattcacctgcctcagcctcccaaatagctgggattacaagcatgcgccaccacgcccagctaattttttgtatttttagtagagatggggtttcactatgtcggccagtctgctctcaaactcctgatctcaagtgatccacccactttggcctcccaaagtgctgggatttcaggtgtgagccaccgcgcccagctatttctgctgcttgctttgtgtcttgtattcatgttttatgctgctaatatcttccttagaatatctgttgggctaatttcaaattactggatcagctattctaaaatacctgcttctggtaaggtttcggatataatatgtgttttccgtttgaaatagttgggttcctccagcatcctgttattccagcctctgagcttattttcccctgggcctgtcagcttctgtcagacagtatgtatagaagaaggccaaaccccagtccctgttagtgcccgtcagtgcagggggtggggtaagccctaggatgggcagcctcagcgactcatctcacaaaacagcctgtcaggtcagcacttcactcctcgccctccagagaggagcagcaggaagaaaagatggactctgggtcatcattctccagcatgggggtttggctggggaagggtgaggaaacagctgcccaaagtcagtcagcctcccatgtttttctctaggccccacaagtccaaccccagtttcagtcttgaggacacagggacagaggtctcagttgctgcagggggcaggggagcgggggtgagcaggcacactattgatgagatcggtgatgggaagaggcaggagtcagtttcctgcagctctctattcctgccctggccacagcgccactccttacagcagttattctctctacatgaccttcccctcagggttttcacagctttctccattttcttggtattccctctgtagttctgggtgagcttggggaaaggagccagcctgtcatgccaactcatcattatcattgtgagaagtgcctgttttactcttctttatattccagagccagtttcctgttaaaactaggacagttctgttaacacacccaagaccatcttgcttgtgttatcctttacctattcacaaatctcttataggaagcttattatagacttctgatgttttagggaaaatggcattgtccccttctaaatcatttcttatatcaagaacttaccacccagtgggtagtaaggacacagggacagaggtctgagttgctgcagtgggtagtaagttcttgatataagaaatgatttagaagaggcatagtattttttcttagacttattgcagtacaaccttgtgtttttgtcataccaaataagaattctggtgaatcactgatctcattttgtttccttgacaatatggtgttctcagccacgtgaaacacttcactctttcaaaattaagtcaacaactgtttaagggtctgtttgtaatatcctgtacctagcactcacacctgaatagcttcactgtcatatcagtatgaactgatgataagcagtttatgtataagtagggaagtatgccatgaaatgcaacattacaaactcttagaatattctatagctgattcaattaattgaattttgccagatgttttaagttgctagaatttggaagagctgtcttgtgtagaccatcacctttgtgattgaaagaatccattgatttatcattacaagccatatgcagagaggcctgaccagtttttcttatttaaaaaacaaaacaaaactttctttagatggggggtgtcactgtgttgcccaggctggtctccaactcctgggtttaggggaccctcccatctcagcctccagagtagttgagattacaggcatgtgccaccatgactggctatattttaaaaatattttaacatctgaaaataatgatttgatattatattacattagaaattcttttttttaaagtggggcttatgtaaatttttaattgtgctaaaatacacataacataaaatttgccattatgcgtttttaagaacacaggtcaatagtgttaagtatattcacgttgttgtgctatcagtctccagaacttctttatcttgcccaactgacattctgtacccgttaaatcacaattttctattctccaccccatctccagtgcttggcaaccacccttctactttctgtttctatgaagttgactacttcgaatacttcacggaaatgaaaccatccagtatttgtctttttgtgactggcttatttcacttagcatgtcctcaaggctcatctgtgtgatagcttgcatcagaatttccttctttgttaaggctgtgtattgtgtatatacagataaccattcctccattcattgtttatccattcattcatcagttgacacttgggttgcttccacctgttggctgttgtgaataatgttgctatgaacatggatgtatagaaatacctcattattcatgaatttttttgttcaatgtgtaataacaagttacaacttttttttttaattaaatgtcttcttttgagataattgtagaatcacgtgcagttgtaaggaataatatagggattttatcatatgcataggtttgtgtattgcatcacctccaggatccttgtgttctcgtgcccccgctgtcttcatgttgcccttttataactacacccacagccccaagccctggaaaccactaacccgttctccatttctatcatttcatcatttcaggaatgttatataaatgaaactgtatcgtgtgcaaccttttgggattagcttttttccactcagcataatgccttggagattcatccaagctgttgtatgattccattccacttcattgctaggtaacattctatggtatggatataccatggtttgtttgacattcacccattgaaggaatttgggttgtttccagtttggggctgttaacacacacagtgctgtaaacatttggatacatttttttttgtttgaacctgagcttccatttctctgggataaatgcccaagagtgcagttgttgggttatatggtaattgcatgtttagttttgtaagggactgagactgttttccacggtgtatgatcttatttatgatccagattctctacatccttgccagcatttggtgttctcactaatttttattttagccattgtgataggtgtgaagtgtagaaatattttctttttattgtgtgttaactgtgtgcaacttgttaagcagcccatctctagaactaaagccttaggaaacggtagctttgtacccattcgagcaatgactcctcattcctccctcccccagcaatcaccattctactttgtctctataaatctaactgttctgggtacctcatatgagtggaatcatacaatatttgtccttttgtgactgtcttatttcactcagcataatgtcctcaaggctcacccatgtcatagcatgtgtcagaatttacttattaaggtggaatcatattcagtcatgtatacacattcatgtcacttaacaacggggatgtgttctgagaactgcatccttaggcagttttgtcattgtgttaacagtgtacttaaaccaacttagatggcatgtactaggcttaggtgtaagcctagtacatgccgcggctatatgatgtgttgcctattcctcccaggatacacacttggacagcatgttactgtattgagtactgtagataattgtagcatgatggtaagttgtgtatctaaacatagaaaaggtacagtaaaaatacagtataaaagataaaaaatgagcctgggcaacataatgagacctgttttctacaaaaaagttaaaaattaggcgtggtggcatatgcctgtagtcccagctacacgggaggctgaggcaggaggatcactggagtcaaggagtttgaggctgcagtgagccatgatcacactactcagtccagcgggggtgacagagtgagaccttatctcaaaaaaaaaaaagatgaagtatgttacacctgtttggggcacttagtaatttattacctagtattatgtagtatacctaagtatgtgtgctatacttttacacagctaggcaacactataggtttgtttacaccagcatcaccacaagtatgtgcataatgcattgtgctatgacattatgatggcaacagtgtcactaggtgattagaaatttttagctccattattgtcttatgggtctaccactgtatgtgccatccatcgttgactgagacattgttatgtggtcatgattttaacacatttcctttatccattcatctatcaatggacacttgagttgttcccaccttttggctattgtgaataatgctgctacaaacattggtgtacaattgatattcaagtccgtgctttcaattcttttgtgtatgtacctagaagaggaattgctggatcatgtggtaattctgtgtttaattaatttaatttatttatttttttggaactgccaatactgttttccacagtgactatatcattttacatttccaccagcaacacaagggttcctatttctgtactttctcaccaacacttgttgttttgtttttttttaataatagccatcttaatgggtgagtgagccaagccaggagaatcagagcctggccaccagatctcttctccccagtgacagagacctgaggcagtttctttgagtcagctttatagtttctgaagaactaacacctgatttatggctactttttggctagtccagatgtgttacacagttgctcctccttttgctaacaggcaaagagggagggaataaagtctgctgggtctatcagttagcagaaaaagattgggagtatccataagcatttctaccttacttggtatcacctgtgaggttggtcagtatcagggaattaagatgaccccgtaccagagggcttagggaataatatgtttgttctttttcttttgctgatacatgtttccggtgtttttttcaggctgaacattgccatcttagttatttaaaatggtgctctcatatgttcattgcagcattatccatgatagtaaagacggaatcaacctaagtgcccatcaactgtgggttggataaagaaaatatggtacatatagaccatggaatactacacagctataaaaaagaacaaaatcatgtcctttgcagcaatatggatgcagctggaggtcattatcccaagtgaattattgcaggaacagaaagccaaataccgcgtgttcttacttataagtgggagctaaacactgggtgcacatggacataaagatggcaacaatagacactggggactcctagagggaagagagacagagggattcaaggactgaaaacaacctgtttgctactatgctcgctacctgagtggtggggtcagttgtaccccaaacgtcagtgtcatgcagtatgcccatataacaaaccccttaatctaaaacattgagattattaaaaataagagattaaagatatttttaaaataaaaaaaggtatatgccaaattgtatgtgtatgtttgtttgtatgctaagcaaatgaaacacctttcaaaatccatcatggtacttagacttttttttaattcctctacagacaaagaatagaatctaaagtttgtaaggcagccatcgccacattttatgttaatgttaaagaacaattcatcaaaatggtaagctcacggacatgcatttgttggtctaaggtttttttcactaatcctgtagcagcatattgttgtcttagaaaagcttgcatttgctggcagtatggtaataaactcattagaactattcatattccacataactgtttttaaactaaatgtgacacatgtgaaactaattaacatttacttttggaaactgatgtacatgtgtattttttgttttgtgtagcttaaagaaagccagatgttgacaaatctgaaaaggaagaatgctaaggtaaattatttatgtgattagagtcatagagtcaaacacaatactaatgtagagttatgcgaagacttgactctgggtttacagcctttagagtgtgagtagatttcataatcttgtcaggcttttatttggttgatcttgtggttgatacggttggtattattaatgcaaggtaaggaatggggatcctagtcacttttgtttcctaaggctgcacgagtgtcaaaataattgtttttataattaaagacagaaatttaagccttttattaatgtcacaaaggtagctttaaaaaaactacccagtccaaaatgaccacttacatggataaatattaatatatatttattgcttttgtggatgtcgaaaagcacaaccttttagaataaagaactgtcccaggtaggacagcctgggaagaatactgggttaagggtcaggagacctcatgtctagtcctggttctgctgcttcattgctataccacctataagctgtataccactgggtctgcagtgggtgacaagccagccagcatgagagtctcctttgcttacctggaaatggttggaccaaatgacctctgagcatcagaggtgaatccaggagtggaagtccacctctacatttaaagtagaagtggacttgaaatacatacgttttccttccagtgattgcaagctctgggatgtttttgtttttcagttttaatctcttattggtcatttctgcattgcttattacggagtgggaacattatgaatgtctaacaatggagaattaggtagtcactaaaagtgactgaatgtccgagataataaaatatgaaatatttcttttaaaatacagagtggatcacaacactcccctgctttgatagtttcctagtatgcctagataaaatctcctcactttacaggtcacagggtccagtaaagacctggcccctgctttccttcctctggtcattctgaagtagatacccctgcttttcttttccagagttctctcttcttttcctacatatcacaagctgtaaatacatactgtttctatgtaatgtctgtcttccccattagaccaaagtctgtgatggtaagaactgggtctgtcttgttttccactgcacttcattacctggcagcttatgtggcagtgctcaaacagttacaaattaattttaacacaaatgattgtgttacttagatgatttcagatatcgaaaagaaaaggcagcgtatgattgaagtccaggatgaactgcttcggtaagatactgtcaaatcctgtttgagcacttacctaaaaggatgtaatgatggtgtgtcatttaggggagtgacacttgctgctgtgatgtattaaagccccaggttatcttcaagctccgatactcagtgaaggcagggtatgctgcttagttgccccaccttttgacaaaggagaattccacactgatctatctccacagatttctcagctctggccttaagagatataatgcctagattctagaattcagctgcctgggttgaattctagaatctacacattaaactgcttgaactgcttgggttgaacccaagctctgccacttactggctgcgcaacattgaccaagttatttaatgtcccagtgtctcagttccctcttttgtatataggcataataataatcatacctatacttcacagagtgttgtggaaattaaataagtacatatatagaaagtgcttcacagggacaggcgcacacagtaagtgctgtgtaagtgttgacaattgtttatgttattgtcgaagggtatgccttggagtgacatgcatgtgaatccactcccaagtgtgggccaggtgaacttaccaggccctgcaggccagggctgcccccagtttctggttaggaagactggagtgcacatcagctgtcagcccccaagtgtgttttgaggccagggctgttgtgagagctagaggcttggtagtaaaacagtgctagatgtggtgtctgctcctgagcttaaaaatagcttgagaaagacagtgatattatcagaaaagaatgtgcataatgaaaagttgaaacttttaaaaactcactcaaaactaagttttaaaaaagaggctgctaggccgggcacggtggctcacgcctgtaatcccagcactttgggaggccgaggtgggcagatcacttgaggtcaggagttcaagaccagcttggccaacatagtgaaaccccatctcaaaaatacaaaaattagccgggtgtggtggtgcatacctgtaatccaagctactcgggaggttgaggcacgagaatcgcttgaacctgggaggcggaggttgcagggagccgagattgtgccagtgcactccagcctgggtgacagagtgaaactgtgtctcaaaaaaaaaagagagactgccacaggagtttaagtgggagaaagcagttgtctaatctgttggtttctaaattgagtctctggacaggtgctggcctatggtaaggttttcactgacccaggccaaaataagaaaactaaaggtaaatataatagggaaagctaacatttacaagcttcctgtgtggcagggcactttcctaaacgcttcctatgctaactcatcatcatcacagtcctatgagataagtggttatagctacagtcaggccgtgcctggttacacttgtcttcggtgtgagactactgagacaagtttattttatttatttatttatttatttatttttgagacggagtctggctctgtcgcccaggctggagtgcggtggcgctatcttggctcactgcaagctccgcctcccgggttcgcgctattctcctgcctcatcctcccgaatagttgggactacaggcgcctgccactgtgcccggctaatttttttttgtatttttagtagagacagggtttcaccatgttagtcaggatgctctggatctcctgacctcgtgattcgcctgccttggcctcccaaagtgctgggattacaggtgtgagccaccgcgcccagcctgagacgtgttttaaagactgacttttgtttcttttctagatataaatttagaaattgagaagtgtattttgaaaaggcataataaaaaaacctatggtatataattattttaacttgccatatgaaaacctaaggcacagggaggtaacttgcctacggtgcagccctaggaagtcagggagccaggattcactgtcagctgactgactccaaatccagcactcctgaccatggctgccagttcagtagtgagttttccccagcgctgcatttgttcagtgtaaagaatcgttaaagaagacttttcctggctcacgcctgtagtcccagcactttgggaggctggggcgggtggatcactgaggtcaggagttcgagaccagcctggccaacatggtgaaaccccgtctctactaaaaatacaaaacttagccgggcgtggtgtgggcacctgtaatcccagctactcgagaggctgaggcaggagaatcacttgaacctgggaggcggaggttgcagtgagctgagatcacgccactgcactcccagcctgggtgacagagcaagactctgtctcaaaaaaacaaacaaaaaagacgtttttatgaaattatattagagaattgtgttttatatctttatttggcaaaatacaaaatttgccgcctttgcccctcatttttttgttggtccataaaacccaagttatccctttttattttatagatgaagaaactcagccactgagagatgaaacagtttgccccaagtcacacattttcatccaggcactgacagtcttccactggttttattagactttggaaagtggacaagatttgataagaggaaggagcactgggaaggctttttctccatggtttctgtgttagactgtagtgcctggctccgctggtgcgagcctctgaatgtcaaccaggcatacatttgatccagtagttcccaagacttgaacggcttgatgaatttcagcatttataaggaatattcttctgtggatatcactgctaattattcattgtgcattgtatttcagagattttttttcctacattttaaactgaaacccagaatcttttacacattcgtagtttcagagccaaagcaagtcatctagttggccagccccggttcttcacactcgctcagcgtacttacaacctcagtttcaccacgataggctggtacattttattatttgtcacttatttttgttttaggttagagccacagctgaaacaactacaaacaaaatatgatgaacttaaagagagaaagtcttcccttaggaatgcagcatatttcttatctaatttaaaacagctttatcaagattattcagatgttcaagctcaagaaccaaacgtaaaggaaacggtaactccaattttactttttaccatgcttcagaagatgattgtgggagggcattttcatgctagagtatcagaagctttggggaaagacaaatgcagatacagaattacagagtccacctaaaatagtatcactataagccagtgaaacttcattatatcagcacttttcttagctacttaatgaaggctggaggagtaatgtctagaattgctgattgtgtaaggtattttcactcggacagctgaatttcatcaagggaagtttttattctgtgtataaatctcaattgaaaaatcacactctgctgtattacagttttcattcatgtaagaccactcagccatgttcgaaagaccagcctcttctgtttggtctagcccatgttcacggcatcttttgcatatgaaaaacaagctattttcccgtataagtggtaggtaggattttagaagttaagaaacaggccgggtgtgatagctctcacctgtaatcatagcacttcgggaggctgaggcaagtagatcccttgagcccaggagttcaagaccagccttgggcgatatggtgaaaccccatctctactaaaaatacaaaaactagccaggtgtggtggtgtatgcctgtagtcccagctactcaggaggctgaggtggcaagatcgcttgagccctggaggtccaggctgcactgagctgtgatcgcactactgcactccagcctgggtgacagagcaagactttgcctcaaaaaaaaaaaaaaagttaaggaacattaaaaaggaatataatgggaaaacaagtttattgttttaatacattttgtagttgcttctggatttttactgcagactttgctactgttatgccatctgcctcagattaatagaaatgtttaagttctaggaaagaaatttgtatttgtatgccctaatataattttatataatatatatatatgtaatgtatacatattttatgatcagatttgtattcacttctaaattcaatgttaaggttttgacactgatctaaattaattttcctgagcctaaggtttgtgtatatattagagatccagaaatagaatgcttttaaaggtatttttttaattacctaagtagtccaaagcttatgatttggagtttgttactaaatttgggcaagttatctgtagcattgattcagcttgaacataatactttggttaaaagcgaggtttagtgtctctgccttgtttggaacacaccacctgatgagcgtcctgttcttagagtgagctcaatgccttcttgcactcctcttgtattaactgtcccttttgccttattaagtgtagatatttgggcatatgtcttactctaaacatttagtgacaaatgtgacttcttcccctttattcctccctagagcaggtgcccatgggagcttgaacacattagtttgtcaaatatttgtataaaattccattatcatgtgtgtggtagtcacagcatgacaccttttctgctgtcatcttgaaaacatgctattaaacagcaaactatcaaagtatgacaaaattctgtaagaggaatttaatcatgcacccttagatacaatttgcaactggaagtttgactttgttaattatttcaaaatcatgagttggatattgtattttatgttgggtttgtattctaattttaacatgaatcattaagaacatttggattggcagcctttgagacatttaattgattctcccaataaataatttcttgagatgatagatttgggttttcttttttccttaagaacttttatggatctggtgttctcattccattagttatttcagttaaagtaaaacctgtcttacagttttctgtgttttaaaatagacatgatatcaagcagattctacacagcacgagcagacctgcccaaaccaagccttgacatgtcccagatgtgatttcctgtctccagtaatagagatgatacaattctttgaatcagctggtcttctgggataagaagatcagttcaagctttgcagagcagctccctagcaactttgtgatcaattatattctaagggaaatggattaaaaccaattgtcttaatggtcctagttaaaaatgagaggaggagtagttaatggaaagctcaatcaaaatttgcattagtcataagattgggctatctaaggacaaggttatgagtttttgatattgctaattatataattttctttcaacagtatgattcatccagccttccagctctgttatttaaagcaagaacacttctgggagccgaaagccatctgcgaaatatcaaccatcagttagagaagctccttgaccagggatgagaagagcagtctactaaaatgtgcctataggaagactagtctcatgctgttaccttctgaaactgtacctttataaatcaattgttttgcaaagaagttatggcctacttagaatctaaaatttgttattcaaattaaatggctgtgaacaatgttaaatagcatcagtttgtccaatagttttaaaggccataatcatcttttctggttaatatcttgagtaattttaaaatgttgacaccttaatcggtcccaggtatgagctataataaacttgtaaaattaagttgatgtgaacataattttgattaattaataaggcgatttctcctgaatttacaccaaagctaatttttaatgaaattggtttacagaagtaaaaaacaaaaattggaaagcaaagtaataaaacttagtttatataaacaggttgaatgatatatttatcaaatctcacagacatcaggcaaattatagcctggtgacaaaagtgttcatagtgaattagttactcttgtaatacttctataattagttcatcaggaatttcatccacttcactgttataactgagaagactgttctctgcagcttcagctaattcagcatcttcagtagcttctaaaaaataagcatcatcaatgccattatcccagacagcatcagcaga

SEQ ID NO: 603 - DNA, 496642 bp, Homo sapiens
ctccagccccgccgtcgagtcgccctcgcctcgcccgcaccatgatcgccgcggctttcctcgtcttgctgagaccctacagcatccaatgtgccctcttcctcttgttgcttctgctgggcaccatcgccaccatcgtcttcttctgctgctggcaccgcaagctccagaaagggaggcatccgatgaaatcggtcttctcgggtcgttcaagaagccgaggtaagacacgccgcgacgggtttctgcgggctaccaggaacaattaagccgatttggagagtgaagcgcggctcgctcccttctcctcggctgcccctagccccatcattgcccactccccaggctgagtgcgtttctttaacgccccttgccctttttgccgtcacctccgccctccagtctcccaggtttgaataaccacggcgatgccgagggcagggaggggaggaaagaactcaaatttttagtcagtttgctaaagccttaagggtaatttgagcgtagtccggggctgcgccagcctcgccttcacgcatccttcgctggagcgtaggggtaagaaagtaaggcatggaaacttcggggctccccaactcccccagaactttcatgcaaacttctcgcggagaaatcacgtagagaccgatggccccaggactcctcctccctcccccaggatgtcccaccgaattccaggagtctgcgatgtgctttcccaaccctggtctcccaggtaagtcatgagtcactcggtaggtgaagaacaaggagttaaatgaagtctcatttatctcttttctccccagatgctgttttgagatcgcaccactttcgttctgaggtaatttatttagcgcgcacgctcaaggtcagaagaagttctctttcctgagtaccaatattaattatatgcgtgttaagaaaccagtaggacactgaatgacgaacatgctgtcccctagccgaaagtggcatgtttccttttaagtgatttcatattagtgcccagcgaacggttttagcaaatttcttgtgtagtggagctgttgtacaagaggggaaaaggcaaaccctaaaagtgctgcagaccttaaaaaacttagccacagggtggatgtcacttgagtttacagtttatattttgctggtggaagtgttttctgggtgctgtcagttgactctggttgttcacttggataaacgaagaggttagtgcagaacaatttgatccatatgcatttcattttcgattttcaagtttacatttctgttttctcctaaagctctccatgttttattggggaccatctgatgatttttgcaaagcgatgatggtagtgtgtgcttaaatgcttgtgctagtctccactctcaaaacgtggaccatccctctagggcaagtaactcctaatcactgcacccaggaaccagctccactgaagaaacacaagcgctccttgacctaggatttctttaggagttttcaggccaacctccacttatcctaagataatttcccctctttttaggaaagttgcacgccgccaggcttggaggttgctgcttggtgcagtttactcatgttggcaaagacttcatagttaaacgccctccatttacctgaagttatcttgcctttcatttcattagttaatcagatattttatgccaccctagatgttttattgggttctagttgcttaaaaactttaactgtattattgcaatatcattaaaatgttgcacaaagagtaattctactgtatatagccctggaaggtgagaactctattcagtttaggattcttgagaggataagtgaggtaatcagaggttccattcctggctttacattaactagctgtgtgatacatctcggtgcctcgatttacccatctgtaagatagggccattagtaccttgcagggttatgggagggtggaggaaattacaagaaattgtgtaaagaaaaatcccacttagttcataataagtattcagtatttggtagctatcattatattttgtaaaattgaattttaaaatgtataaaaataaacgataatgtttgcaaatttccaagtctttattaaattacttaattaaagtttatggaaaacatcaaaaaccgggactatcgtaaagcaacaatttttgaatatgagattaattcaatagaacagcccattcagatgtgatgagaagtaaataattgacagagtgcaaacaccaaaatataagattttgattttaaaaagagatacccagttccacacacataaatgatagaacaagaataataatcctgttttggattattatactagccatcagatatttcagctaaagcacaaacaaaaaatgagatacaactatgtcttgtttaattatctctcagttgaatatttttgttctgagcttgcatttggttaggaaagctgggggtagttgtttaatgccttaactcacttcataagattcctggtacagtttgacatctttgtgtggtatttgccttgtctactagactgtgagctccttgagggcaggaccatatctttcttgtttagggctgtatccccactatttggctcagtgccttgtatacagtgggttattaataaatatttattgaatgaatgaatgaaaaaaaaaatctcctagtgggtgctagttcctgaaactgggcaaatagaactcagagttgggcagaaaagaaaaatgcacattctcaggacatcgctcagaattcaacatttgctaaatctcaactcttactggatctttgcaggcttttaaaaattgccctggagtttgtgctaaaaatgtaagtcacaaattgaaacaaaatggattcggtttgaatttttttctgaaaaatttaaatgcaatattagtttaatttgttgatgggctacccatcagcaagctgttttgataaaccactcaaagaatgccatttataagtgaaaattatgggactgtgttgcaaaagaatgtcatgtttcatcactactttgcttacataaatgaaatattttcccttaaggaaaacatagggaatatttttcttttctcttttctatcaagatgccattttctgcaagattttctctttgagaaatacctctgaatttacttggttttaaacatattttaaaaaatagaatttgtgtagcataatgaatattcttgttgctttttagtagtagctgctgcaaaataattattcaagaaaatattttgatttctgacaaatcatagtcatattgaactaagaatttagtactttctgtttctccttccattctcagtaagtagattaactcactttcagcatttctaccatggtcaaaggaggaaaatgagtttaggatctgctgactcactttgaaccatgaaaaagctttgggctagcccttgtacagatgaagaagttcagtgagtactttgatgctctacttggcagaatgtattgcttctggtacccacacgcccaggaaggagtccaattgcacaggaagttttagccggttccttttcaggtagtcagagaaatactcctagagaaaaaatcatcgcaccaggactcagtttgctttgggaaagttctgcagtagggaaaaaagccaccttcctcatctgaggagctccagctattttctcctcactaagtatataataaacacattttttcagtttcttcctcatgaagctagaaataagtaatatagatgtttataataagttttggaaccataactgccaaccctttttattttcacatacttgcaaactttactagctttttagtagtcttctaaatgttcataaatagcatatgagaatgtgaaataattaatgcagctagcaaggcctgaacagtgtaacttcatttcagtaatagacagaaatatgtgttttatgtatgcatattaaacacttacacagtgtttttgttcttgttatgctaaacagctaatgaagagaagtgatttcacattgatgtagcaagacagtctagaaaccaagcgttcattctggtttctagaatcctgttatctaagaagtgtacttttcctgaggatttataatgctttatgctgtgactttaaataatggtaaactgttaccctagattcctgtggtgaaagtcaggctgtgacaatcctgattttaaggaaatttcagaaagtgatatgggtaattgaggtaccattagattataagaaagggtcttgggagtacttcagtagaatggagactattataatgccctttgagaatatccagagtgaatagtggtaaataatccctattcatgagctcagtggaataagggaagccttgtctgacataaggaaggagaagagtgtgttctatatctaccaatttttgagtaaatatctctatttcctgtttcaggcaaaggaaccaaaagagttaagcagttcccaaagactcacataacaagataaggactgagtaacacaagaattatctggctacgtattgtctgtcctctggtgttgaattgtgtcactcacagcccagagaataatatgcccaaaattttcactgaaagaaattgagtttttagttgacatttcttataatactgaactggcaaatcctttagtttttttccagtgattatgtaagttatcctaaatgaaacaatggtccacctaagccctgttgtcctcattatgttcctcaagtgtccctgtaccaaatcattggagaatggccagcaaaataaccacatttcacagcatctcattaaattttcatctttcattaagaattacctaatttagtggattagggaaagtgatagtttattattgagaaatcctttataattaggttatctttataaataaataatttgtctagagttacgttttaggtctaaattaatttacactaattaaatcagccataagttgtaagtgtgcacatgatgtagtattcactgagtgtcacccaattatttttcaaataaacacatttattttctctttctgtccaaagtactgtgttagacaatagggctaacaaagggttagagatggagcccctgcccttgacagttccttctaggtcactcccaatgtcagtgctgaaattttatagttactggttttttctgttatgctaactgaactgctgtgccgtttccaactatgaatcacaaatgcaatgagagcatcggaggctgctgtgtaaaagtgtacagccaatacatatgtaaaaaagacaaattaatcctattcacagagtttatcataccagagtcaacactaccatataattaacgctgactttagctacatggtgacaaaacacaaaaacaaaacaacaaaaacaaacaaacaaaaactctcactttttttcatgcatccaagccaattaaattcatctagattagaattgaaacaaaatattttccagagaagtttgcatctttatgtaatcttaaggctcaagaatgactctctttgagatctggatggcaaaatggaactagggtaataacaataattattggcataatgtaaggattataagaatatgagttcaaaattctggttttgggttctagctctgccacaaactaactgtgtcaccttggtcaagtctcttttgtcactgatacttagattttgtattatgactggtaatgtgagaatgatctctgatccccttccagaagtaataggccaagtatctactacatacaaagtgtcatgctgtagaggcaccatgaaaacatgattcctgtcttctaggtgcttaaggcaggtaaagaaaaaagcatcattagcgtaaataccaagtaacaaattatgtatagaaaaggaatggttggaatagttctggtgaaatggttgcttctagctcaagtggttagagaagccttccaagaggagtgatatttatgctgaagcctgaaggttgtatggtaagtacagtagtcccctcttctgtgtggttttgcttttcatggcttcagttacccgtggccaactgtggtgtgaaaatattgagtggaaaattacagaaataaaggattcataagtttgaaattgcgtgccactctgagtagcccgatggaaccctgagctgccctgctccaatcccactttgtcctgcccaacatgtgaatcatcccttagtctagcaaatacatactttatactctggccatctcagttatcaggtttaccgtcaactgtattgccacacttgtgttcaagtcacccttattttacttaataatggccccatagtgcaagagtagtgatgctggcaattcagatatgccaaagagaagccacaaaatgcttccttaaagtgaaaaggtaaaacttcttgacttagtaaggaaaggaaaaaaaaatcgtatgctgaagcttctgagatataccacaagaatgaatcttctatctgtgaaattgtgaagaaggaaaaagaaattcctgatagttttgctgtcacactttaaactgtaaaagttatggccacagggcatgatgagtgcttagttaggatggaaaagacattaaatatgtgggtggaagacatgaatagaaaacatattctgattgatggcaatgtgttgcatcagatttacttaattaaattacactttatcataggtgtgtttgtataggaaaaaaacatagtatgtatagggtttagtactattcatggtttaaggcatccactggggtcttggaatggatctgtggtggataagtggggtccactgtacctgagtagattcagagaaatgagagcaaaatcccaggttggtataagggcatgaggatagacaagatttaggaaagcacatgcctgttttcagagcttggtgtacaccagtatggttagagaaagggactcttgagattgcataaaggaatatagtgctggaagtagacataagtgtcagctataataaaaatgattcgtgtatactacatgacagttgacaaaaggctttgacataacattattttatttgaacactttaggagggcatctgctgtgagtcctcttaagagaagcaggctgggcgtggtggctcacgcctgtaattccagaactttgggaggctgaggtgggtgaatcacaagatcaggagatggagaacatcctggtcaacatggtgaaaccccgtctttactaaaatacaaaaattagctgggtgtggtggcgcacgcctgtagtcctagctactcgggaggctgaggcagaagaatcgtttgaacctgggaggtggaggttgcagtgagccaagatcgtgccactgcactccagcctggtgaaagagcaagattctgtctcagaaaaaaaaaaaaaaaaagagagagtagcaaaaaatcaccatttgatttcttttccagcaactataacaaaaccgtccaatcactcttctttcacccagggagaacaaagagttatggcctctgctgcagagggccttggaaaatggccagttgggggcctttctggtgaccccgaggctgagtttttgatgggtaccatatttttgaggtccaaggatcagcatcattgggttatattctgactgcagacaccatctctccagggatttatgggaacttgctcatgtgtttagtgtggtcattacaaattttaatatgaagtataataaatttgcaggtaattcattatgtaaaagacctttttattgactgaaatacattaaagtttttgaaagtatttgaaatgtatgtagcaacttttcaacttcttcctttaaaatttctctcctataataattattcctaaatgtttaccctcctatgaaatcctcaggcctactcccttaccttcagccagtgactttttatctcctgactcacaattaatgtatcaagtaatagctccttaaacttattgcacctacgaactaactggcatcttagccttccttcccagtccaatgaaaaattcatctgtcgtccacactgatattttatgcttatgttgtgaattcttttcttcccatcttgggggatattctattagtcatcccctccttctttatcctcaattgctccttctctgctggctcctttcccttacctataaacatcatatgtgcttcctattggaaataacagcaacagcacaaaacctccctatgtcaccaactcttctcttgacaagaaaagtttcctgaaaaagcttctttgttaccttctattcctcacctctcacttattcctcaatttaatctggcttctgctgctactatttagaaccactcacacttaggtcaccaatgatttccaaattgatatattgattgtttcagtctttaatttagttgatctatccagtatttgatactattggccactgattccttcttgatatttccttcctggtttctagacaacaccctcttaatcccctgcccctttctggccctggctctctctgtttctgcactgaatcctcttcctacttataacttgatattccctgtcttgggcctacttaaaagaagaaaacagctttattgagatataatttacgtaccatacagttcacccatttaagtgtataattaagtggtttttggtatattcacaaggttgtgcaaccatcatcacaatttaattttagaacattttcatcacccccaaaataaacctatacccattagcaattattccctattcccctccttccttcatcctttacctataggcagccactaatcttcattcttttttttttttaaatatggaatgcttcacaaatttatatttcagtgtttcatccttgtgcaggggccatgctaatcttctctgtatctttccaattttcatatatgtgctgcccaaccaagcactactttctggcaataggtttgctgggcctcatttttgcttatttagattttacttgtgggatctcaccatactcactgttttagtttatccccatatcatggttactctgaaatctgcctatcaaatttagacctcacttttgatctctaggttcagagtcacctgctttttcctcattttcccatagatgtcccattggcatctcaaactgaacatgtgcaaaactgaatcatcagtcttttaccacatcttatgcatctattttggagaatggcaatattctcacatccagtccccaaacccctgcagtttttcaaactaggaatatagaagatagaatagatggctccctcatccatcctgtcccatctgtcttctcttttaaatatctctggactctgcctttcgttgtattcccattgctgtttctttggttcaagccctataataagcctctggacaagtctctctgcatccccttccccaactcatccacaccaatttaataaagatcatttgaaaatacaaattaattattaaaacttctataagttatggagacattcagatttaagtaatagaaaacccaacttaaaatgggttattaataaacagggatttctattctctcataacaagaaggctagagatggccacaggctttgcttgagcagttctaccatgtcattttcagtatatttgggataatcttgtcattctcttgtggttggagaatggttggcacagttacagatatggtgtctaaattcaaggaaggaaggaagggaaggggcagagccagccatggttatttatcagaaaatctgaatatttgccagaagacttttcagttagatttctgcttacccttcactggccagaactgtcacaggccatctgtcactataaaggaggcttgggatgtgaggttttatcttttctagtgtctgtagtagaggtaggcaagggagaaagagttggggaatgcatatttctcccctacttaaaatccttcagtagcttcccacttctttcaagatcataaagttcattcttagtataatgtcaaagggttccttgtactgatgtcctgtgataggtcgagtctaccatttgtccacacttcttataattcttcaaacagaccatgatcttttaggattattgtttttgtccatgttatttccaactaagaaagcctctttctatttctttcctctcttttctcatacacctccaacaaaaacaaaaatactcaaaacaaaaaaaaagggtaactcttgctctttcttgaaagtccagttcataagttatctccttagggaaactttcatgactcccgcctcgtagtaacaatttagtgttttttttttgttattgtgagactcttaaaggcagtctaaaaccccagttcttagtttagaatctgacacatagtgaagctcagtaaatgttggatgaatgaatgaatatttgaagttttctacaagtcagtttcattctcaattctcatgaatttgctaacttccccaaatatcctgtatccctcttttccttaaggggaaagagacagatacttttcatattgtatcttatttttatttatttatttgagacagggtctctctctgttgcccaggctggagtacagtggcgtgatctcagctcactgcaacctctgcctcctgggttcaagtgattctcctgcctcagctgcccgagtagctgggattacaggcactcaccaccacgcccagctaatttttatatttttagtagagacaagatttcaccatgttggccaggttggtctcaaactcctgacttcaagtgatccacccactttggtctcccaaagtgctgggattacatgcgtgagccactctgcctggccccgtattttattttagacatatagttataccttacttatgtcttaccctgtgtttacttcatggatacacagatcagacactttagaaaatgagttgaaattggctgggcgcggtggctcatgcctgtaatcccagcactttgggaggccgaggagggcaaatcacctgaggttgggagtttgagatcagcctgaccaacatagagaaaccccttctctactaaaaatacaaaatcagccaggtgtggtggcgggccccctgtaatcccagctacttgggaggctgaggtgggagagtcacttgagcctgggaggtggaggttacggtgagctgagctgagatcgtgccattgcactccagcctgggcaacaagagtgaaaatctatctcaaaaaaaaaaaaaagaaaaagaaaaagaaaatgagttgaaaatatccctgacttttttttttttaatttaaaggactttcatcctttgagagttttaaatcaaagtttgatatttaatgtttgtatttcaatttgtaatctaaaaataattctgaattatttcgtaaccattttaccttataaccagtactgtcatccaattccagttcctgaatttgtgttttacttacagtcacattagtgccaagtggtattgctttaactgtcataagcttaaaaggaaagatttgaggcaatttttatgtataatttatgcattaatgccaaatgagagccaaatgctgtgctttggtaatctgtttaactgattttgagaaatgtggtggtatatttgaataaagagcgtcagaaatggcaaatattggaccggatatggtagctcatgcctgtaatcccagcactttgggaggcagatgcgggagaattgcttgagctcaggaattcgagaccggcctgggcaatatagcaaaaccttgtctatacaaaaaataatttaaaaattttgtcgggcatggtgatgtgctcctatagtcctaactacttgggaggctgaggcggctgactgcttttaagcccaggagttcgaagctacagtgagccgtgatcataccactgcactctagcctgggcagcagagcaaggccctatctcttaaaaaaaaaaaaaaaaaaaaaaaaagagaaatggcaaatattagagtaaatataaagcacaaattataacattgtcctgtggggtgtataaaatatatagatgtttgacacctttagtgtaaagaatggcaggggagtaatggaattcctatacatttgcaaagtttctacattttatgtgaagtggcatattaacttaggtagaatgaaaagttaaggatgcatattttaactctcagagcaactaattaaaaaaaggaaacccaagagataaacccaactagaacttctaaaacatatccaaatgacctgaagaaggcaagaaaaagggaacacaggaacgaaaaaccaggagagacagattgaaaataaataataaaataatagacctaaatctaataatatcaataattacattaaatattaatgggccaaacactccaattatgagacatagatgaacagaatcaataaatagcagggcctaactatatgctatttacaagaaattcactttaagtataaagacatagactgaaagtgaatggatggagaaaatataaatgatgcaaacaataatcataagaagattagagtggctatattaatattaggtaaagtagataatcaaggcaaatggtattaacagagacaaagagggatgttccgcaatgatgaaaggaccaatcattctggaagacattatcataaatgtgtatctaactaatataaacctaacctcaaaaggtatgacataaacatttcaaaagtaaaggcggaattagacaatgctgtaatcatagttggtgatcaacagagtttataagcatacctctttcagcaattgatagaacatccacacagaaaatcagtaaaaacgtaggtaaagagctaaacaactctaccaactatcttgacctaactgatacttctagaaacaccacactcattggccaggcacggtggctcatgcctataatgataacactttgggaggccgaggtagtaggatcatttgagcccaggagtttgagaccagcctgggcaacatgacaaatccctgtctctccaaaaatacaaaaattagccaagcttagtggcatgcactgtagtcccaactacttgggaggctaaggtgggatgattgattaagtctaagtgggtgaagttgtggtgaaccatgatagcaccattgcactgcagcctgggtgacagagtgagaccctgtcttaaaatgaataaataaatatttgtaaagaaacaccatacttacatgactcattcacgaagacagactatattctgggtcagaatacaagtcacaattaatttaaaggattgaaataatacagattatataggaatcagtaatatctccaagaaaatctcaaatatttataaattaaataacattcttctaaataattcatgtatcaataaggaaaccataaaggaaatttaaaaatattttaaactaaatgataatgaaaacacagtatctcaaaattgtggggtgcagccaaagcagtgctcagagggaaacatatagctttaactgcttatcttagaaaagaaggaaagtctaaaatcaattaacaaagcttcaaccttgagaagttggagagggtgttggggggaaaagcaaactaaacacaaaataagtagaaagaaggacataataaaggtaagagcaaacatggatataattgagaagagaaaaccaaattagactcttagatgaacaaagtttataaacttgtagctagactgatcaaatcactggtatgacaaatgaaagagagggtataactatggaacccacagacattagaagggtaagaaaactggttgcagtggctcatgcctctaatctcagcattttgggaggctgacgggggaggatcacttgagcccaggagttcaagaccagtcttggcaacacaatgagatcccaactctccaaaaagagaaaaaaaagaaaaaaaaaagccaggcacggtggcttgcgcctgcagtcccagctactccagaggctgaggtgggaggatctcttgagcccaggaggtcaaggttgtagtgagctgtgattgcgccactgcactccgccctgggtgacagcaagaccctgtctcaaaataaagtaaataaaaagaaaaaaaaaaggataagagaatatactgtacaacttgatgcccacagaagtgacaaattagattaaatggattttttttgaaaaatataatattaacattgctacaaaaatgtaaaactaagatggcttattattatgaaattactttgtggattcctaaaagagtcttgtggtccagaggtttatggaccacattttgagaattgctgctttagatgggtgcaatttattttatgtaccttgtatctcagtgaagttggttaagaaatatatatgtacatatttttatatatatccataaaaatatattgcataaaaatgtgtgtgtgtatatatgtatatatgtgtgtgtgtgtgtgtgtgtgtgtgtgtgtgtgtgtgtgtgtgtatgggggtaatgtggaatttattttactttaagaagtttctgtcattttgagtgtataaaacattacctgacagtatatttaagactatgacatttttgatagtatgattgaaacttttttttattccacttctgctagacttatttatataaaatttttttttttgagacggagtcttgctctgtcacgcaggctggagtgcagtggcacgatctcggctcactgcaacctccacctccctggttcaagcgattctcctgcctgagcctcctgagtaggtgggattacaggtgcccgccaccacacctggctaattttttgtagttttagtagagacagggtttcatcatgttggccaggctggtcttgaactcctgacctcaagtgatccagccgcctcggcctcccaaagtgctgggattacaggcgtgagccaccacgcccggctgcttatttatataatttttattggaagagtaatctatagacatctataaaaataaaataaatataaaaaagaaataaaaaaatgcaaaaacagtgaaaatggtttgaccaacttaaaaggacagcagaaaatttagaaggaaagcctagatataaggggaactttctaatctttatgtaagtaatttttcttatcgatttatgtttatctgtagctctttatttatctatccccccatctgttcattcacgtatccatccattcatccaaccatccttcctccttgtgcatattgtatcatgccttagaactactctcataccaagatcttgaattctgccatgtccttctctgatcatacctgcttctgtctctggaccttattgtgagctcttaatgagtttccttcttaccttcgtcaggaccaaaatcttctttgggggtcagtctgtcattaccttcttatttaatgtcacttggcagtctgctcactatagacccttggaccaacagttttgagaaactttgttattctcacttcactcatgcaattaattagtccttctgccacagtgactttgccaactctcagacttggtgactgcttttctgttcttgtgcctgggaggcatatccttattggacaacttcacaaaactcaaccatttgattcattatgctgtctagcagtcatcactgcccctttgtagtgtatcaattagctgcttctttgtaaccatttaaaacttagtaacttagacattaatcatttatctcacaattccgtgggttggtgatctgggctgtgcccagttgggcacttggtctggtctgagtcaggcttggctcatcacagctggaagtcacccaggtatctttgatgagctctggctgactcatggttttcctctgcatggtctctcctcttccagtaagccaactcaggctggttcacatgtggttaggtttgggttccaaaagcagcaagagtggaagtgcatgaggcctcttgaagtctggaatctgggcttgtacagtgcctctgctgacacattgttttggccaaagcaagtcacagtgggtagagaagagtcctgataggaggagttacatagtattgtggccatttttgcaatctaccgtaggtaatcttttgatttatttttggtttgctactgtctgctatccctaaagtactcatggtaagctttttctgtttttttccctggacagtcttttccaatttcttggctttcatatgtatggaaattacttctaccagacgtttttaggcccaacttagtttttcaaaaatttcagactgggtgctgtggctcatacttgtaatcccagtgctttgggaggctgagacgggagggttgcttgaggacaggagttcaagaccagtctgggcaacatagtgaaacaaaaaataaaaaaattagctgggcatgatggtatgcacctgttgtcccagttactcaggaagctgagataaggaggatcacttgagcccaggagtttgaggctgcagtgagctatgatcatgccactgcattccagcataggcaacagagcaagaatctatctcaaaaaaatttttttttaaacatatatatatatatatatatatagagagagagagagagagagagagagaaagagagagagaggtgtaatttctagttttagaatatttttcgtcatccccaaaagatttctcatgcctgtttgcagtcaatctctgttccaatccctaaccccatgctgctttcagtatctatagatagtgcctctcctggacattgcatataagtagaatcatataatatgtagtctttcacatctggcttctttcatgtagcttaaggtttttgagatttgtccatgttgtagtatgtatcagtagtttgttcatttttattgctgaatagtatttcattctgtgaatataccatacttgatttatccatttaccattgatggacattggcgcttctccctaatgattagctattacaaatagcaccgctgtgaatatgtgcttaaaaccattgtgtggacatatattttcatttctcttgggcagatacctaggagtaaaattgctaggttgtatggtaagtttaatttttaaagaaattctccagttgtttttttaaatggctgtacaatttaatattctcatcagcagtgtatgtggggtccagtatcttgacatccttggcaatacttgttactgtcttttttactatagctattctattggatatgtagtgatagctccgaggtttgatttgcatttccctaaagactaatgatgttgagcatcttttcacatgctttttagctattcatatatcttctctggtgaagtgttcaaatcttttgtccattgtaaaattgatttttttttcttattgaattttaagagttctttatacattctggatacaaattctttaatagatacatagtttgcctatttttatggtctgtggtttctcttttcatttacttaatggtgtctttttaagtgcaaagttaaaaaattttaataagtccaatttatcaattatttttctttatggattatactttggtgtcatttctaggaattgtttgcctcatccaagataataaaataagtttcctgctgcttttttttcaaggcaatttagttttggttcttacatatagttttagtttttctgtgttttttgagtttgtaaattgctggtattagttttttaaaaatatttggaatatttcaccagtgaacccatttggagctggtgttttctctgtgggaagataattttaagttgttaattccacttctttacttttatgtgcctattcagattacttttcttcttgagtcactttggtaatttttgcctttctaaatggttcatttcatctaagttatctagtttgttggcctaaagttgtttctggtattctcttctgctctttttaattctgtatggttgatagtactttcggattccctttttgtttgtctagccaaaaagttggggcttttgttatcctgtcctgttgcacacttctgtgaccgcacttgcatccaggaaggaagataaaaaccaaacgtaaaggaataggagtttgccctgcctgtggtattgtttaggggctgtgagaaaagaaaaaaaaatgagtgatttctgtactttctctgagtcttaagaattgtccttctcacctcgctacccagaattagggcactttttctggagctctgtatctgaacatcagtacccatttctgggtttcaggctgcactgctgcattgcattcggtctggagaataatggaggtcaaaaatggcaaactcaccactggttttcatatactttgaattttggcctttttacttcaattggcctgctgctgtttacgtttcagaatcctcaagtagctgctcaatgcattctattcagttttacagctgcgttcaatgagagacatgcttattctactttattgtaaatgggaacacgaactgactttaactagtctgtcctccatccacttcaagcttgttacttttctctttttatttatttaccctttagaaaatcttgtaggattttgacagttggtaagatgatgctggtagagatgtgtattgctacatataactcatgaaatactgaagattccatttattttaccattatacaaattttttaggaatcaaacatcaatagattattcattttggaaaagtttcttttcttatttttttggtccaatctcattattctttttgtttttcttttttctctttttgagacagagtctcgttctgtcaccaggctggagtgcagtggtgtgatctcggctcactgcaacctctgcctcccgggttcaagcaattctcctgcctcagcctcctgagtagctgggactacaggcacgcaccaccatgcccagctaatttttgtattttagtagagacgggttttcaccatgttggccaggatggtctcgatctcttgacctcgtgatccgcccactttggcctcccaaagtgctgggattacaggtgtgagctaccgtgcccggcaatctcattattctttatattttctgcatttgtctccaacttctgtacataaaatagattgaggttaaagaactacttgcagattttaaagaaaacaatatgtatcacttcatatttactgatgagtttacaaagagtagaaatttcacattaagaagtaattaagcagtagaccattaacaagttttaaataactaactgaccaactttgaagaatcattaaaagaacattaaatagtatattcctgctactgcccactctgcagtgagctgcacgcagcaggcagcaggcagttgcgagcatttcagactgatctagagtgtgactgcctcttgttttaaaaacggttgtggggcatcccaaagtgaatcccaaatacattcttaattgtttagactctcttgaaatatttggattacctagctgtatgtctgaatcatcagctgttctgggtgggagataaaattgggaaattttggctggctactgctatattacaatttctctagaaacttcagttaataatggactcaagcatgccttgagctgttcgccgagaaactatggcaacgggccttttaattaaagctgaagtagtgtgtgtagcttaggaaaacggagatactgccaattgatagggtgacagtatgggaatcatccatgaagctaacaagaaatttctttttagatatatttagttaactcttttttacctaagttgctcaaagaaacactagtaaactcttttagtggacatcaatatttggctttggaatatgttacaatattttttaaagaatatatagcttcctaattttttttaagaataatattaaaattattttgtgttttctgagtatatgttaaactgagagttggaagttattggaagggtcagcctagaggcatccttaatgtcagagggcagccaatctgagatagttcacaaaaccaatgatctctccattttggtgatggagacattagtgtgccttaattctctctctccatgtcatattctctctctctctctcccctccttctctctctctcacgatatatatatatatatatatatatatataatataatatataatatgtatattttatatgtatataaaagtgcactagtgggctgatgattgacaaattagtaaactgtccccctcttgagctaacgcatttccaggcagtgtgctggaatttataagcccagaccataacaaaagtgatttattattgttagctttccaaattaaaaaaataaaaactaagtagaaaagcaacagttgccattttttgagggtcaagtatgtgttatgctaacaacccccagtgatgggcagattctattagccctttggtaggggctgaggagggggagaatttgagtttaagtctgttgttttagcatcccatcttaaaaagtgtccctgtttgaggataaattgcagtcacctggtgaaggcaatcgctagaaagatgagtagcatctaattaaataaaatgttctacttaggaggctgagatgggaagatttttagaagccaggagtttgtgaccagcctgagcagcatggtgagatccccatctctaaaaaataaaaaatatatatatgtatataaaataaaacaaaatgtaatagtgacaaatgtaaaagcccttaagccagagacaatgtaggaattggctcttacaaaagcctgttatctggtttccttggctttgggtttcagttcactttttatgatactgttggcagagtaagctatctgaaataagatctgatcttccactccttttgcttaatggcttttctttgcttaatggcttcccgttgcttacaggataagtacaccctttcttggtatcagctcccacatacctctaatgcacaccttaaactcaaacaagacccagctgcttggttccctaccccattctgttttcatgccattgctcatgctggaacccctctattctacttttttgttgttgttgcaaactcccatttctacttaaaaatgaggattaaacatcattttcttcctttctttatctcacattcttcccttagtcttcctggacattctcccctcttgttattgaactgaactaactggggcctgctcacctggcacggtaaggccaaacatccacactgaggtttgcagtggaagaaaggagggcatttatttgcagggtgccaagcaaggagaatagtgcagcttatgctgaaagacctgatctcctcaatggcttgcaagtcgagttcttaaaggcatggttaagttttaggaaagcagaagttacagacaaaatcataaatcaatatgcagaggttacacattggtttggcctacaaagggtgggatatcttgaagtgggggcaggtcataggtagattaaaagattttctgttttgcaattggttaaggaagggaagctttgtttaagatctgggtcagcagaaaagattgttagctctggtttctggtgtgacttctttcaggaccatcaggaagaaatttacagcaaagagaagtggtcagagatcagtcctcagttcctcctatctgaggtctacatgctgttcggtgggggtctgggtttctgaaaaacaactcaggaacatatgttaagattttatctttactttctatagagaaccaaacattgtattattttaacttcctgggagattgttttaagctactattaccttcttgcttatctagttgctcatttatttctcagggagacctaggtacctggaaattcccttgaaggaactcaggattttctattatttctatgcttgggacccacagacccctaagaagtgtccctgctccatctcactctgggactggatgagggcaccagatatggggatttacacaccaaggcaggtggtatgtaatttttatcttgtatccatagccttgtgtggcatctggcatggaataggcacttactatttgttgaatatttgatgttggctaaatatttgatgtatataggaatggaattaagtgagtaaactagagttaccaggcatatttgagaaaatacagagtagttgaacttcagttcagctgttttccctcctccttctctcccacccttctcttgcctcccggctgcctgttcctcctatgcctgttctgtggctttccagaataccctggtcaaggaattgctcttcccttaaatgcccctctattagtccacttccattctgctgataaagacaaacttgagactaggtttggaagactttttctggaagaaaaagaggtttaattggatttaaagttcacatggctggggaggcctcagaatcatggcgggaagcaaaaggcacttcttacatgttggtggcaagagaaaatgagagagaagcaaaagcagaaaccccccataaaaccatcagatctcctgaagcttatttactaccacgagaacagtctgggggaaaccacccccatgattcaaattatctcccactggatccttcccacaacacatgggaattatgggagtacaattcaagatgagattcgggtggggacacagagccaaaccatatcattcagcccctggcccctcctaatctcatgtcctcacgtttcaaaaccaatcctgtcctcacatttcaaaaccaatcatgccttcccagcagtcccccaaagtcttaactcatttcagcattaacccgaaagtccaaagtctcatctgagacaaggcaaatctcttctgcctatgagcctgtagaatcaaaagcaagctagttacttcttagatacaatggggttacaggtattgggtaaatacagcagttccaaatgggaggaattggccaaaacaaagtggttacaaaggcccatgcaagtccaaaatccagcagggcagtcaaattttaaagctccgaaatgatcttctgtgactccaggtctcacatccaggtcacactgatgcaagaggtgggttcccatgttcttgggcagctccacccctgtggctttgaagggtacagcctccctcctggctgctttcacaggctagtgttgagtgtctgcagcttttccaggccaacagtgtaagcggttggtggatctaccattctggggtctggaggtcggtggccctcttgtcacagctccactaggcagtgccccagtagggactctatgtgggggctctgacctcacatttctcttctgcactgccctagcagaggttctccatgagtgccctgcccctgcagcaaacttctgtctgggcatccaggcatttccatacatcttctgaaatctaggcggagattcacaaacccaaattcttgacttctgtgcactcgcaggctcaataccacatggaagctgccaagtcttgggacttgaaccctctgaagccacagcactctttggggacacagagccaaaccatatcagcccctgagcttccaaaataccctttgcctttctttcccaaacttctaccctcaactccaatcaaaatgccatttctttactgaggaatgcagctagatataattaggagattatcacatcaacctaatttatgccaggctataaatgactgacagtgaggcagcaggaagtgttttgattttgaattccacaatataagtgattgatttcgtgttcaaatttctgactgtgtatataaccttctctttcacattgtatattaatgacatcctaaacatgttttcatgcaagggttttggattttgtcatgcaatcgtgacaaaggaatattctgagagctgcctgcctgtaaccagtttcagcaacattgctgtctttgttcagcagcatttgtgcaattatttgaatattttattgctttttcatatctttcttatataaatgaatgaacactagaaaaattactgataatgctggtgatgggaaattaggtcttatatagcaattcacttcagataaagatataaaaaatcaggtgagccagaaagaagaaattcttagcttcaagtggatactctctgaattaaagcccgtctagaatctgttttattggtaggaaaagaagcaaaagcaaggaactgtatggaattctggaaatctatcattgaatattgtatacaaaaaggaagatataactaaagatttttaatcctatattttagtttttgggccctgaaatccagtttctcatgagattcctacacatttcatttttttgtgtgttttcaagaaaacattttacacacaagacaggctgctgataaaaggttaggaaaaatgcctgggtttccttcaagctgtcccttcttcgaagtcattaattcttgccttagatcttttcaacaactggaatctaggtaatagctttgctgcaactactttagtagatcccaaagttagggccctgaaaaaccaagatacggcataggcctgttggctaggcactgagtgctacaagatgaggccagaggtctgcaaaccatcatcaccttccttaccttttggtgtccttacccatacacaattaccagatcctggaggctagctcactttgtgccattagttctgaagggcttggtcttattaacccaactgagaggagcttctgtcagaaacttaaatggaatacaatcaagttgaataagacttgtctctacctttgaggagttctcttttcatttcctttatcttacagtgatgggtgatcagataagaaatgaatcattcattgaatttagtgttgatgctcttttcttctcttgatgcttcttttcttctcttctttggctatgcctgcatttatctgaaagttttctatacgttttatatagaattaaaggtaaattgggtttattaacattttatatatgttttgtatagaattaaagggtaaattgggggattaaaaatttagtgtggcagcctttgctgttattgtttttatttgtttgatttttgagaaggtaaaacatttacgtgattcaaaaatcaaagcatataaaagtatatcagtgagaattctttatctcattcttgttttttatttctggaagaggaaatctaagtaatgactattcttagtttctcttaaatcctttcattatttttccatacacaaggaaataaaaatatattttattttaccctttttatatggatagtagtatattgtatacactgttttgcatcttgttttattcactcaatgtatcttgaagagctttccatagagaaatacttctttttgtaggtgcatagtattctattgaacgcatgaacataatttagctaatcatccgcctattaatgtatttgggatttttctaatctttcattattacaatcaatgctgaaatgtaaaaccttagccttttacatgtgtgcaaatgttatctgtgggataaattcccagaaggagaattatggaatcaaatatttacatattttgattttggtaaatatgatcacatggccatttacaatggtttattttaattatcaaagcttcataatatgttctagtcctcccttattggtatactcttttagttgtattctttttattcctatgtgaatattagaattgggttgtctaattccaaaggaaaaaaaatcagtatttttgttgaacatgttaaatgtgaattttattaaaggataaatggaatatttatgatttttagttttcctatcagtaggtatacttttctgttagttcaactcttcttttttggcagagtttttttcatgtatttcttccatatttcttgtaaaagtatatctagtattttattttggttgtgattaaaaacaggtcttttttacattatgtcttccgtttgtagtttctgtaagtgaagctattggtttcattatcttaatcttataatctgctaacttatcttactgtttgtagtggattttattatagtagaatctcttgggttttccaagtgtaataacatatcatccgcaaatagtgattattgtatatcctcttttccaacttttgcattttatttatttctcttgtataattgtatcggctaggacatccagcaaaatgttaaataatagaaataagagtgagtacctttttcttgtttctgactttattgggaaagtctctgatgtttccttaattagcataagtgggcttttgggttgagataaatctttgctggtcatttactcttggtcttccagcttcacctcacctttctattctatactctctggtgttggggctgggactcctttgatagcacagtgggctgcgtcaatagggggcactggagggggtttggaaaatgatagcactttctggtgggctctgccaatacgaggtactaaagggagcttggaaaggggaagtggggagaagcactccctgtctctcttgctcttcctgtcagaggtgccccagtaggggtatctcacctcagctttatgtatttatttttctagattgccagagccagcctcatcactccgccttgtaggtaccagcagcagctaggcagtgctcccacctcagaggtataagccccaactcagatgcacttccctcctctgagctcctaaagaactaacagcagctgagcagctgagcagtgcccccttctcacaggtctgagccccagctttgtggggcccttcctttgagctcccatgatcttgtaacttaatctcatcctttggaacccctcaaactggaggtggtagctgcttccttgcatttatggtctgcaggttgctcagtgtcctagttttgctgttctagtcctctagtacctgtttaaacaattctcttttttaaatccctcctgttgaaatatctaatgtgctttctgttttcctgaaaggacccaatcctgaatgactcatgcattcctattttattgaacatttttgtcaagatcagttgctcatttttttctaatttttttctcttcgtcaaagggggtgattgtatggtttttctttttagacctgtgaaatataataggaacttttctaaccctagacacttctagacacttctagaatttctgtaacaaatctcccttcatcatattgtattcttttaatgcactactgattctacttgctgatattgtaattaggatttttgtattaatatttatatctgagattggtcttaatttttctctttcagggaaatccatgtcaggcttttatttcaatgttatatttgctttataaaacctttggatctcccacatttttgctaatctctggaaaaattcagatagcatttaacattaacatttccaggcttttgttgttgttttgtcttgtttttattttttaagatttggtagcattgccttatgagactctgggttgggtactagtttggtatcatataatgggaaacttatttcattaaatgaatccagaaatgactaatagataaaatgatgtttgtgtgttctgcattagctgagctagttaaaaaaaaagcttttttggctaccagcattagtttagatcaaactgtgaaacaggcagcatgtctctggtgccctttttatcctttaattattgtacatatgcatctaattaattctccctcttacctgctcttttccctcctatgctgttgccagtctctgctgaagttacctactgatactgtttttggaggtatgactctgcatataaatatttgcattttcatagaattatgaatatgctcttggcagaatcttgggtcctggtgctgtatgttttgtgtcccttcttccttctaagttcttcaagtacatgtattcctgaggtgaagcataagcgtaccagtttgaggagagcatatcctcccattgacttagttacacgatttaataagctctacactcaggaaccttagagagccttcagtcttcctcttaataaaaagagggtcgccacttaactacctttagtgtgagtaaaggaaaaggtggaataacacctgttattgtgaactcatcgctagctgcctggctcatcatttcttttcagtgccttcatgcatcctcctctctctgaccagcaggtctttccttgactttgtccctgttgaatcctcactggtttttgaagcgatggccttggcttccctcacacagtggttcctccttcccctcaggaactgaccccctcctcaatttccccttacggtctcctgagcttacttctatcatgttaccattattgcattgtttacttataagtctgtctccttcaccaggctggttgctgctgagggtgcattccatgtttattctcttttgtttccaatgcttagctcactgctgtatatatagtaggtttcaaaatatattcgttgaattactgaataaatgagacccaacaaaaagtggagagaaagaaagatgagtggcaaatgggtaaatggactctgtaggaacttttagtaccatgctccagacatgttccagatgctaaaaaggttttttttttaaatccacctgtactatatgaaaagtaaacatagtgtttcattcagagtgaacttaatttatatttgatttatgttcacattgtggatgcttttctggcaacacactttctacatctgcttactcgaaggcatatatcagaataagtcagaaagacagtttcaagactatgaaagtctaaaatcctctggtagctttatagtaatttagcttttggatcgggaaattttggtttatttttcctgcatcaggaaattatgttctgcttcaggaaatgatgatagtagagataagggaatcaaagggattaataagggatgctaaaaatagattcattgggagataagatgacctgaaagcagaggattaaattgagggggttgagggaaataaaacctatttccatgatgcttccacttggaaaggataaatataaagagaacttgggattatgtttagcttgaatgttttcccatcttgagctgctggaaaaattctaatcggcaagctgtgttcggaagacaaagagaggaatttagaattctttggaactgctttagccaccaaaattattctgaactgtataaacattgtgatcccttttcccactcaaaatgtagatatataagaaggccagtttttacctgtaagtcaatgtgggtgcctatctcttttccctgtttctgccatctctgccaggggcagagtgtgctttaactcctgactgctggctttgccaatctccatagggtctaggtgagaaaagtcatatgctccctattaatgttatttcgactgtatgttttttaaaaataattgattggcctagcattattatgctaagaaagctttttaaatggactgaccatggagatgctcaaatagatgatttttaatccctatgaaaaaaaacaacactagtgtgatgttagccagttccatcaaagtttggcatgagatggaatgtcctgatcctcttcctcctatcttattaaattaaagaaatacttttattaaagcaagcatttgtgatatggatttttctttaaactcaaatgaccacatatagaactcagtgtccccctcctccccatctctttcctactatgctgttggtaatgtacttttcagtcctttgttacaggtgttctaattataaaaggaataagctggattaagtaaatttccatagcacaggaaagtggcctctaattaagcctattttgaatttttactgtgaatgagaagttacttaggaacattttaggggacacaacatagggtgaaatgagagatctctcctgcactgtggatggagagtcacttattcaaacacatatgtcacttattttaacttaatcataagaagtatgggcttcttgtgattaagttaaaataagtgacatatatgtttgaaaattagaaatgatggctttgtatgtttccagtaccaaaaaaaaactagctctctttctgtgtttaatttattgccttggtaaaatttccttcaccataagagaatattagtagaaatcgaagatgaccaaagctgagaagaaaccaatataattgcttgtatcggcaagacaccatgctctcagattttcttgtttaagcatattaaacctgtcctcaggctatctttgaacacagaaaagctgaactgtgtgtgtatgtatatacatacagataaacacaaatataaatattaaaaaatatataacatcagtctccatccattggtgagctggagctggggatcaatatgcatataactggctctccagggagagctatctgatagggagctatatcagctagggagagccagttttatgtttatcgttccaactctgcgttcagtgatatcatggccatgatgggagtgtttataccatgaattttggcaagcactatgtgatggttaattttatgtgtcaacttggctgggccatggggtacccaggtacttggtcagacatttattctaggtgtttctgggagggtttttttttgagatggtggcttgctctatcgcccgggctggagagcagtggcgtgatctcggctcactgcaacctccgcctcccaggctcaagcgattcaattgcctcagcctcctaagtagctgtgactacaggcatgtaccaccataccctgtgaatttttgtatctttagtagagataggattttgccatgtaggcctggctggtctcaaactcctgacctaaagtgatcctcccgcctcagcctcccaaagtgttgggattacaggcatgagccaccatgcctggccatagggaaggtgtttttggatgagattaacatttaaactggtggatttgagtagactgccttccataatgtgggtgggcctcatccaatcagatgaaggccttaataaaacaaaaagactgaccttcccctgagtaagagagaattttacacttgagtgccttcagatttcaactggaacattggatcttcctgctcaatggcttttggactaaaacattggctttacttgcatctcctgaaccactggcccatcctgtagatttgaattaaccagcctccaaattgcctgagccagttccttatctgttttgtttctctggggaactcagactaatacaccctacatcaggatttttttttttttttttttttttttgccagtgagccggtttaccagcatccactctctccatctaatccagggaaaaaaatcaaaattcccaaataagtactttctgatcactgtctctgtctaagctaaggaaaaaaatcaacaagtcccaaataaaacttcctggtaggtaatctttttaatattcaggcagtttccttctattcttattttactcaattttaaaatcaataatttctcctgaacttaattgaattttaaaaatttaagggaatttttgaggtacctattgatataattatttctcctttaatttataactgtagtgaattacagtaatgagttccctattgaatcagccatgatttcttggaatcaactttatttagtcttggaatattattattttaactcactttgatagttctggcaagattttatttaggactttaaaacttatatgttagattgatgtatactttatttccttgagtttatcaagttttgtttttagattgtgctaggatctttacatgaatctagagttatttttagcttcttaatattaattttaattactttgaaacaataaaatttagtaatgtttaacaagcacccattataattgctaaactgtgaaatcagcattatttgtatctgaccagctgtacaaagctcatccatttttcttttgacaaaaggtagtagaaattccaaacaataaagaagaaactactcattaaaagtcatatttgctaatctagcaccataattccagtcttagaaccattcatgcagctggaaggaggatatggaagaggtgagaataccagaaatgtaagggtagttctcaaattggggccccattttgcttgctctaaggcaaaaaaaacagagggtttagcaaagaagaaggtcactgaggctagagatgcaaacaaaagcttttggttcagatggtaaaggagaccctcaagagagtagaatcagtgtatctataagacagtgcctcatgaactaggctccaaccttcttggcatccaagtcctttttaatttcaagttttttagccaggttttgtatagtatgccatagttctgagccagttacattccaaccacattgcccaaagtaaatcaaagcaggacctggaccatgatgttggtagggaaggtgaggagggaacgaagggcggctgcagctccatgggctggcctgatgagaaaatttttatctttttctatttcttagaataatttgaaaaatataggaatgacctgttgtaggttagatagaacttgactgtacacacatagccctttttaacataagcagtatgcttctggaaatgggagtgctaactgaatcagtgcatgggaaaacagagattttaatagtcaatgggaataggaacttatatattttaatgatatatatatatggagaaaggatacatacgtatatatgtatgtatttaaggaaataatttcgtaaacagcaatataataataattcagtgctgtgtgtttagcatttaatgggggctatgtgtgcaaagtctttgtgcctagaaccttttttcatgttagatctttctcctatcctcttttgtatcttctatggttatagtccatttagatttttcttccttttttatatgttggagataaatatacgaaataacaaaaagatccttttctgccggtagtcttcacagttttgattgcacccccaccagtgaaataaatttgagcatgcacactcaatatgtatatgtatttacgtatcaattatatacatatacatatacacctattctaatatattatgtaaaacagatttcaacatgagaaaaatgcagttaaatgtgcttcattattttaaaaaatctttaacactatgtgaattagtaattcaatgtctggttttaaagtcagtttattttgatatttgattttagtcattgctatctcaaaaaaagattcaaatggaagaaatgcattgataactgctcttactaatcacgatatttgtttttcaagttcatccatagattatgcaaagttatttaaaaataaaatttactagcaaattttcatctttcttgatgtcaactgattttcttataatctgaaggtgttgatatttctacttttaacaaatgattacagaactcactgaagatctgcatttagttggctttaaaacatattagaaaactctattttcagattttaaaatctgcaaaattagagcttttctagataataaacctatattctttgggaggaacagaatcacatgttagtagaaatatattcaaattcatatttttgaaacgctctttctgttccagaaatttaaaagagcagttcctttctcattcattgttcaaatatcacctttatttgtttgatttatttgtttaaaaatgtctgctgctctattgggcgtggtggctcatgcctgtaatcccagcactttgggaggtcaaggtgggaagatctcttgagcctaggagttccagatcaacctgggcaacgtagggaaaccctgtctctgtgaaaaaaaaaaaaaaaaaaaaaaaaaaaattagctgggcgtggttgtgtgttcctgtggtcacagctactccggaggctgaggcaggagaatcacttgatcccaggaggtcgaggctgcagtgagtggtgatagtgctactgcactccagcctgggtgacagagcaagaccttgtctcaaaaaaaaaaaaaaaaaaaggaagaaagaaagaaaaagaaaaaccgctgttgatggcatcttgctattactgaaagttagtaattttggaactcttgtctttctataaaataaagctgcataatttgcttttaaatttggcagtgctttgaagtactttttatagacaaccaatgaaactccgtgatccaaaaaatttttaacggttgctcactgtagtagagactatgaatttctaccaagaattattcttttctttttgtaatagaaatgtcctggttgtagctgggcgcatggtgagcgagctagagacttcatttcccagcctttcatgcagatgtgtgtgactctatggctaagttatggccgattggatataagtagaggtgatatatacacattccaggtcaagcccttaaaagaatcagcttgcctcctatagcccctttcttctcatgcctgggaaggaattgtggtggtaaactagcttcaaccctgtgggcaagtaatattggaggggaaggctgagcagtgatagagtaggatcttgggttcttagatcccttggttactggatcttattttaatagctgtacttttggatctctttgttacagtagctagcctgtatcttactacactttttatctcattgcaatgcagtgtaaacagtctatatatttgttgtttttatcaaaatttttatgtgtttatataattgctgtaaaaataaccacattgattgaagtggtgcagagcagagtgtttagatatatatatccttcttttttcccggagacagagtctcactgcgtcacccaggctggagtgcaggagtgcaatggtgggctctcaactcactgcaacctctgtctccgggttaagcaattcttctgcctcagtctcccaagtagctgggattacaggtgcatgccaaaatgcctggctaattattgtatttttagtagagatggggtttcaccatattggccaggctgccctcaaactcctgggctcaagtgatatgcctgccttggcctcccaaagtgctgggattacaggtgtaagccaccttgcctggcccaaatatatatatccaaatttatgtaggagtttagtaaataataaagatgggcatttggaatcaatagagaggcactaatggttgttaaagttgggtgataggtacttagggttctttttaaaatctttttatattttggaattttctgtaataaaaagttaacatatttaggaaattaaaaaatgaatacaataaattcattggagaaaggatagttaagtagatgatgttacccacttggcaggaaataaaattagttgtgtctctcacactatacttaaaaattaatttcagatggattaaaatgtacatatgattaattccagatggattataagtgtacatttacaggatttaaaaaaatagaaggtataggagaatgttttataattttgcagttgggaaaagctttctaggacaaacatttaaaagtcataaaggaaaagattggcagttttgaataaaagaattctaaacttatgtacaacaaaatgaaaagacagattgcaacctaggcaaaaatacttgctgcatatatagtaaattattttattcatattatataaaaaacttctcaaatcaataagaaatacatataagttgtacaaaaatgagcaaagcatgtgaacagacaattcagagaagaaaataattcggagaaaaaaatggcttataaaaatataaaaaataatttaaaaattcagacaattcagagaaaaaaatggcttataaaaatatacaaagatttttaactttactaataaataacgcaaattcaaactcactccgtcacccaggctggagtgcaggagtgtgcgatctcagctcactgcaacctctgtcgcccgggttaagcaattctcctgcctcagtctcccaagtagctgggattacaggtgcatgccaaaatgccttttgtccatcacataggcaacagatataaagatttatattatccagtgttgatggagataatagaattaaaaaggcactttcatagtgttgctagaaatgtaatttggtacatttttagagacaaagttggtacctgtagtatctctcaaactttttcctacggactggaaataccacttctaagtaaagaagatttagttgaagatattttgtttattccactgtttatactggaaaaaaattaaaatgtccgaattctagtcagtaggaaaatagttaagtatggtacgtgcataaactagaaaattattcagttgtaaaaaagagggtgtggtggctcatgcctgtaatcccagcattttgggaggctgaggtgggtggatctcttgaggtcgggagtttgggactagcctgaccaacatggcgaaaccctgtctctactaaaaatacaaaaattagctggaagtggtggcacgtgcctgttatcctaactactcaggaggttgaggcaggagaatcacttgaacccgggaggtggaggttgcagtgagccaagatcatgccaccacattccagcttgggtgacaaagcaagactctgtctcaaaaaaaaaaagaaaaaaaaaagaatgtacacctgaacctgaaatgtcataaaaagagcaatgtagaaaacatatatataaaacaagatcccatttttgttgaattatttttataggagaagtcaagatgataggaactaacatcacagtgattactctagagggatgtatttgaagattcaaaacagggacattcacacttatttatagggttcaaaaaagggttgcaattttaggtggatttagtttctaatttgtttttttctgaaattttcacacaagtagatctttaaaaaggaaaaatcaaacccaaagcatattgagagtctattttgtgcccaaacataagtaggagcaatgaaggacacaaagatgaaaaagaagctgtccctccccttcatatccatgataagtcaaactgtggtaagtgctatttaaaaagccacattgaaataaacttcttttaaatcagtctactgggaaaagtcaacaggaataatatgattcaggttaaaaagttcatagctcttgcctaaataactgcaagaggggcaagagaaggtaacaaaaatctcttcaaagcttttagctactgatctggattcagtaacatcatcttaggaaaaggagtcaatacaaggtgacttcttatgcacagtttatgcagatatccatgtaatgcattgtcaaagacagagcagaaatgaacagtaaaaaatgctgtagccaccacaaaatggactagccacaagcatttctcacaaacctttgattaaccatctttgtttaaaacctgctcctgttggctttcccttctgctttttctctgtctttactcagcataaattatcagaagattttaggtcatgaaaatattttttctcctttcttgctaagtgtgtcttcagagtaagcagatttttgagagagaatgtgctgccagaaaaagcatttaagacttgaacacagaccaaatacacatttgatctatgcaagggcaaaggttcagcccccagacagtgggcaggagtggtcagtcctttctgctgtgtgtatcctcagtgggctattgctgtttctgagaaatacctggtccgagcagtgtgtgttaggagcctctgcctgtcttttttttttttttttttttttttttttttagcatgcctggggcttgatggcgagtcttggcaagcatccatttcatgggggcccagtgaatgctgcttccctaccttagtaatgtagctcacctttgggacttgaaatcctgcctggaactccagcccaaaagcctgaatagcttttctctctctgtctctctgtgtgtgtgtgtgtgtgtgtgtgtgtgtgtgtgtgtgtgtgtgtgagagagagagagagagagagagagatagagagagagagaagatcttgtctcagggctggagtacagtggccccatcatggcttactacagctcgaccccccaggctcaggagatccccccacctcagcctcccagatagctggggctacaggtgtgcgccaccatacccagctaattttttgtatttttggtagagacagggtctcactatgttgcccaggctagtctcgaactcctgggctcaagcgatctgctcgccttggcctcccaaagtgctgggattacaggcatgaaccactgcacccaggtcttgaatagcttttgttaagttcgggcactggcaggagtgatgctcaaaatatttaacaaccagtagaaagtgggcactgagcagtcagaagagttgccaactgaaggtccaatactttgtagtttctagatcctgggggaggttcaggaactctggggagggtgtgtgcaacaacaggacactcaggggtcttagggcttctacctcttatggctgtccaggtcctgctgtgcttgaactaatcacctagtgtcctatggctcttctctgcctggctttgaggatttgattcatggatcctctcatggctgtgctgatgtatgagctcttgcctgtacatattcatgacgcttagccgacttgtcttgttacttcctccctatcacctatctgccatctgagctagtctgaactatatgaactatctgaaccgtctaaactatctgccatcttcccatctgccttatggcttagcctgcctcagtcatgatagggttggcttcaatgcaggaaattctcaaagaaggtgttaggattacattgtatctgaagacaaagatattactggagaatagtttgttggggttgctattgatatggctatcgttgtaagattagtttaaccactcattcttcccttgcgtaaagtattaacagttcagtttgcatatacatttaggtctttattctgtcttcttgtcctctcttgtgtcttgagtgatttctgatgtactgcctgatacattgacttttgtctccaaagactgattttgtagtggtattaaaagtcacttaaggatgcccttgaaatagactcagttaggactttgctgtgacttattgcaaattagcacgtttttttcctttctttttttcatcttgtttcttacctttttttctgtccctgtcttcactctccacccccgtattttgtgctgcacactcagtgggctgcacaacctcatctatctcagttgactttccttcctgtgctctttttgtggcccattttcttttctcaccacacctctctaggctgtcttcttatgattagtgttcctggcctttgcttagtgtgaacatttaccacttcagaaatcttgctgtttgggtgctatttggcttctcagaatttgcagttgggaagttgtaaatgccccataaaacatgcttttttattttatatttcctaagttcttgtcttgagaaggacgttatcttagatatacatatttttaaaccgtgactctttttatttgtagacatggtcactagtgataatgtctgtgagtagtatctcagaaaaggctgcatgcaaacagattgtgctcacatttaaagaatcatctataaaatcccttggtctataattatgaaggctgggttatgatttgctggtggcacagctatttatagagtctgtcattgcgcatgactgtctgtgcccggggctgtgggcccgttgctgagagaagctgagctctggctgccgcaagagcagattgcactgactgctgctcctgtttctcagtcagccttcctcatttgccttccttagctttgaatggagcttgtttctctctagaactcttgtctattcccactttgctttttcatatggttactgttacctgtttttgatgtgtatattgcccagtgttttgccattactctcattttttgtattgatgagttttctgtcctctagaagctctttgttgctggatctttcttgtcattgaatgttaaatatggttcgtaagttattgatggcactgttcaggaaatcagactgtttgtttcaggtcagcttcccagaaaaatagactttgagatggagactctatgcaggagatttattggggagtgccctcgggaaaaacaccctaaaatagtgagggaagcaggattgggccacggaggaattatgttgcatatgccaatggccccaagatcccacaggaagtttcagagttgtccctagttgaagcaatcactagcccttccctgttgaccagcatttggcctgggggacgggatgtgacagctagctcttaggctggagggcaattcccagctaaaagccatgctgccaccctctcagcaactggcccaaggaatgggggaaaatgtggggtatgccccacattatccagactagttgtagttttgaatatagtgtaatttctaccctcttttaattttaatatggatgcaatgttggttccttacttaatatgggtgcattgttggttccatacttaatatggatgcattgttggttccataaatatgcctgaaagccaagcatatttattttctttttatggttcattttggtacaaaacatgaagttgatgaattcagtctaagaaaaaataagagtgtagggcaatttcaacagaataaaccctggcttactgaacagccactgttcataaaagtctgctgtcattcagtggctaatgactttatccctaaaaaccaaagctggagatgggaaggataaaggattgcagtagggttgataaaatttgtgcagacttttgcctggtagttgcagtctaaatataaaaaaaatcatcagattaggaaaataatccaactgcatcatctatgtgtttgatgaaataacataacagatgctgtttgatctgcctagaaactacaaacagatggagtagacacggctgccagagggaaattaggctgaccttatatttcatagactaggttgttgactgagagtacagattagcagaccaaaacatcaagtcaaaattatttttcagtctgtgttagaaacagagtgctcaaggccctacagggtgctatagagcaggggttggccacatttttctgtaaagggccagataataagtacagtatttttgactttgcaggtcatatgatctctgttgcagctacttaactctgtgtttgtggcagagaagtagccatagacaatatgtaaatgaatggacatggctgtgttccaatgaaactttgcaaaaacagatggtgggtcagtttgtccgaagagtgatagtttgctgacctttggtggagagcacatatcaggttgctgagtttcagtcctcgagcagatacttacaaagtattaggcaaacttctaagtgtccatttccttatctgtaaaatgggcattgaaaaagtatttacctactaggaatattacaagaaatagtgagataatgcatgcatagtatttggcacataggaaatgcttgataagtagaaataattgttgtttatggagctgtaaagaattaaagagagttgaatgtagttaggagctgaacaatgctggaaaagtgttagataaatgggactcagattctgtttggctatgtaataagatgtgtcaatggagctctttttgtcttagttttgtttgaggccccaatagttgtagtcagaaaggctcacattgccagagagaggagtagagccctatgtaggaggtagctataaatttgattttgccaccagctctgtggtagactgtgttttgctcaccaatgtctgtgttctcttattcttggcacataactaattttttagcttcccttgcaacttggtgatgaccttgtaactgggttctagttaatgaaacgtaagaaatgatgtgtgccatttacaggtctgatgtactgaaaccatgcacacaatcctggccctagtttccataatccagcagagtggagaggatattgagaacctaaaaagccatagatggaaggtgcctggtgttctaaatgactctgtggagcagagcaccacccccacttgctgatctatgcgtgacatgagcgaggcataaacttttattgtgttaagctcctgaggttttggtgttgcttgctgtagccgttagtctatgctgatagttatagtcagccatcaccgattttaggtatatggataaaggctaaggtttcatctgtgagaggttaaagaagtgctgttcagtagaactttctgtgagaacacaaatgttttatctgtattatccaatagggtctctactagccacatatgatattgagtacttagaatatggctagcatgcttgagaagttgaaattttaatttaattttaattaattaaaatttaaataaaaatatgtggctggtagctactctgttagacaggtcaggattagagactggggaatgtcttagcagtgtgctgcgcccgaccccaagactccataataattccaaagggccagagactgtggctggaccactgttctaatgatggaatgagcagaaagggctgcactggaaacagcctgctctcccagaatttgttggggcaaaggatacatgaatatttcttacagctgtcttgggagaaagagcctggagtcactttaaaccccatctaggaggaaaccaaaaggagtgatgtgacctcattggaatggtatgcttttgtgactagaagtggttgggagactttttaattatctgagaatgaccagaaaaattatagatctacacaaaatcttatgtagtattgagagaaaaggaacccctcattgtggatttcagaggtcgaccaggaaagaaaatgtagtttttttctgagtgtacactatgatccctgcttgggctaatctaacatttataattaaaaagcactttaagctctttaaaggagaagatgctgtatctcaagtagcttcaacctcgtagtctttgtttagtcttttccccacccgcatccaagactgtgtttagtgtcttaggctcatttggatgcagaatcagagacatactatattttaaggcatgttgtatgtataatttaatggaaatcaaagaaaaagatccatacgagggtctggctttacatggatagaactggaagttggttacagattaaaggcctcactccctgcagtagcgagatgccgtaggaatgactccattccactccactagctgcttcttttccttttgcccttttcacttatgatttctggcccctgatagcctcagcctataccagaggcacacagtttccatgaatccttctacatccttgttactcaaagtttggtctgcagaccagcagcatcagaataccctggaagcctgttagaaaagcagactctcaggccccactcagacccactgcattagaatctgcattttaataggatttccaggtgatccatgtacatattaaagtttgagaagcactgatctatagaattaattccctcccttcctccttcccttcctcccttgcagcctctatgctaagcagcccaggctctcagtttttctcagactctcaaagcaaaaactctgatagacacagcctaagtgtcaagaaccagcaaccataactggaggggtgtgaggctacagtacaaaacatgcttcctcaggcagcagggactgtgggtggagccttttgtttaagaagggaatgtttgacattattaagagattttaaaatattttcatttacaaaactgcacctaagttgtagttcatttgcaatttagaaaacattaaggctctctgattgtttaaatcagtgcttcttaccagcaggaactaataagcagttgatataatatcagtcaatatgaaataaacactgtattactaacctgtgaaagtttatctaaaataaatgtacaggccgagcacgggggctcatgcttgtaatcccagcactttgggaggccgaggtgggtggatcatttgaggtcaggagttcgagactagcctggccaacatggtgaaaccctgtctctactaaaaatacaaaaattagccaggtgtggtggtatatgcctgtaatcccagctacttgggaggctgaggcagaagaattgcttgaacccaggtggtggaggttgcagtgagctgacagcatgccactgtactccagcctgggtgctggagtgagactccatctcaaaatgaataaataaaataaaataaaataaaataaatgtacaattcagctaggcacagtggctcatgcctataatcccagcactttgggaggctcaggtgggaggattcttgaggccaggagtttgagaccagcctgggcaacatgtgagaccttgtctctttaaaatattaagtggatgtagtggtgcatacaggtattcccagctgctcaggaggctgaagaagggggatcacttgagcccaggagttctaggctacagtgagctatgatcacaccactgttctctagcctgggcaactgagcgagacctcatctctataaaataataaataaaaagaaatgtgcagttccctagacttttccaaaacagactctttgttgtcatcataactccagggaccaatgttctataccaaacaatgactagttattagaaaagattttaaaaaggtaatattttgccccactttcctttacttgccagggaatacattctctctgaaaacagaacggtatcttctagatacattattttttttcccggctgacaaagtgacttccaggaccaatcttttaatatagggttattaaaacaacaaacagttaaattgctctaatcctgagggtccccctgcatatagcacgatgggatacagtattattaagaccaaaactactcattcaccacacagtaaggggcaggacctttggtttctcagactgtactcacatgatggtggcatcagcatcactggaggatttgttaggaatgcagattcttagccctatcccagacttaatgaatcagaaactccgagggtgtggcccagaagtctgtattttaatgagccttcaaggtggttctgatgcttgataaagtttgagaaccagtgagtcagggtagtgcaaactcctatagcaaatatatactcattggctcaaacaaaatacaaatctgtttgttgtttatttaaaggtacaggtgtgggtaaacaggttggtagagtggcctctttcatgtagttattcagggacttgggctgctggaagcatggttgcttcaaaggtcatgctggccaaaagaggagaagagcatggagaagtggctgtgggaagtgtttatatgctaggtccagaaatggcttacatatatacacatttcattggctagagctcagtcacatggccttatctaactgcaggggaggctgggaaacgtagcctagcttgtgaccaacaaaaaaaggcaaacatggataaaagacagaactatgaaagaaaccaattacattgaaatataagttattagaaatatttttgacagcagcataggtactttttaattaatgcgttgaataacaagatctagtggtgttacaggaaaggagtcctgattgagacccccagagagggttcttggatctcccacaagaaagaattcagggtgagtccatagagtaaaatgaaagtaagtttattaagaaagtaaaggaatagaagaatggctattccatagacagggcagcccagagggctactggttacacatttttatgcttatttcttgattatatgctaaacaaggggtggattattcatgcatcccccttttagaccatatagggtaactacctgaccttgccatgggatctgtaaactgtcatggcggtgggcggagtgtagcagtgaggacgactgtaggtcactctcattgccatattggttttggtgggttttagccagcttctttgctgcaacctgttttatcaggaaggtctttacgacccgtatcttgtgccaacctcctatctcatcctgtgacttagaatgctttaaccgtctgggaatgcagcccagtaggtctcagcctcattttacctagctcctgtttaaggtggagttgctctggttcaaacgcctctgacagtggcacatttactaactactgtgattttgaagtaacaagtataaatagtatttcaagagatctgcaggcactacaacttaatatttaaatctatgatgacttttggtggcaaaagtcacaggtactgttgatgataccaggtttatggcctacattcataattgaaccatattttaaatttcaattataagttattgaaaatcaaggcatattttttctgcatccaagttcgttgactgccctcttcatctctctcaaattttatccatggatcaaagagcttctacgatacactttatttctagcctaggatgaagggaatcttttgattttttaatggagcattatagactttataagtagcagcttattgagctttataatatttacatatggtaaatttatatcttgtataacacaaaagtaacattatatatacatatatgtgtgtatatatgtgtgtgtgtgtgtgtgtatatatatatatgtattttctttttttgttttgacgaagtctcactccgcctcccaggctggagtgcagtggtgcaatcttggctcactgcaacctccgcccctgggctcaagcaattcttgtgcctcagccttccaaatagctgggattataggcgtgtgccaccacgcccggctggtggagacggagtttgaccatgttgcccaggctgaaaagtaattctatagcaatgctcagtgggtcaacgtgttaatttttcctctttccagatgcgtaatcagtaaacttgacagtagtttgaccttataaaacaataatgcttacctaaaaatgttatttttttttccaatttctgcctcattcatctaaattgttaatagatcttttcttgttttaatcagtcaacatatattcctgagcacttccagtcctgtggatacatgtagaagattaattctgaatgcattactgccttataatctctttacataagagcagaatgttgaagggcactggttggagttagataaacctgggttctaatctgggcttttctaattgcaactttttgcctttaagcagattacttaaccctgaaaagcctgtttgcttgtttctgcagggtgtatataggctaagtgcctaaatggcgctaagtaaattattgctattaatatttcctccctttttatgcccatctacacatacacaaccaaacagcctggttgtctgagaattcaacctccaaggaaaatagctaaccacttgcaagctttaacaaaaattgtgtgcgttacagatttttgtttgtaggtaacaggacctgactgtctgacttaagccaatagagaatttaatacaactagattgtggaactcacaatcaagactggatgtctggttagaacaaacaaaaccaggcagcttcagaaggtctttggtgtagccattggaactaatgaactcctgatttttttcagtctttacttgcctccatgtaatattcacagtccaagcagagaaatttgaattcactgagtcttggttatgggcttacccatgagatgtactgggttattattaagagggaagatctagagtgggctctggagcatcttggtgtaactatgtatgaagacattactcatcattgggaaatgcaaataaaagctacagtgagctatcacctcacatctgttaggatggttgtcatcaataagccacaagataagtgtttgttgatgaggaaatgaagcggctacattatctggggtaaatacccggggttcgttgtcttgcaccaagaaaatttaggacagggacacacttgaggagtttaggggcagaggtttaataggcaaaagaaagagaaagaaaaacatctctctctctagtgagagagaggggacttctgagaggaaaaggctggcaggcagtggatgccccgaattttatagtccagcttgaggaggtggtatctgatttttgtagggctcacagattgatttgatcaggtgtgacgtctacatagcgggcctggagggctgattaccccaccctaatattattatgctaatgactcttcccttggccagcaccattttgtcttcttcttactgtacacgtggctggcagagaagggaagatggagccatcattttgaacacgtctagtcccaggtagttctttcctgcaggcatccacctgtgaaagctctcagcttgcttgtctatgtctgcagcttgactttacaggctgttctttgttagaaaatgatttggggctgcttttcgttaaagggaaaatctgactgaggacttttgtaccctgagtatctgcctagtaatttcttcttaactctggtatcagaaggctatggagaaattggaacccttgtacactgtaggtgggaatgtaaactggtgtagccgctatgcaaaacagtatggtggtttctcaaaaagttaaaactagaattaccatatgatccaacaatcacacttctggctatatgtacaaaggggttggaatcaggatcttgaagagttatatatgctcctatgttcattgcagcatttttcacagtagccaagatatggaaacaatctaaatgtccgtggagagatgagtggataaagaaagtgcaatataggctgggtgtggtggcttacacctgtaatcccagcactttggaaggccgagatgggtggatcacctgaggtcaggagttcaagaccagcctgggcaacaaggtgaaaccccatctctactaaaaatataaaaattagctgggtgcggtggcctgtgcctgtaatcccatctacttgggaggctgaggcaggagaattgcttgagcccgggaggtggaggttgcagtgagccgagattgtgccattgcacttcagcctgggtgacaaagcaagactctgtctaaaaaaaaaaaaaagtagagaaaaagaaaacgcaatatatgcatacaatggaatagtactcagccttaaaaaatgaaggaaatcctggcatatgcaacagtatgaatgaacctggagaacattatgttaggtgcaataactcagtcacagaaagacaaatactgaatgattccatttatataaagtatctaaattagttgaattaataaaatcaaagagtagaatggtagttgccaggggctggagggaaggagagataggaagttgctattcaatgggtataaagtttccgttacgccagctgaatgagttctaaagatctgctatacaacattgtacccagagttaacaatactgtattgtgcacttaaaggttgaagagagcagatctcatgataaatgttcctcacacatgcacatacacaccacacaaacacacacacacacacacgagtgcacatcttgggaaatgattatccaaaaggggctgataatttggggtgtcctaaaaatgatagaagtccactactgacaggcttccaagtgtccatcacctaatggttgaagagtaactcttattggccgggcatggtggctcacgcctgtaatcccaggactttgggaggccgaggtgggcagatcatgaggtcaggagatcaagaccatactggccaatgtggtgaaaccccatctctactaaaaatacaaaaattagctgggcatggtggcacatgcttgtaatcccagctactcaggaggctgaggcaggagaatcacttgaacccgggaggcggcggttgcagtgagccgatattgcgccactgcactccagcctagcgacagagctagactcggtctcaaaagaaaaagagtaactcttattaacacctggaagaacttatagcaccacctactgtttcaagctaaaatttcctctgttaaaagacatggcttttttttaatattacttaggagaagaaagtgtcataaatcaaggagctgtaattccttacagttatttagggaaataaaggtgaacggtcatcgttgtttatagtgtttgtaatcatagctgtgagctgctgatgtgtaaattgctgctgccagatccaggaagtgaagcagtaataataatgataataatgtattaagtattttttctatgctgtgtactgttctgagtacgtaatgtggattatctcatttaaacaccccattactctacaagagagacgtattgttatatgcatttgacaaattaaagaagaagcaaggcacagagaagtaatttagccaagaccacacacctagtaagtaatagagctggtattatatttgaacccaggtagtttgactcactggagagtaacaaagaactctctcctaatgatcggtacctcacatgtgtctgtcttcaaggcacaccagcaatgtgactcattttcctatttccacctgatttcttttttagatagtatgaataatacactattgtgttcaagactatattttattcacacaagtaatatccatagtaattatagtgaatgtttctgtactactacgtgctaggtactctttgaagtactttacctccattactttattcttttcagcaaccctatgaattactattttaatccttattttataggtgaggaaataattaagtaactattcaagatcatacaactaggaagtgacaaaggcagtattagaacccagatagtggctgcagagtctgtgtagtataccacagtgcttataaatagttattttaaaatagtacaagtaaatttgggtataaaagaaataactgaggcagtgctcagatctggagaaaaaatgttaaggtggaatgaagatgcctgaagtttaggaaagactgatttaagtggtttagaatttttggccgcatgcgatggcttacacctgtaatcccagcactttgggaagctgagctgggcagatcatgaggtcaggagtttgagaccagcctggccaacatggtgaaaccccatctgtactaaaaatacaaaaattagccgggcatggtggtgcacacctgtaatcccagctactcaggaggctgaggcaggagaatcgcttgaacccagcaggcagaggttgcagtgagctgagatcacaccactgcactccagcctgggtgacagagcaagattctgtctcaaaaaaatttttttatatcataaataattctgcattgaatatcttactgggcactcttggtagaatttctctagggtagatacagggatgtgaattcactgagttattgttttgcagaatggctgtgacagcatgttttaatctctgtcatttggttactttagcgaagttttatgcagtttttctccctaagtgtttctagaatttgtagtccactgaggactattggtaataataccagttaagcaaaatctggttgcttattactcataagagaatctacattcttaccaaagaaatgtactgaacttactccactattacagaagctactatatcatcaaatattttgttcattctaccagaacaccaaatttctgaattagaatgcagggctatgggagataatgccatctagtggtcaaactaaactctggttcctagagattcttagtcttcaaagtgtagaaaaattatcagagaagcttgttaaaaaatgagattgagaaggaaagacagagagagagagagagagaatgaatgtgtgtgtgtagagggtggagggggcgggtgggtggatggggaatgtccaggaagctgcataaaaagcagcctgtatggttgttggttttgatgtgtgtggtctaaactgccctagaatttggttcagcatttggcccagttccctcttctccttaatcctcttctccagcagctgctgtagtacctcctgagttacgtgggagtggtggggatgttctgggactattttcggttgaagaggaccagctgagcttgcacgcaggggcgggatgggaacaagactaaagtatttgcggatggattaggagagcccaaacaatgacctcggttttgccaaatccatttgcattttctccttaccgatttctgttgacctcattgctacttttgactctggggttaaccccctccttttttaaaaattatctctttcttcatatccttcagcctggtgtacaggctctccataattggacagtagcccatcttccggctccctcagtgagaatcccactgtacacatttatctttcagaatcccacagaatcattattatgccttttctcatactgttcatctctctgaaattcttactcctcattttttatgcatttactgcagactttaagccttttatacatcttcaaaaattcagaagacacacaaactgaaagaagcccttcttggatcatttagtgtttatctctcactagtttcccaccatatttagcttgtaccctcataccagcacattatcaaataacgtttcttattgttgtaaatactccacccatctgtctatcatctatgtattattcattcatttcttatgttgtttcctttgtcttcaatataaattcaattcattcttcaaatgccacccactcaactaagccaaatgtaactatactcagcttcattcattgatttccttctctgagatctgctagcgctgagagtctactactttaaccactttaacccttcattacacattcccatgtgtttatgaactctatgttagatttctccttctgctctccagtaaattgtaagccatgaggaccaagactattttatgtaattattgatattttccaaaattgcatgttctcagttgcataatatgacttagctgacatgtttccgttgtctgagttgtccttatactcatcttgctctaaagaagaggaaaatgacaattttattaagcacttcctatgtgtcagataccatgcttagaattttacatgtatatatatatacacacacagaaacacacacacacagatacacacacacacatatatatattttttatcttattttattttattttttagatggagtctcactctgtcacctgggctggagtgcagtggcatgatcttggctcactgcaacctctgcctcccaggttcaagcagttctcctgcctcagcctcccaagtagctgggattactggcgtccaccagcatgaccagctaatttttgatttttagtagagacagggtttcgccatgttggccaggctggtctccaactcctgacctcaggtgatccacccgccttggcctcccaaagtgctgggattacaggcgtgagccattgtgcccagctggaattttacttatatttatgttatttaaaacttaaaagccctgtgagtggaatgttatacattttgtaggttagaacagttggactcagaaatatttaatacattgtgtagctgtaattaagaagtcagcatttggacccgggcccatctgacgcccaaacccataccctttgtgccacctcgttgcttccatttgagtttggaaccctcactttgtggtgttttgcagtgatgattggcattcctgctctttccttcctcagaaagagtctctctcaggaatgtaaagtggcactttaccctggaatgatatcctgtcccgctccctacactctacttcaggccaaaatggaaacgcccttcttcacagtctccctgatgcttcagtcaagcagtgtgcccacctgctttttttccctccttttttttttttttttggactggctttactcaattaagaacacttcttaatgtagaataactctgggccctgaaatactggggtgctttaaagaacacttgtggggaaaacttaacttgcacgttaagcctcctccatgctcactttgggagtgcacgtgatctcactgaatatagtgacttttggagctctttgtataactagccatggagaacttccagactaactcaatacaaatctggatttgcttggttgtgttttctgccacagggattcagagcaagccctcggcatcttagaagacgagttgcagcggccgcagctgcccgtctggaagaagtgaagcccgtggtggaagttcaccatcagagtgagcaagaaacttcagtgaggaaacgaagaatcaagaagagcagccgagtccagccagaattttatcactctgttcaaggtgcttcaatcaggaggcctgtaagtagagaactgtcttttataaaaatattaaattcactgtcaaatcatgtggttgttcttttagtttaaaaacattatcagattaactttgaataattaggttgttgttattcccaacaagtggcagcgtactcatatgagtttcagcaaggaatagggtttcatagaatgttctaggatggatagatagttgacaaaaaagcaagagttagtcactgtcaggcagctgatatgaaagctggtgaactcccagccctgctgaagctggagttctagaatgaggatggggacatagagtcaacaaatctaggtgtggtaatgagagaactgatgaagaggatgacaacaaaaccagtgtcaggataggagaagcagtgaaggaaggtggggctggagtcttgggcagtagcagtggctgaactcctcctggaggctcttgagccagtgaggcctgtgcgtccctccacacccagcctagggtaactctaagtgtcctggccttctcaggtgtggcctttatattgttataaggcagcaccattgtctttttctaacctggtgccctgttggccacaatgccacctttcttcagaaactcagggctcaactaggagctggtcttcatccccttctcacatcctgagcacgttgttctgtgtgctctgatttttctttccttggttctggctcatgggctttttaccaaggctggggcttagaaaatgccattttaaaacttgtaaagtaattttatgactgcaataattttatttgctttggcattagaaaaaagtgtctgtatggctcatctctatgctgtggggagcctgttgttgtttcttgtgccaacataggggagccatcaagatttggcttgaaaatgtctttgtaaattattgaaacagaactgcccttctgtgggggtaactgtgtggcaggcacatgtggagactgtgcgaaggccaagagaatgtctgactcagtaaccaggccaacaacaatggaaagaagttaaattcctttacagaaaaggatctgtttatcataaccaattgaaaaaaaagtacatatttagaaatgagggtttatttttcatgattcaataaaacaaaggctaagtagaatttggtatctatgcagagaaatatgaaatggtaggaaaatttactcattcaacaaacatgcattttatgtagaaaataagggacatacagatatgtgttaactaacagttactgagggctaaatgtgtaacaggcattattttatgtcacttatttaacaattctatgaggtagatgttatgattcccattttatggataatgaaactgagccccagagaggatacataacttgcctcaggttatctagttgtttggggtagagtttaggatttggatctaggtggcctgcctccagaacccaagcatgtacctctaccatctgttactttcctgtagtacctggtcactaggaaatcacagtcgagtcaatcaacagacatgaaaacaagcaattataatgcatgttctgtgctttgaaagtactgttctagagttatacacaaggcattatggaatcatcttggatctccagaaatatttacagataagcagacacctgagatgagtcctgagagataaggaggaatttaccaagtacaaagtagaagtaggtatcttctgcatgagaaaaacatatataaaagcacagagatgtgggagggtatggcattctcagtgaacagcttgaggtggtgctggcacatcagactggtgggttgggtagaggccagattagaaagggcttgtacattatgctaaatatttgaacttattttgtgtaataggcatcagttgaaggtagggaataggtgaattgtttctcttgccaggagtctagctaattctttgcttcttctaatctccccatgtggatcaggattgagaagtaagtgactatcattaaagtttagaaactctcaaccatcattattctctcacaagccctctacataactgccttggttaataagacatagtctttatgcctctgtgactttgaacctgctgtctactttgcccttgaatgtttttccttattctttgtttgcctggtaaacttcagttcatcttttgagactgactcatgctcggataggtcaggtgaagtcttttctgatccttcctatcagagtgaggtgcccttagttttgattctcagcactaggtacaaacctccaacatagcagctaccccagcaaaaaaggaggtctctgcagtaagactcacgtgggttcaaatcctgctctgtgtatctgcaggaaacagcacactaagaggatttaactgaagagagtttaatgaaggcactatttacagaaatgtgggcagggctaaggtgcttcatcagcctataggtggagcctacttaccttcaactcctggtctaaggggcagcagagggcattggtcttaattgatcctggtaggaagagctggagccatggaagagcccttccacaaggatggtgcctgagggttgcagctactgccagaacctagtgagtcaggagggagcagggcgaataaatatactgctctcttagctcgtgctctcagtggtatctcctgttgacccaacctacctagaagctggagggcaaaggaacttgggtgatgcagatcacagccatcagtctcccagggactgagcaaggaagagatggacagacaatctgagagggttacagtgacagcagagaataaaaacatacctacctggtggccgagcatggtggctcactcctgtaatcccagcaccttgggataccaaggtgggcaaaacacttgaggccaggagtttgagaccagcctagccaacatggcaaaaccccttctctactaaaagtacaaaaattagccaggtgtggtggcacacgcctgtaatcccagctactcgggaggtggaagcaggataatcgcttgaaccaggaggtggaggttgcagggagccaagatcgtgccattgcactccagccttggcaatagagtgagactacgtctcaaaaataaataaataaataaataaataaaaacaaccccccccccaaaaaaaaaccacttagtattctttgccaagatatttcaattctctgagaatcagtttccttattataaagtgataataagggaaaggacacccttctcaacaaatagaaaagtttgggctagccacatgtaggagaatgaaaccgatcctcatctctcaccttatacaaaaatcaactcaagatagattaaggacttaaacctaagacctgatactataaaaattatagaaataacattggaaaaacccttctagacattggcttaggcaaagatttcatgactgagaacccaaaagcaaatgcagtaaaaacaaagataaatagttggggcttaattaaactaaagagcttttgcatgacaaaaggaacagtcatcagagtaaagagacagcccacaaagtgggagagaatctgcacaatctatacatctgacaaaggactaatatccagaatctacaatgaactcaaacaaatcagcaagaaaaaaacaaacagtcccatcagaaagtgggctaaggacatgaatagacagttctcaaaagacaatgatatacaaatggccaacagacataggagaaaatgctcaacttcactaatgatcaggcaaatgcaaatcaaaaccgcaaggtgataccacctcactcctgcaagaatggccataatcaaaatattaaaaaatggttgatgttggcgtggatgtggtgatcagggaacacttctacactgctggtgggaatgtaaactagtacagccactgtattagtttgttttcatgctgctgataaagacatacctgagactgggaagaaaaagaggtttaattggacttacagttccacatggctggggaggcctcagaatcgtgggaggtgaaaggcacttcttaacatggtggtggcaagagaaaataaggaagaagcaaaagcagaaacccctgataaacccatcagatctcatgagacttattcactatcatgagaatagcatggggaagaccgacccccatgattgaattacctcccactgggtccatcccacaacacgtgggaattctgggagatacaattcaagttgagatttgggtggggacacagccaaaccatatcagccactatggaaaacagtgtggagattccttaaagaactaaaagtaggctctcccgtctccctctccctctcccgtctccctctccctctcccgtctccctctccctctcccgtctccctctccctctcccgtctccctctccctctcccgtctccctctccctctcccgtctccctctccctctcccgtctccctctccctctcatgccgagccaaagctggacggtactgctgccatctcggctcactgcaacctccctgcctgattctcctgcctcagcctgccgagtgcctgcgattgcaggcgcgcgccgccacgcctgactggttttcgtttttttttggtggagatggggtttcgctgtgttggccgggctggtctccagctcctaaccgcgagtgatccgccagcctcggcctcccgaggtgccgggattgcagatggagtctcgttcactcagtgctcaatggtgcccaggctggagtgcagtggcgtgatctcggctcgctacaaccacctcccagccgcctgccttggcctcccaaagagccgagattgcagcctctgcccggccgccaccccgtctgggaagtgaggagcgtctctgcttggccacccatcgtctgggatgtgaggagcccctctgcctggctgcccagtgtggaaagtgaggagcgtctctgcccggccgccatcccatctaggaagcgagaagcgcctcttccccgccgccatcccatctaggaagtgaggagcgtctctgcccggccgcccatcgtctgagatgtggggagcacctctgccccaccgccctgtctgggatgtgaggagcgcctctgctgggccgcaaccctgtctgggaggtgaggagtgtctctgcccggccgctccgtctgagaagtgaggaaaccctctgcctggcaaccgccccgtctgagaagtgaggagcccctccgtctggcaaccaccccgtctgggaagtgaggagcgtctccgcccggcagccaccccgtccgggagggaggtggggggggtcagccccccgcccggccagcctccccgtccgggaggtgaggggctcctctgcccggccgcccctactgggaagtgaggagcccctctgcccggccagtcgccccgtccaggagggaggtggggggtcaaccccccgcccggccagccgcccagtccgggagggaggtaggggggtcagccccccgcctggccagccgccccgtccgggaggtgaggggcgcctctgcccggccgcccctactgggaagtgaggagcccctctgcccggccagccgccccgcccaggagggaggtgggggggtcagccccccgcctggccagccgccccatccgggagggaggtgggggggtcagccccccgcccggccagccgcctcgtccgggaggggggagggggggtcagccccctgcccggccagccgccccgtccgggagggaggtggggggggtcagccccccgcccggccagccgccccgtccgggagggaggtggggggatcagccccatgcctggccagccgccccgtccgggaggtgaggggcgcctctgcccggccgcccctactgggaagtgaggacccctctgcccggccagccgccccgtccaggagggaggtggggggggtcagccccccgcccggccagccgccccgtccgggagggaggtggggggatcagccccctgcctggccagccgccccgtccgggaggtgaggggcgcctctgcccggccgcccctactgggaagtgaggacccctctgcccggccagccgccccgtccgggagggaggtggggggaacagcccccctgcccggccagccgccctatccaggaggtgaggggcgcctctgcccggccgcccctactgggaagtgaggagcccctctgcctggccagccgccccgtccgggagggcggtgggggggtcagccccccgcccggccagccgccccatctgggaggtgaggggcacttctgccgggccgcccctactgggaagtgaggagcccctctgcccggccacgaccccgtctgggaggtgtgcccagcggctcattggggatgggccatgatgacaatggcggttttgtggaatagaaaggcgggaagggtggggaaaaaattgagaaatcggatggttgctgggtctgtgtggatagaagtagacatgggagacttttcattttgttctgtactaagaaaaattcttctgccttgggatcctgttgatctgtgaccttatccccaaccctgtgctctctgagacatgtgctgtgtccactcagggttagatggattaagggcggtgcaagatgtgctttgttgaacagatgcttgagggcagcatgctcgttgagagtcatcaccactccctaatcttaagtacccagggacacaaacgctgcggaaggccgcagggtcctctgcctaggaaaaccagagacctttgttcacttgtttatctgctgaccttccctccactattgtcctatgaccctgccaaatccccctctgcgagaaacacccaagaatgatcaataaaaataaaaaataaaaaataaaaaaaaataaaaaaaaaaaaaaaaaaaaaaaaagaactaaaagtaggactaccatttgatccagcaatcccactactgggtatctacccagaggaaaagaagtcattatatgaaaaatatacttgtacacgtgtgtttatagcagtacaattcacaattccaaaattgtgggaccaacccaaatgcccatcaatcaacgagtggataaagaaactgtggtgtatctatacgatggaatactactcagccataaaaaggaatgaattaacagaatttgcagtgacctggatgagattggagactattattctaagtgaagtaactcaggaatggaaaaccaaacatcatatgttctcactgacatgtgggagctaagctatgaggactcaaagtcgtaagaatgataaaatggactgtggggacttgggaggaagagtatgaggagggcgagggataaaagccaacagtatggtacaatgtatactgcttgggtgatgggtgcaccaaaatctcacaaatcaccactaaagaacttactcatgtaaccaaataccacctgtacctcaataacttctggaaaaataaaaaataaataaagtgataacaatagctaccatatagagtcatgaggatgaactgagctgacatatggaaagacctgcatagaataaacaataaatagtagtttcttccttttattcctcctcccctagaccatgaattctttgaggcccatatcaagggttctagaatatctcctggcatctggcgtttggcatttggcatctgagtgaatactattgactgagtgaatgatatatgaaagatagctaatgatgactggtacaattagtaagcattataggaattcagagaacaaagaggggacccccacccctaaataggttggttaaggcataattactttatggaaaagttgggattgagttgggctttaaaatatgggtagtgctgggcgtggcggctcacacctggaatcccagtactttgggaggctgaggtgggaggatcacttgagctcaagagtttgaaaccagcctgggcaacatagggagaccctatctctactaaaaattaaaaacaaattagccagtcatggtggtgcacgcctgtagtcccagctacttgagaggctgaggtgggagaatcacttgagcccggagttccaggctgcagtaagccatgatcatgctgctgtactccagcctgagtgacagagcaagacactgtctgaaaaaaaaaaaaaaaaaaagggataggaattggctgggtagcagatgctgggtccgggaagtggagtaagcaaaagtgctgagaactgactggatgtggggatttatatgagagaaatacaagataaagctggaaaaaatagttaggggccaacatacatttcagacaaccactggtttaagctttcttttctgtgcttctgaagacactgtaataggtgagtagtgtgatcatagcatgattttaggaggattaaacatgtgcagggtacatcaggagagcaggacagttaggtagctgtggcagcctagcagtgaggtgattagggcctgaatttgggcctaacccatggtgttctgctgacatctgctgatgactgctggtggggaatctgaggatggcctcaccctctctcctgaaggatctgttggaagagagggagattagagggcagcaaatagcagtggagattactcagttgcatgggcaaaaaaccattctgaggagtgtttttttttgagacggagtcttgctctcttgcccaggctggagtgcagtggtgcgatctcagctcactgcaagctccaccgaggagttttcttttttttgagacagggttttgctctgtcacccaggctggagtgcagtcgcgcaatcacggctcactgcagcctcaacctcttgggctcaaccttcccatctcagcctcctgagtagcttagactataggcaggtgccagcatgcctggctaatttttttttttttttttttttttgagacggagtctcactctgtcgcccaggctggagtgcagtggctcaatctcggctcactgcaagctccacctcccggttcacgccattctcctgcctcagccttctgggtagctgggactacaggtgcccgctaccacgcctcatgcctggctaattttaactttttttttgtagaggtggagtctgtctgtgttgtcctggttggtcttgaactcctgggctcaagagaacacctcggcctcccaaagtgctgggattataggcatgagccaccacatccagctgggagaggtcttcagggtgtcttactgcatctcctgtcagttgtctgagagactggacgttgtcagagttggtagtgagaaggctgttggctccttgtctcacacaattcctgtgcaggcttctagaaccttttggcctctgccgacatttccctgcttttaatgccatatatgagcttgaactgaggctttgtgtcctcttctggatttggttaggtgcagccagtagtgcctgctagagccaccctattcaacatgcgtctaaagcctgtgtcttttctaaacgtacacatttggagaaaatcagtgttatgacgtgttgccatgaaagcaactctgattatagcttggagatggagtaaaaataaatcagttatggtgattcaggattacttgaatgactttatatgaagcactcaaggcatttctagtggcaatctaaataagaaataggcccatgagtgagaaagactgaaaacagaagtaactgcaaaggagatgagtcagaaagcgtgactgtgcagttttagctactttcagtcagaccatcctcttgaagtgttatgtgaaatgcaaatactttagcatccttagctgttttaacctatttacttattctggatttgtaagctatatgcaaatatacctataagaatttgtaatggggatcactaataaaaacttaataatatctagattttttattttactccttgttttagatgtttctaaaagtggataaactaaaaatttatcctgatttcctctcagtacatatgtatttggatttatactgtatattaagatatgtcactaggatgcttaggaattttttttaccatcttgaaacagaaaagataattagatccagatctccatttattccttagtattttcacattacaaagcattttgttttgtttctgaatcccaggatttttaaacatcatcatcatcatcataagaactcttgcattactgcatgtttacctcattgacaatacatgggcattgttctctgcactcttctctgtttttctctcattttatcttctcagcgattctctggagtcggtgctcactttccagggaggaaatgtgtcaaggtcatacagctggtagatcatggagttaacatttaaacctaggcactcttggcttgagccgtttttgagtaaggaatggagaactccccatgattacaattctagtgctagacatttatcctcatcagccttcctgaagtattttaattactttgagtctcatttttctaactgcatagatggtagatatggatgaaatctttgtgtttttaaactattacatcaattaaaacctatctttaaaatggtattgaaaaccataggtaaacctcaaacatcatttttgccatcattttattggcaaaattggccccctctttctgtggcagggcacctaggaggtagcaagaagtaagcaagagtaattttgccctactgcctgctcacatgaacctgttaatgtacaactttcagacccaaaaagtatttatgtgtttgagattgggggtgggtatggggaaataacagttttagagcatcaggaaataatcaaacatactgactctactcctgttacatttcactgattccagttttttgcacactgcaacagcattgcctgcatttcctggtgacttagaatctttgagactttctcactgagctgaaaaagtataattaaaaattgctagtgttcccaggttattgccaaagctgcagcttgttctccctgctggcaaaatcttagcctctgagcacctgttttcttacttttgggctcccaccaccatcaagcaatgggatttttgaacctgacagttttgactgaggagttggaggacatatgggcctaacacaggtgattgggtgatcctcttttctgaaatggtaagcacaaaggaagaagcaggtttggattgaggattggaaagaaaattttctgatttggatatgtgaagtttgaaataactattagatattcttgtgtctggatttcatggaagatgtgagaattatttgtacatagatgttattaaatctataagactgggtgggatgactccgaaaatgaatttgatagagaagagaagacacttgaggtctgagccttggagtctgccagtgatgagagtttgggaagaggactgaggatcgcttataacttccaactcttcactcagaaatataaatgccttaagcagacatgggtctaggtagctcttgactttgatttaaggctattcattttaggccaagaaaaggccactcaggtagagactagagaaaatagcaggaaatgaagtcccagatgtactcattagattttcccttccctgaactctccccaactaaaccaccacttccttgacctcacccttcttttccttctgttgtgggtttctgtttttcagtcttggggaaattttctgtttttctgattacagcttaggtttttgtaaggctgcagtatattttggaacattatatagctttaatttgtaataattaaattaaccagattttgtcatatttgtagttgggaactttttggagtgtaggaaagacttaagcatatatccttgatctcttgaaaatatagcagggtgtttctgtgttcctttcctgcttagattattaaaatggtcttccttttccctttccttttcaaatatgtaggaccaggcagctctatgtgcataaccttaggatatttccccttttgtggaaggcataactgtacaactcataccttactttggctaattaactagcaaatccaaagctcttagaggaaacatttgtttccttttcccctttggaattctggagaatgaattgattaataaagtcaaatttcttttgctaattatctgaaaagaatttttttgaatgacacccattcaatgtactgagtctttgctacatattgctgtacctccctttttaggttcataattaatagaattttataaaagatttcatttatggccaggtgtggtggttcacgtctgtaatcccagcacactgggaggctgaggcgggcggatcacgaggtcaagagattgagaccatcccagccaacatggtgaaacccgtctctactaaaaatacaaaacttagctgggcatggtggcacgtgcctgtagtctcagctacttgggaggctgaggcaggagaatcgcttgaacccgggaggcagaggttgcagtgagccgagatcgcactgctgcactccagcctggtaacagagcgagactccatctcaaaaaaaaaaaaaaaagatttcatttattataggcttgctataataaattacagtaaggtattggaataattaatgcacaggggcacaagaatgtgcaaggtaggtagactgtattgaatgaacagtttagtctctataaacaactcatgaaaccaagattaacttggtaaagggattcatgtgttctgcttggagaaaaataagcatgtgttcataactcatgattcttttttgaggtcagtattttgactgaagcaagacctcttgccattctttctatgtctttcttgtatgtgatgacaacctgttgtcttaaataaaaaaaaccttaaattctttaatctccaaaccaaggaaacttaaagaaaacatttagatagtcacttacactttgaaaattttcatggacaactatggatcaaaggactgaaaagaaagccccttcaaagatggtctagtttattatttcacctctaaccaaagaaatccttaaattgctctggtaagatgggtatagcttcctttattttaaaggacacagccatagcttacctcagaattctgtttggaatttaacagccatctctgcctgaaacaactccttgatctttgccctaaatcccatgccttacaatttaagaccatttcttattgtggtatcctctgtggagaggatgaagcatagccacctgctaccgtgtcactctcagtctttgtgaatcaaagaatgttaaagcttgaggggatcttagagctcatctgacttaacagtttttgtaatgctagattcctctctgcttcagtacttttagtgatacaatctcctaccattaaatagtgctaattagcagcaagttaattgtacttgaaaatcaataaattgtttcttttctaggctcatggttctatctctctgaacttttctcctaagtctaattcttaatttttccaaacatcatttttgttttactcttctaaaccacctccaagtgagtgataagggtctgatttctctcaatattttctgtctctctctctttatttatttattttagttctgagatgatgattgtgtttcaaaaaaatcaatctatggaaattgaacaaaatttagtttgtgctttgggagatgagaattcagttctagaaatgacagtaatgtttcaggaattttttttttttttttttttttgagactgagtttcactctcattgcctaggctggagtgcaatggcacgatctccggctcaccgcaaactccacctcctgggttcaagcaattctcctgcctcagcctcccgagcagctgggattacaggcatgtgccaccacacccagctaattttgtatttttagtagagacggggtttctccatgttggtcagggtggtctcgaactcctaacctcaggtgatctgcccgcctcggcctcccaaaatgctgggattacaggcgtgagccaccatgcctggctgtttcaggaaaattatagctttggagtagtacttcgtagttaagtagcacttcatactttcaaagactgctcatattcattatctcctgaacaaacaccctgtgtgttgggtatggcatatattattgatccagtttgacaaaactaaacctcagtgagtaggtgattggcttaagttcataaggtcagttagaagcagacctctctcatccttgcagtctgttgtctcctgtgtttatcctatgtttatttagtctttatctctgacaatgcttagagaattgggtgagaacttccagggagaagaatatagattccatttgactggaggaattattcagtatcccaatgtgactcattcccagggagtagctttacatctttgagagtctgctcacagcctgcattatctgtgttggccaccctaggctacctgtgtattggcaagtccactttggtctaatactatcaagcccatgctgctcctccacacaccctattcaattatgaattggtaaattagataatcaactctgatactgggtaataccactggctaatctacattgacccttgctacatgcagctcagtattactaagatcgatggggatcagacactgtcttagtccatctgtgttgctataagagaatacctgagactgggtaatttataaataatagaaatttattttctcactcttctggaacctagaaagttcaagaccaaggcatcagcaggtttggtattgggtgaggtgttgttcctcagcgatgacaccttgtttctgcatcctcacctggtggaaggcagaaggcaaagacagcaagagagagcaagggagctctttgaagccttttttgtagtggcattaacccattcatgatggtgagcccccatgacataatcacttccaaaaagcccctcctcttaatactgtcatattggggattaaatttcaacacatgaattttgggtgggatacaacattcaaaccaaagcagatacctaagcaaatatgttgttaaaattaagtttatatacccttgtgcactcttggtgggaatgtaaaatggttcaactgctatagaaaacagtatggtaggtcttcaaaaattaaaaaatagcattatcatatgagccaactattccacttctgaatattgaaccctggcacatgaattgtacgcagagttagtctcaacttgaagccaagccttttgtccttcacctcagtcagtcattggttatgggctgctagggctgggggtgtgaggaagctttaggttaggggagtccctgaaggggagggcggctatgagccattagcagccaaccctcacagtagcctgtatgtgagtccattggccaggtggaagggatgcagccaggacactcatagaaaccatcaatcacaaacttgttggataaatggctgattccagacctgaaacagaaaatatagaatgagcttcacagctcacgcctgtaatcccagcactttgggaggccgaggtgggcggatcatgaggtcaggagatcgagaccatcctggctaacatggtgaaaccccgtctctactaaatatacaaaaaaaattagcctggcgtggtggcacgtgcctgtagtctcagctacctgggaggctgaggcaggagaatggtgtgaacctgggaggcggagcttgcattgagccgagatcgcgccattgcactccagcctgggcaacagagtgagactccatctcaaaaagaaaaaaaaaatgagcttggcacatcttgtcaaactcgaaagcaaggaagcatcaaagactactgggatcatgtcagcaccaggagtaaacttggagaggctcctactgctgttgaaggaagaaggaatgatgaaattacaattttaccaccttgcaagccctaataaaataacgaacctagacactgatcatcaatgactgctaatacatgagagacaaccacacatatgcgtctcctgatgaaagtatacaaaaatacttataaagtattcttgctaaaaattgaacctaaatcagatcaaactgctagttctaattatagatttacataaaatacaggtgacagaggaatatgttaaatgataaggtgaagatagtgaagatacatttaggatttagctaagttgaggtgtgggaaactctagaacaaatacccctaatttctttgacaaattataagaaaaaatgtgggagtgatagtctatacaagaaaagagacttaaaagacctaccaaccaaatgtaacatgtatgccttatttgggtgaataaaccgaatataaaaaaaagagaaagtgggggaaatttgaacaatgaatttttttttttttgagataagttctcactctgccacccaggctcgagtgcagtggcacaatcacagctcactgcatcgtcaacctcctgaactcaggtaatcctcctgcctctgtctcctgagaaggtgagactacaggtgtgtgccaccaagcctggctaattttttaatttttttgaagaaacatggtcttgctttgttgcccaggcttggatatttaatgatattaagaaacttataaaaatattttagattgataatggtatttttattttattaaaaataattattatcttttagagatgcatactaaaatatttaataatgaaataaaatccctcatattggctttaaaatcatctggtggggtaggggagaaaatgtggataggggtatagttgaaatagcactgaccaggagatggtgattgttcaagctgggcatgtaaatggcagttctctatagttttactttgttgtataagcataaaattttccataatgaaaggtttaagacattagagaaagaaacaaacctttacttgaagtttgcatcatcaacacttttgttttccgtagagtaagcctaaatttttgttaataacattttgagattttagatatttattattaaaaggtttttagaaaggcagaaggtgggaaattgttcttatggccatctcctgatttctttttacttcttgttttcttttaacaaagaactatttgcttatttgttgtctttttacttagaacatttgacagaccatattagtgaatggtgtataaaatgtgcttattatttaaaacttaaacaaataatataaaatagacaaggaattatataggcatattcttctgttttaaaatctagagcagatttttttcccgcaagactactgtttttgttctttgctgatttattgatctgagactagaatcatcattgaaacaaaactgaccttaaaggcaacatgggcctggcgtggtggctcacacctgtaatcccagcactttgggaggccaaggtgggtggatcacctgaggtcaggagtttgagaccagcctggccaacatggtgaaaccccatctctactaaaaatataaaaaccagctgggtgtggtggcacgcacctgtaattccagctacttgggaggttgaggcaggaggatcagcttgaacctggcaggcagaggttgcagtgagctgagatcatgccacctcattccagcctgggtgacagagcgagactctgtcttgggggggaaaagaaaaaagcaacatgctatcacattgcttgacttttgtcttgctgaaatttaaacgatagctggtctaacaattttttcttagtaaatagaattcttccattttagtatgattttattccagcaaattacacatatatcttttcacagagctcatgaaattttgatgatggctaaaatgcaagatattgagttgcttaattgatttgagttaatctttaatattggcattacatgccattatgtgactctctgctcaggagatagcttttcagtggtagattatttgctttcattttgctgcttatacttttaattttctgttgctaaatagggaggcaagccagtgatttatacatttctaactctgttcatagcttaattaagaaagtttgaaactatcattagttaggatgctttagaattatctgtgaattttatttatatattagccctattataaataggcattgttaattgagaatggagtataatttttagctactttgccaaacacaataaaaataacccatttactttctccaaaactggatagctggatgtggatatctttcagaagcaatggggtccttacaggacatgtgctttcatgctactaattttcataatttgcagccacaggaaaataattatttttaagtggccagcattcatgttgaaaatgagcctatttttcttggccatcaggacaaccatttctcttgaactatgataatcagttctgacatattgctttgagccttttctccttctgcatttcaagaaggttaaacattattgagcataaacgtttgtcccaggagttcagaagggcaaaaattatacattcgacctgaacatatactttaaagtggatttctgtgttcattcagcttttggagttttaactgagaggtgtctgaaaaatcattagccaagtttcttgtgcacgcgctgccctctccctttgtttggtgctttttttggtctctatgaaattgaatattagccacccatttaataaaatgtgaatgagttagtcaggcttgaattcttccactgatggcaaattatagaaattgtgatttttttttttaccaataaagagatatcacttggattaaattttcagattgttgatcttttgagttgtactatttcctgtttttaggagtaaaaggctgaatatggttggagaattttagaattctgtggcctatggcttgctcttaaaaatttgggttttttaaaaacataaaaataaacttttgagtttgaagatgggaaatggggtgggaagatcagtcagttggatgtcaggcattgtctgattcttttatcagttacttgttttatattctaattttcacttgttcttttatttctttgttgttgttgttttttgagatgagtctcactctgtcacccaggccggagtgtaatggcatggtcttggctcactgcaacctctgtctcccgggttcaagtgattctcttgcctcagcctcttgagtagctgggactacaggcatgtctcaccaagcccggctaatttttgtatttttagtagagatgcggtttcactatgttggccaggttggtcttgaaatcctgacctcgtgatctgcccccatcggcctcccaaagtgctgggattacagatgtgagccaccgtgcctggccttatttctttaggtatatataactttgagaaagatggtattttatgctgggcgtggtggctcatgcctgtaatcccagcacttcgggagaccgaggcgggtggatcatgaggtcaggagatcgagaccatcctggctaacacggtgaaaccccgtctctactaaaaaaatacaaaaaattagccgggcgtggtggtgggcgactgtagtcccagctactcgggaggctaagccaggagaatggcatgaacccaggaggcggagctttcagtgagccgagattgtgccgctgcactctagcctggcaacagagcaaagactctgtctcaaaaaaaaaaaaaaaaaaaaaaaaaaaagaaagacagtattttatattactagggactatattaagtatttcattaatcaatgttttaaaatatctctttcactaattatggaaccagataagttgaaaaacagaacagcactgctttcttttttttttttttcttttttcttttttttgagacggagtctcactctgtcatccaggctggagtgcagtggtgtgatcttggctcactgcaacctccacctcctgggttcatgcaattctcctgcctcaggctcccaagtagctgggataacaggtgtgtgtaccacgcccggctaatttttgtatttttagtagagacagggttttaccatgttggccagtctggtctcgaactcctgacctcaagcgatctgcccaccttggcttcccaaagtgctgggattacaggcatgggccactgcgcctggcctaatatactgctttctaagaaacgtactaaaatggtttctccgaagtaatttcttcattgtagttctatctcttattctgactttagtaatgagaagaattacatcattttagaggaaagagactgtattttgtgttctaaaccttagcaccagagaattgtaagatttcaatatatttttaataatgaatctctagactatttttctgaagagttatcgcttaactttagctaagagaaaattgtaaggtgagaagtcagggtgaagaatggataaaaggaaaatcatacattcagttattgtgatgaattaacaagttgggttgtatgttacatatccaaagtacctttctggatactcttttgaaaggtacctattcattgtgggaatagaaattttaaaaatgtctttatcatatgctacaatagcacctactttagtaatgggctaggcccagtttaattttgcttgagctatgacttaaaccttttagcaaacataagcactatcatggaggggctaagagtgtgcattctggaactatacagcctaatgtgagtttaaattctggtttcagcacttaccagctcagtgcctttgggcaagtgagttacttaatttctctgtggctcaggttcctccagtttagaatgggggtcataactttatagtgagtgttattgtgtggattaatctatttatagatttgaggaagcaagaaaatttaatcatggtatactacttaattaaggagtgaatgatataagatggaattaaccataatatcactgaatatggatgtatgcaaaaattctgtaagaaaggtataattctttatctatcttaatagggactgaatagataataactataattaataaacctagacataccactatatgcatgttacttggaactatttttttttttttccgagacgaagtctcgctctgtctcccagggtggagtgcagtggcgtgatctctgctcactgcaaactccacctcccgggttcctgccattctcctgcctcagcctcctgagtagctgggactacaggcgcctgccaccgctcctggctaatttttttgtattttttagtagagacgggggtttcaccgtgttagccaggatggtctcgatctcctgaccttgtgatccacctgccttggcctcccaaagtgctgggattacaggcatgagccaccgcgcctggccggaactattaagataaatgcagtaagatacgtagaaagttgaaagtggttgtgtctgagaaggtgggaagaagagccaggggaccacatttttttgtgtataatctatttattgattcgagtgcaaagagaaatcaaatttgttctttctcactaattaccatttaactcactctctactcctaaggaaaaactcaaggcaggtgccacaactttactggtgattcttagataatggaaagcccttgggtcactgtcaagcattaaagatttttgcttcgtctaataataatataactccagtctagcctcatgaattattacaacttcatattcaacgttaatattttttgccttctctcagcttgacagagattcaggctgcagtggcaaaagacgtggttggttttttccctctcttctctcctcattttctcctgttgttgtttttgactgctctaggattggccaaggagagaggggattaggggacaagggcctagttttgcacagcccttatagttatgacctggcagtttgtgtcctctgaatgtgttgtatttcctttcatctgggaaaagatttttctttgcttgtgtattcctgccttggtcctctgagcttctgatgcttcaccccatctgtttggtccctccttccatccacaaattcctcttggataggatccctttgaataggagcttaaactagctccctctgtccctgggtccatgacagatctcccaaaagcatgtgccacggaggggcagctcagtgccaagcatgccttttattccagccacagtcttcacctttagagtcttttggtgagagtcatattctagtcacatgttccttaaactccaggggagacatgttttacccttcaaggtgtctccttgaagccctctcccttggtttaaggcataggatatgcacaccaacctctcttctaggaggaaatgctcaagacataaatagctttctacaaaacaatctctcctcttggtttctggctttgtctaccctcttagagtggtgatgggctcatgttgctctaatctgtgtcacactgtcctaacgtggttgtcacagatggtttagcacagggcattgcgtacatttgtgggaaagatttttttttttaacttccaattcattacaggtctatacctggccctttattgcatgactggtcttcagttcacatcacactggtgatgtattatgtgagttcaacagcacctgaaacagtctgttcaacaagacaagtctgttgaccagttgtacttccaaagcaatgtcaaattattctaaaagtctctaaatacttccaatttctgtatttatcttatagcaaaccaataaaaacagttctcagactggtatttgtccatgggcatattttgagttgcactgttccaacactttcctttaggactgggggatagtggcatttattgtgttgttcccagcctatgggatatcagttgaaactaattaaaaatgttccaatttgatatcctgttagaatagattttcattaattccacacatatttattgtttgctctgtgccacagatcccataaaaataaaaacaaataactaaatttatttatatatttattttcagatggagtctcactctgtcacccaggctggagtacagcggcacaatctttgctcactgcaacctccgcctcctgggttcaagtgattctcctgcctctgcctcccaggtagctgggattacaggtgcctgccaccatgcccggctaattttttgtattttttagtagagacagggtttcaccatgttggtcaggcttgtcttgaactcctgacctcaagtaatctgcccacctcggcccccacaaagtgctgggattacaggcgtgagccactgagcccggccaaataactaaatttatattatgctaggaggtggtaaatggtatgaagaaaaatgcttcaggtaagggggaagatagtgttggggtgggatgatgggtttacattgcacagtcagggaacattctttgataaggtgacatttgatcagagccaggtatctaggtaagagccttttaggccaaatgtttttttagcattatttgcttcttataggcacattttactttgatacaaatacaagtcaatttaaaaatgaatggggaaaaaatgactaggagatacagacatggaaataacctttataaattaccctttaaaggagtttgcctaagaagagacaggaatttaggcagtaagctggggaggatataggattcagaaaggtctttcataagatgggagacatttgagatattttagggagatgaaagggggcctttcctgggcctggacagagtgcaggtgagggtaagagtagaaatggatacatttggggatagttagaagttgttaaagaaaaacagtgctgagaacccagttgatgttagatggttggacatttgtcgagggattaagctgcttcattgagtagtgttttcaaagcacatttcagccatttagaattgggagttaaggtgaatgtttcaactgatccaagatagagggtggacttgatagctctaaaggaggcagctgggatattgatgtcaagagaatgcttgaaatgatgcatcatgaggcttgatgaagaagaacaggaaatcttaacggcagtccaggaacagagcattagaggtctggattagcttgaagaggagtgagagagctggagagccaaaaattggaggtcacatttttggattacagtgagaggtctcagagttggttcagtaccaggtgatgtgatcatccagaatggggccatggcatgctgggagaagaagagagaagataaagattatttgaactcaggaggctaggaacttttgtggctgaggtgttggctggcccatccacattgaatgtggaaatcttcccagatgactacactcaaagtgaagaagaagcaatgagtcaggttccaaagtcctcagcaaatgagggagtgtgaccagaggtcagacagtgacaattcagggaaaggaagagagcggcattggatgatgtttccctccgggatttcgatgagacatgcaggagaagcagaagcctctgctggagaggtgcagaggtatagagagcaggcacttaacaaatacaacgtggaatgattaaggtaaggcaagcagtggagatggcactttcgtgaggagttagagcttcctgacaattaaatgaaggtttcaaagggcacctagaaaagagttgactaggcgggcagcagtggagcagctacagagtagcaaaaggatgatagtttttgagaaaagagttgcccatggggcttgaatttgggggtagtatacaagtatggtagggagaagtggtgtggtggataagttcacctgtgctaagattccagcagctctagggatggagccaggggtagccacagacagccctctaccattgacaccaataatctgtagcctttgctcctggcctgatggtgtgtccattagacactctggtctgtccttagggtccatgagctcttcaaaggctttttgagatcactgggacctaaatacatgttattgattccaaaataagaagcttggaacttaactttaaaaacaatctttaattaaatgactagtcattatttcaactgcccagttgcaattcaacttttgtataattgtgcataagtgaaatttaaaattacacaaaaataacttttaacaaaatatatttttcaaataataaaagccctttcaagcatttaatggaaaatgtattgaatgtgtctgagtatatgtctaatgtgatgagacctgtaaaagagtggctcagggccctgtgagcatcttaaaacatctctggcaggcggggcatggtggctcatgcctgtaatcccagcactttgggaggctgaggcgggcggatcacgaggccaggagatcgagaccatcctggctaacatggtgaaaccccgtctctattaaaaatacaaaaaaattagccgggcgtggtggcgggcgcctgtagtcccagctactcgggaggctgaggcaggagaatggggtgaacctgggaggcggagcttgcagtgagcggagatcgcgccactgcacttcagcctgggcgacagagcgagactccatctcaaaacaaacaaaaaaacaaaaaacatctgtggcttaggttccaaatagaagctcagtcaggagttgttagaaggttatgtgtttgtgtgcgattgaagatggtattagtaaagataaccaggcctttaatatgaccttgtttaggtggctgagaaagggatccagtagtctgaggaatctcacctttcaagggtgttagttttggcatctacttttggtgatttggtgctaattttattatttcttcgagatctcttaaatatcacatgatttgagatgcatgtggagcgattagaacggatagatatttttcaggctcatgtgggaaagaatgcagaatttggagtttaagaactggatttaaactggaacagtcacttatctcttttagccatagttttcccttatgtagaatgagaatgatagcaatgcacgtttcataagattgttgcagggattaaatgagataatatttttgacaagttttgtgagctattaaatgaactacaaatgtagttatgattgacagtggttttaggtggtgataagagggatgaaaagaaagtaagatggtgaattcatgacacccattggctcatgtgccactttcagttgtttatttaatttatataaatttaagttttatctattgattttttttaagagatgggatctcgctgtgatgcccaggcaggagagaagtggtgcactcatagctctctgcagccttgaactccggggctcaagtgatcctctcaccctggcctcccaaagtgttgggattacaggtgtgacccaccagaggcaactttgtttttaatttttatggatactaatagttgtacatatttatggggtacatggtttttttgttttgtgttttttaagagacagggtctctctgtgttgcccaggctggagtgcagtggttattcacaggtgtaaagtatactacagccttgtattcctaggttctagtgatcctcccacctcagtctcccaagtagtaggactatagttatgcaccactgaagctggcttacatgtggtgctttgatacaagcatagtgtgtaatggtcagatcacaattgggatattcatcacctcaaacatttatcattcttttgtgctgggagacattccaaacctcttctagttatttagagctatacaataaagtattaaccacagctatcctatattgctgtcaaacactagatcttgttccttctgagtgtatttttgtgctcattaaccaacctctcttcatctcccctctccgcccaaccttcccagcttctggtaaacacctttcaattctctatcttcatgagatccactattttaactccaacatgagtgagaacaggcaatatttttctctttgtgcttggcttactgcacttaacataatgccttccagttccgtctatgttgctgtaaatgacagaatttcattcttctttatgactgaataatattcctttgtgtatatatatatatctcacaatttccttataatttcatccattgatggacacttaggttgatttcatatcttgctattgaaatgcctcagtacattggtctaggcaaagatttcttcagtaagacctcaaaagcacaggaaaccaaagcaaattgacaagtgggatcacatcaagctaaaaagcttcagaggaaacaatcaacaaagagaagagacagcccacagaatgggaaaaaaatatttgccagctattcatctgacaagtgattaataaccagattatgtgaggaactcaaacaactcaagagcaaaaagacaaataatctgattaaaaaatgggcaaaagatctaaatagatatttccctaaagaagacatacaaatgacgaacaggtatatgaaaagatgctcaacatcactaattgtcaaggaaatgcaaattaaaactacaatgggatatcatcgcaccctggttaaaatgtctgttatcaaaaagaaaataacagatgctagcaggtattcagggaaaggagaatgctcattggtaggaatgtaagtttagtacagccattgtggaaaacaaaatatggaggttcctcaaaaaactaaaaatagaactactatatgatctagcatatagtagttcccactgctgggtatatatccgaaaaaaaaaaaaaggggggggggaatcagtgtattgaagagattctgcacttccatacctatttatttttaaattactctatctttctatctatctgataaatacctatacacccccactcaaaacaaaagctaagatcttggtagtaacctatgtctaatgatatggtctctttttccattggcctgagtgttcttactcaagataaccatcattctgaaacacatttcatcattctcttgtttccctgttcacagagttttattgctagtctatttattcctaaaaagtttaaattttttattttatttatttgttttcttagaggtggagtcttactctgttgcccaggctagagtgcagtggtgccatcatagctcactgcagcctcaaactcctgggctcaagtgattcctccacctcatcctcttgagtagctgtgactacaggtatgagccactgcgcctagcttaaaaaattttaattttaaaattttagttacttttaacttaataaaaaatgttatcatactttatgtaattatttgaaactaccttttttcacttaatatgctattgctaatagtattgctaataatattgttcactatagtttatttgtttcaacttttgtatgactataccacagtttgctcatttgctctcctgtaagtgggacatttgttttcaggcctttactgtatgagtgccactgtgcattttcttgtacatgcctcttactgttcatgtgcagtttttcttgtgtatatgcttagtggaattactggatcaattcttagtagaatcgctggacatacatgaaagttcaacttcaggagataatgccaaactctttttcaaaatacctgcacccatttatactttcctcagccacgtctaagcgagcatgaggagccacgttcttttcaacacatagtaatattagacttaatttttttttccagttgaatacatgcaatctgttaaccccattgtgggcttgatttgctttaccctgattgttaatgatgccacacctcttttctttttctttttttttttttttttttacttttaattgtatttattttaacgctgaatttactcctgtgctgtaagtttttgtttcttcagtttcttctgggatatctttttcttctaggcaaccccctcttctggtttaggaacaatttgttccttttcagtaaggatcatctcgatgtggcagagagagctcatgtatgggttaatccaaccatgagctctgtaggtccagcagtgtgtcttaggtgctttgtttatttggatatgctcaatgaccagagaatctacctctaagcccttaagttcagcatcactctctgcatttttaagcatgtgcagcaaaaattcagcactctttttgggccaccgaccttgtgtccggcctcactgcttggcctgggcacacctgccaactccagcattgtaacgttggaatggtacacactgtttctgtaaagtgacatctttcagatacttcgtggcttttcgtatatgcatacccttggtgtcctgggcagtttcacgagtgttcttaaagtgaacacgaagatttgaacctcttgatttgcatgactttgtgtggttctctgggtcaagtaaatagtgaaccattttcacagactacctcaggccacttaggggaagaggaagagccccacacattttttcatatgtttatatctttttgtatgtttattagccatatatgttttctcttctgcaaaatgtctgtccatttcatttgctatttttcttctttggttgtttgtatgttttttactgatttgagtgggttctttatatatacatattctttgttcactgaattttaatttatattattatattttcattgcttggtatttttgacagtctcttattcctaactcctacttttgatactcttttccctttatttaaatatataaaatatgtttattttatatgtaatatctgataattaacatacctgaagtttttgcctatggatttgtgtctgttgtttctatagtttcaccagtggggccttgtttcattgtatgctttgtgactttcttgttgcccaggatggagtgtaatggcatgatctcggctcactgcaacctctacctcccgggttcaagtgattctcctgcctcagcctcccgagtagctgggattacaggtgcctgccaccatgcccggctaatttttgtatttttagtagagacagggtttcaccatattgaccaggctgatcttgaacgcctgacctcaggtgatctgcccacctcggtctcccaaaatgctgggattacaggcgtgagccactgtgcctggctgctttgtgactttttaccatgagctctttttttttttttttttttttttgcagttgcaagatttaatagagtgaaaatagggctcccataaaatgggagggaacccaaagggggttgcctttgctggctcgagtgcctgggtttatatcccgatcattgtccctccccttgtgctctcaggcgatagatgattggctatttccttacctcctgtttttgcctaattagcattttagtgagctctctttactacctgattggttgggtatgagctaagttgcaagccccgtgtttaaaggtggatgtggtcaccttcccagctaggcttagggattcttagttggcctaggaaatccagctagtcctgtctcaccacgagctcatttttgactgaactttatctgtggtaattttagaggctaggcttgaaagtacatttctctagagtggatattctgttagttttgccagggaaatctaaaaaaaaaaatctcagctgggtgcgggtggctcatgcctgtaatcccagcactttaggaggccgaggcaggtggattgcttgagctcaggagttcaagactagcctgggcaacataacaagacatcgtctctactaaaaatcaaaaaaattaactgggcatgatggcgcctgcctgtagtctcggctactcgggaggctgaggtgggaggctcgtttcagcctgggaggttgaggctgagattgtaccactgcacttcagccttggtgacagagcgattccctgtctcaaaaaaataaataaaaataaaatctcagtttcagagtttttcatactgcatagattgtgtgaacttgggccataaaatacacatgagaatcagcttgtggttatgaagttttttttttttttcttctctgtccagccacaagcttgacatgggcaagtgtccttgcaatctcagggtatttttctttggttttcctagttcatgcttccctggctttatttgtttgtttctatttttgtgtttttcactgagactcctttggctttgtcttctgtcccctgagcaggtcgtcctactcttctgtctcctgtttgtcaagtgaaactttagatgagagggaatcagcctaacatttctgtatttgtgcttttgcttttctattgctctagcctctaagaatttttcttattttcctgcccctttgctgattcatttaaaaatattttatccagcatttttagctactgtacagcaggaaggtttgttaggaagtcaagtctgcaatatatctgagaaacccttgccttgtttttgtatgactagactccccaaaataggtcccctcagatcagagccatatgtaccccaaagttctagcatccatacctagagccaccaaaagttttttaaaaaatctgtacatcattatcaaagtacagtagccatcgtctgccaaggcatagcttttagtccttatttttagtataatttcatttctatgtagggctgtgcagtacatttagccaattgtttcttatctcttggtcttaaagcagatgacaaaggaccttcatttcccacagagggtagaattcatgtttacatagggtattgagaagtgctgtagtgactcacttatttcaactctcaaatttcagtacatatttgtcatttctgttaggccaaatcaacttcctaattgcaccatgttttgttataatttggagttgaacctaaaactccaatagagaaaatgttcatggaatatttttgtgataaaatcagataaaaattgttaaatagcagttgtgattgtcaaattattttattttattgttgatttattttatcattggtttttatttttgtttttggtagttaacaacattctaaaaaaatgttgtagtccaaaatacacttcttttttttgagaggacggtgagttgtggcattgggagagggtattttctgttttcttacatgtgctactcaatacacaatatctctgactcattagcatttaaacttagttcagggtaactatataaagaggctctttagaagtttgaaaatgaaacattaaaggtatggaatttgtatatcaaaaaagctttagagatgatggatttgtggacaatttaggaacatcaaaagtcatccagcctgagttgttgttttaaggaaataaggcccagaacagtgacctgagatgctgaactatcagaaccacgattggaaacaagacctcatagttgagaacactctcttcaacgctgcattgttttcctgtttatatgccatgtttagctaagcatttaaaattgtttatacttacaaattaaaaataattatttctacttgcatgttttgtaaaatgaactgacaccccccatgtttaaaattgatttagaaaacccagacatttaatgttttttaaaaaaactacataataatatttggaatttatgggagtattaaagaggcaacacagctttctgaagtttatttctagaacacgggtaatcaccatgactccaggcacacccgtctgtttattaaagcagaagaatcaagaagtctgagatgcagacgtttcaggatactagggaagtgaaaaatagttttttctgaaatgagagccctactattttttttttttttgagacggagtctcgctctgtcgccagactggagtgcagtggcgcggtctcggctcactgcatcctctgccacccgggttcaagtgattctcctgcctcagcctcagcctcccgaatagctggcactacggctgtgcaccaccatacctcaaaatacactgatttttgtatttttagtagagacggggtttcaccatgttggccaggatggtcttgatctcctgacctcgtgatccgcccaccttggcctcccaaagtgctgggattacaggcatgagcctccgcatccagccaagccctgctttttataaataaatgactatcattatttcctgtttttaaatcttttaaaaactcttttggaactttatcagctccctataactccagagataaccataaatgagactgtaaaagaaatgaagttataaagacagacatttcatatcaacagcatttttattgatgctgaccaacaatattaacagtagtgggcatttcttaagcacttcctatgagtcaggctctgtgcttggcaatgggcattaggtcatttaatatagcaaccctaagaggtagatattctttataaataagaaagccaaagcttagaaagtttaagtagtttgtccaaagtcctatagctaataagtagtgaagctgggtcaggaggcacagagctctgccagactgcagggccaggtctagcctcggttctctgttatccccccagttagcttgctgagagcaatcccatttctgatttatggttaggagggtttaactgtgggttgtgagactatgttgtgctttaaatctgttgttctgtaacaagcttcagggcaagtattgcaggcgatgataaataagataaataagaaataaagataaataagaaaaaactaatatttattgcaggaaattggaactcgttgagtacatacaaactgtgtgctagttagtatgggtgcttttgcaaaattcttttactgttcattttcccatttcacaaatattttctgagcacctgctatgggtttgccaccatgctaggaactggggacacagcatgaatgaaacaaagggcttactttctggtggaggagacagacaacaagcagattaacaagtaaatacataatgtttcagatggtaataagtgctgtgggggaaagtgaagcaggataaggggcatagagtaattggtgaggagggtaaagttacataaggcttttaggggaagaactttctttaaaaggttgacatttgagcagagacctaacagcacatcaggaggccttgtaagtcatggtgcaggctttggattttatcctgagtgaagtggaaagccacaggagggttttgagcacaggcatgatgtactctgacttaggtctttgaagactggatctagcttctgtatggagaatagatcgttgaggacaaggaggcaagcaagatcagttggaagatattttccaataattgttcaggcaagaggtgaatgtgacttggaataagaacaacatagctctggctgggcatggtggctcatgcctgtaatcccagcactttgggaggccccagtgggtggatcatctgcagtcaggtgttcgagactagcctggccaacatagtgagttggcccatctctactaaaaatacaaaaaaattagccgggtgtggtggcatgcacctgtagccccagctactcgggaggctgaggcaggagaattgcttgaacccaggaggcagaggttgcagtgagccgagattgcgccactacactctgcactccagcctgggcaacagagtgagactccatctcaaaacaaacaaacaaaaaaacaaaaacaaaaaaaaaacatagctctaatttattgaatgcctatatgtactttatgtatatcattttagtaatccagttgaatttagctatctttgtgttttagaagatgataaaactcaaaatctccctgtgccttagaaatgctctaatgggaacatttcagacattgtggcagcagtttttggtagcagattttcagactccatcagatcccatcaaagattatattctacctagagaatcaggaaggcaggtgagaaggtaacgccatctgtccctatgactcaacagagcagtaatgagcttttactttcaactagggaagcaaggctgagcatggtggctcatgcctgtaatcccagcactttggaaggctgaggcaggaggattgcttgagcccaggagttccagaccagcctgagcaacacagtgagacaattccctggccactcttcccccatctcttcaaaaaacaaaaaaattagccaggtgtggtggcacacatgtagtctagctacttgggaggctgaggtgggaggagtgcttgagcctggaaggtcaaggttgccatgagctgggatctcaccaccacacagtgagctgtgattttaccaccacacttcagcctagatgacagagcaagatgctctctctctctctgtctctcttacacacacacacatacagacacacacacacacacacacacacacacacacacagaaaactagggaagcagggaggtagattgtcacaattaaagtgttccaggccatatttcttttgaatggtgttctgaattgggctaggctgtttctgttaggacagactcatttgactccttgaatctctgtctctgtgattgtcagaaatggctccaggaaaaattgtgatctaggcagcttatctacttctaggagcctcagtgttcccttttcgttttatcaaaacacttctgcaggacatagtctggtggccttattcatactgaagcataaatgactgatactgtgccacttaatatttttcatccatgggtagtttgattagaaataaaaagctttaaaccaaaagaatgtatctgttactggaaatttaggcaacagcatgcaggtgatgtgaagggaggtagatatttttttcaagtcctcaaaatgatatatttttggtcatatagctataatcactgcaattctaagtactcgatatctagtttttgttttatctttttattttataataaaatgctatggaaatgtattgagtagtatgtgctgagcaggcatcatattacaggatttacatacattatttcattttaatactaatatctagtgaagtaggtatgattattcacgtttagaatacgagcaagttaaagatgttaagtaattttcttgtgtagtagtatgggtagttaattatggggctgggtgaagcactctggcttcctaactcagcttggtgaaagtcctgcctactttccataaaactgtaaaatgtgaattatggcaggtgtttctacttccctgaaatgtagtaaaggtgagtcataagtcttttatgcagtaatatggtagacaattgtgttagttagggttctccagagaaacagaccaataggatatattagttacagcacacatacacacacagagatttatttattttaaggaattagctcatgcaattgggctgggagatctaaaatctgtagggcaggccagcaggctagaaattcaggaaagagctgatattgcagtcttgagtccaaattcttcagggtatcaggctggaaactcaggcaaggtctctatgttgcagtcttgaggaaaattctttctttgagaaaccatggtctttgctcttaaggcctgattggagaaggcccacccactatatggaggataatctgctttacttgaagtccactgaataaaatgttaatcacatttaaaaatataccttcacaacatctagactgatcttttatgaaaaactgggtaccatggcctagccaagttggcacataaaattaaccgtcacatcaatagccagagattttcactaaatagacttttaaaggtacctggattctccacttgcaaattctgtagctggttcctgtgctgtggacaaaaacacaaggccagttgaggaagagagtgaaggatggcacaaaggaacatatagtcatatgttctatggtgtgcttgttttttgtgatagaattcatcatattgttttatggacacagatacacatttttaaaaattcttctttgctttattattgttggaggaagctattaggctggcttggaaatccccggttgagaaagggaggagaaaaaacacccaagcaatatttcagggtcaggagggcagctgtgaaggggaggaaggtcaggggattggaattcacacagatcctaagtgtacatgatgactaaggaggagaggggtgtgggctgcacagctgtagcacaggattctaactgccctgtgatgggcactgtgaaagaatgagtgaatttacttcataaatgcagtgggaacaattattacttacagacaattggaagtcagaagaaatagggatattgttatttttgtgcttttaagtagaatatcatggctcataaaatgttataagaaatatgtgtaaatggcgtgactattatgttccccaaaacaactcctgtgtgaaaggggacaatgaacaagatggtttatacacctttgctctctgtgtgtatgaggaaaaggatgaataaaggatggagtggctccataacacttcattaccagcatgctaccatctcagcagtcccttgcatgatgctgatcagctgcagcttctctaagggggcaggtttccaccactcactcgcagcagctccaggagccagagctatagttggaagaaaatgcaggtctcttggaagttggtgtctagccagccttgtatcttaaaccagtttgagtcaccacaaattaggaggcttatcaaaaagaacctcatcatcttgagctctccttgtatgacttgactgggacccactcattttcctactgctattctctgtctccccactattacagttttgcttgacttctgaccttcttctcattcctgcatagtaagctagtttcacttcttaccctagcagcctcagccctaccttcctccagccttcttttttccagtctctaaatgtttctcaaattcatcctctccattcccccccaatttcaatgatttagttcaggctctcatcatttattgctggaccattacagtaactgctcactaatcttgtctgagtgtgatccctcttcagtccatgagtcacacagctatacgggcaaactacttataacccttcagcaacaatccagctcctactggatgaagatgaagatgaagatgaagatgaagtctgggccccagtgtcacatgcaagccctgctgtgatcttcatccaccacctgctttccagacgcctctgctgccacttccacttgatgctctcaaggcaccttgtgcttttctcacttctcattctgggagactggttggataactcaaaggtcctaacatcttcccccctcaaacactatcttttcttacctgatttggaataaggtggcaacaagcaagaaaggaaatacattcccttcttccctggatctagaataattcaaagcagccttaaaatgagaaaggatgctggaggaaggaagtagctgctgtgctgatcccgttggtgggctctgtgtatgtgtgtgtgcgagagagagacagacagatagacacttggggcatttttagccttggttgtggcagagctttctttctgaatttctactcacatttgaccaagctgctgaagccaagctgccaagccaataaattcacccaacagacattattcatcaggggccccctcctaagacctgggattctgaagtacataagaaacagctgctacccacacggtgagtttgaatctcagtctgtacactctggggtaagaggtgttcccttgtctttttttcaactcacctcaggttctgactccccggtctccatgaggccaggcctggtgttccccatttcttccacctcagaattgtgttaaggttctggggtcctgtaagatgcataccacggtgtcagggaatgggagggaacatttgtgcctccaggttatgcccacctcaaaagattcaggcttgtggaaaataaaagtcaggtattcttgcaggctgtttctgcttcccgtcctgccatatagcttcctctaggggtaaagcaaggaagggacaggtccagatcacctcaggaaagagagataaaatgaaatctactggggcctttagtgcagatacgggggctttgagccacacagttgttccagatggatctcaggtgttctaagaggaggatgtgcaacaaatgtcagggaaaacccaaatattgttaaggacatttggaatgaacttagcatttattcttgagaggaggctgtggttggattggtttgctaccatgcaatatgaagcatcccacctgagcagagttttccaccaagccagctcagagggatcaggcactgatccctggttccgattgggtgcagcttaaggtagcagcagaattgttttcactgaatgtacatggaacagccctgctttcctcagaagagggcagtgggagtgccaggcacttaaagtttcatagactttgcttctgtgcagtaataaaagtttttgtttttaatgaaaaagtaattatttcacttaagtgtctactgtttgtagtgaaagagtaagtgtgtaaaagctattatcaaaagcaattttctgaagtctcattaatgaagacaggtaatgaaaatggaagcataaagaagatataaagacataactttgcttatgtgtcaatagagaagaactgaatatctataattgcttttttttttaacactaacatgtttgtctaagtttttgttgtctccagtaatggagacaatgaatttaaaagaaaaaaaccttctgaattacagaaagatatgtattggaaagatacagggacatctcaaaggaggtttaacaaccaagcttgggaaggatagatacggaactcatggactttgtatcctgagagctgttattaaggtgacacagttgcaataacttctagtttctgtgtctctgttgtttcatatttcctgaagtgacaattatattggcttagtcatctacccctggatcaaacaagtgtgaatagacaacatcacctaatagctaaaatttactaatgcttcctacctgttgaccaagggtaggtacgggagcaaaaaccagcagggagtcattagcagtagtgatgggtgggtgggtccagctagattcgtcgggagcctgagccagcatttacatgagtcatacagctttcttccatttcctgggcattggaaatgttaaccagggtatttggggatacagcagaatgaagtgaacacttggatgtcagtagaaacatggaactatctatttttgtttgttgtccatttaattgaaatattttgaaagctttctgttttgttttatcccctcttctccagttttcttatttttaaaaatttcatccccagtctatcaattaccacgatccctacctctcctcctctaccttttcctttactctctgaatacagcaatgtcatccatcacttacttcatgccaggggctccaaagtcatatgtcaccaggggccaggtatcatacatgcaaggactgtgtcagactggaaagcacaggtcctttacgtgtcctttctttaaaggggaaaccactagggccagtattccacatctgaatttttatgtgaaaattttccagtatttacatgtttgctgttaatttgtttttaaaaatgagtaggccagccacagtgcatctacaatgatggtgctatcagcagtgaatagttttggataggatactcttggaagagtgaagtgagggagctggggaactgcatctccaatctggcttctgaagggactgcggaggctcgacttgatttagcctctctctccttatcaactttctactatgagccatatttttatgtatgtatttatactattccactaaaagacatatttttaagcctaataagtgatgataagatgattgatatttaattataaattggcgattttgtcacttctgctctcccagttagatttcaggcccttctaagaaagaagcctataggtacttaagacatatttttaattaactgacataaacaaaaatccatttaaaatataagattaagtattttctagttaaatatatgttttcagtatttgagtttgtcttcctaatgcatttgttttgtggggctatttttagagatctgtttgcttttcctttaggcaagttatttaaaatgttcttcctttggttggaaagactatttgtagatactcaaatgtaaactagttctgatgtctctatttctataattttcatatgattgggtttaggtggacttgcaaaaaaaagatgtctgaaattttttgaaaattttttttacattttttagaaaaattttgtatttcgatactttgcatagttcttattttatttgtaatctgtttggggagatttatggaggtgtgggagcacataggacccaagaatctttgagtggaaagagaccacagagtaagtgaaggcttggtcccttggaataggagagtgctcactatacacaaagcagtctgggagtactgtagttgtacattttgaatggtttttctttgttgtgaactgatacctgtcatttccatgctttgggcctagtactgaacccagtacaagtctagtctttttgggatccccaaatatatggtaatctttagggctgtgagtatatgttcccctagtgccaaggaccacattttagggcacttagtaccatgtggtcaagagcacaggctttcatgtcaaaaggacctatatggaaatcctggctgcaccttgtactgacagaatgactgtggacaagttacttaatatccctaaacatcctttttcttattggatttcagtgagtattaaataagatagtcagtgaaaatgcttaaattataatcacccaataaattaggcatctggatagaatatactaaactgaaagaaaggaagaagttttgcagaatgtcttagtgctgagccttgattgtctaggattcaaagtgatatccctattgggaactgaaattaacatgttgaagaggtatctgcactcccatagtcattgcagcattattcatgatagtcaagatatgaaatcaaccttagtgttcattagcagttgaatgaatgaatgtggcatatatacacaatggaatactatacagtcttaaaaacagaaggaaacaaatctttgatacttaccttgtatacctgtgagagagaccatacagttagaggaaaatgacattgaaaattgtctccctcttctgtcccatcagcaagcttggtttccttagaaatacagtactaagtaacactaaccagtgtacaatcattacaccctagagtttgtgttctaaattccagtgttctttcataggctgatgaactgggcttctctacctagaaagaaacctttgacttccttaactctgcctgaaactgcttcccttgagtcagaacttagcagtaaccttcctgcttcctctccctctgatcccccttcctctcacctccacccaggctcttctgcctcttggagttaagggttcctgcatatctcccctaacagaagagagtgagagccagctaatggcctcaccactagaccccctcttccacacttactacctaaaggtggtttccaggtaagacttaactgagagctgtttatttgataaaagatttcataccttaattgttcaacaagttttgaaaattattaactaaagcaagcacaaggtgccccaaatttaccatatctcattttttcttcaaggagttaagcacattttccttaattgttttcttctacatctatttatttgtggtagagcttgttttccttgggatctctaaaatcagataatgtgctcttgcttttaaacttatttctaaataaaaaactagtcatataaggatagtcttgggccataccatatattttgatacaacatcgaggaagttaatatttgtacctacctacctaagggaattttaaagaaaattgtatctttgattttcctaattttggagaaaaaattttctgtttttgtttatataaaatatcaaaattatgtgatgctgaacctatgttgtgttcactgtattgtacattattaataaatgaatagcagaggaatttcttttatatttttctgtctaaaattatgcttaggactaaggcaagcaggtcatctttctttggtgacttctttacacaggccactgcttctagtgcttctctaagtgtttgtgaagaaatggtacgagaaatttcttagatcaaaactatcactttgtccttgcaacctgcacctgttgattttgtgagcacaggaataaactaagcaacacttaaacacaccacaaaagaccttgctatgggctgtgcgcaatggctcatgcttgttatcccagtactttgagatgccaaggcagaaagattgcttgaggccaggagtttgcgagcagcctggtcaacatagtgagaccccatctctataaaaatattaaaaaataaaattagcccggtgtggtagcatgtgcctgtagacccagctactcgagaggttgaggtgggaggatctcttgagcccaggagttcgaggctgcagtgagctatgatcatgtctctgcactccagcctgggcaatggagcaagaccttgtctcgtaaaaaaaaaaaaagaccttgctatttcccctcaattcttcattttgaaaatattcagatttatagaaaagttgaaagagtagaccaatgaatacttattgttagcctattatcacatttaatacttttccttgtttttattgaaacaataaaaataagtgcagacatcttgggtttcctcagcctgcatcttctatggataaggacactttcctgcataaccacaatactattattgcaccttagaaaactaacaataatttcctaatattgtctaataaacaacccagttccatgttcagatttccccagttgccccaaaatgtctttttagcttttgaaaaagaatcaacccagaatccaaccaaggttcatgaattggttgtgtctcttttgtccttttaaatctagaacaattcctcctttttgagtgtgtatgtttcatgtcattgacctttttgaaggatctaggacaattgtcttgtagaatgcttcacaatcaggatttgtctgtttccttgtgtgctttctatttttgggttttttttggtgaatattttgaaatacacatacagaaatgtgcttaagttataaatatgtgggtatgtgggtttatgaaagtttacttttcagcctctgggattttaaacttttggctactttgcaaacccttgtctctgcacttttctccgttgcctgtagagaatgcctattgccaagacaatttcttggcactttcctacagatcagggtgctaaggctgggcggcatccaatttaggcagttccattgtacttatctcagatcccccaccggggtttcagttaaagaagttattgttcagttccccttctaaaaatgttgcattatgtaattatcctggctttaggagatttgggttgtctttataccatgcgaatgaatgggctatcaggaaagtcattttaaagcttttggtgatctaattcaattgttaaaactgctttaataactaggttgtagaagacacaatatagtaggtccttgaataatgttgttttgttcaatgtgtttttgttaataatgttgatgagaaaaaaaaatgaattcctggctggggccactgtcagtggagttcacactttctccccatgccagtgtgggttttctgtggatgctgcagtttgctcccacattccaaggaagtgcacattaggttaattggtcccattctgagtgactgtgggcatagattatgagtgtaccctgccatgggatggtgtcctgtccaggtgtggttcctgccttgtgccttgagctgctgggatgggttcacccttgatcctgaactgtaataagcaggttggaaaaggaatgcatgaataaatgcaaattattataaaataaaaatttgtaaggtctacaataatcctacaaatgcatgacaataaacaatgtggtatgaaggtactcagtgggtctgccatatttgtgattggctttgaactgcatggcagtaggaggtactccttatatttttcactttgcaaacatttattccttgatttaaccccccaccccgatgactgctgtcatttactgattcaccaaaaattgggtaaataattatcttatttgtttttattaatcttccgtaaatgtatgtatagctcacgttgattgcagtgtttaatattagaagtgttttggtctttatttagaagtttggtgatatttttatgcccagaaatattatttgttgtaggaacttaactctcatttatattaattagtctatgtaaaattggttttattatatgtcctttgacttaaagcagcagtttccaagaacctattgatgattttaagtgaggatttactgtactgggtttttggcttgtaactatctagtgcttttttgtttgcagagattcagtatcagtccagaagtggctcatggtcatttatgaaaaaggccaactgttaaaaagtattatgacgtaggccagctttatcttcactaccctaattactctgcccccttgttggtatggttactccacagctctttcatgtatctcttgttttcagcatacatgccaaatggggatgacaaatgatggtgtgaattggggtcttaacctggggtcagtgggtcagttaatcccataaaatgatatgcaaagtttgcatgtattgactcttgtactttattctggaaagaggtttcattaacttttcaggggtgcctatgagcccagaaatgttaaaaacactgacttagttacttcttcacagagttgtccatattttctctgacccttgacataaaatctttttacttttggtaatctttttatgtgcttgtattggattaaaatattataaggaataaaattaaattcattcagaatcttagtcatcacccaaagataatcgctacttacatatgggtaactattacatgtacatgcacacgcacatattttaagaaatcattctttatgaattatttcttctttactaagtgtagatcagtaacatttttgtttaattgctatagagtagactatggtatccatataactatatttaaacagtctcctattgatggacctagctaccgaatttgtattttaataggaatcaaaccttaggcaacaatagtagaatactagataggaacctggggcttttgttgattacaggagccctcttcctttgtcctacctttctaagccccacatcaaaggttaggctctggcctttgggtgagagaacatatttgcttttcttaaaacaaaagggaactgtagttccgcactcttttctagcccccaagatagtaacatgatttggcaagtcatttcaaatcaataaagaatataataggttttctttaggatcaatccactttaaagcagctccatttaaatctgtttccaattttcagggttcaaatgggcctacttttatatagtttaccttatatttttaaaaagtattcatgaaaatttttgtgggaaaaaatccgatactttaattgttaaaacacttggatcatgtagcctgggagagactttgccacatataaatatgtatgatttccctcagtttgtgtgtgtgtgtggggtccatattttcctatgatatattgttgaaagaagtgttgttgattgtcttttcctctttttctctcttatctgtttaccaatgacactaccagattagaggctgcaccagtcaacacccatgggtccatgggtggtaactgttcccatctggctatgagtgattaatggtgtttatgtcgtggcataaatcacatttcgttgttcaatcagctgagactcaggccattaaaaaaatttactctacaaaaatcaataaccagtggtttttggaaaggagcagttctttaacagttattctccaagtctgtctgtaaagataaataatcaaattactatcctcactaaaatagtacaggtaacaagaaatataatctcacagataaaggatgaccttaaataaggacagataggaagccatttttaggaagatagaaagcagccaaagaaacccaataccctcttaaaagtctttaagaatgtcacccttttatgcagagccagccaaaaacaaaatctcagaaagctcaagatggattttcagaaaagcatggaaaataaactgggttgataatagcatgctgtgactgacctaatgccactcacaactccctatggattgtagctacaatacagaaaatcaattttatttactttttgcctcaagtttgcctaatgccttattgtcattagaaaaatatacagactgtaaataaataaattagccaagatgatgaaattttatgtaaaataaaatggaagacagcttttttggggggaaagaatagagagctacgtcttacatacctcactttgtgggaaatattacgtgaacttctaaaataatggggtttacacctactatgtgcccacaaaaaagaaaaataaataaaataaaataatggtgttgaccatgcatagccacaggcctaaacagattgaggtaaggttggtagtcctgatgcaattagagtttatttcacgtacctagggtgagtgttttgggatgtggctcacacagcctgtttgtgctgcagttgccactgcttttgtgggaagcccagtgtttttgctcaaattggagcatgcctcactgatttctgcctgtaacttgcttcttaggaatccatggctgcaagttacatttcaggaattcgagttataccagttttgcatctttaccatgagtctcagcgaagtagaattctcagtaggaaagtcaagacttccttttgatatgtcgttatgtttataattttgcagcagagatagtcaacatccttgtttccttagtaagccagtggctctgtaaataatcacaaacacaacccaacaaagaaggaaggaataacatcttgtgccttttccctctatggaagatattaacacttttatgcaagacatgaccctacagatttgctccagctagatgaagggaggactaaccttcaggcaaagtgctttggcaaaagcatcctgtttctcatttcactgtgtaatgaccaggagctgagaagagctctgtttcctgtcactgcgcagcatcattctcatttacattattggcagctgttactttgctggaagtttaaattatcttgagaactctaaaccgagttcagatgtttgtttattggtgctgccataggcttctgaaaacagtcttttgtgttctcccagtcttaagaaaaggctcttctcagaatcagcccttcctccctccttgctcttttctgggaacctgcttcagtctcatgaagaaaattaaataaagaggacaggggcttaaaactggtcagaacggagtctccagtggtgaggtgacttgaagcggaaaggagttgggactcaacatcctgcatttgtgctttgttttcgaaacttcgagttagttgcattgatgaattaagcagcaggctagtaatggaaaatatttctactgtcctggtgggggagccaaatactataggtttgtaacaggaaggctgttgattctggcttcattgttgggccagtcatttgtgagctggtggccggaccacaggccacacacttcttccgtgcaaatcttcatgtattgaaactgcctgtgtattgtttttacgattggagacttggccaagaaaagatggtgagctccgggttttatttttttggtttctgcatattccctcagctccgaggatggtgcaggatatgccagacccagtttgggggcagggagggcggcggtggttggtgggggagatgtttaaatcattgagcatatgtgagtattttgctgttaatgctttttctgtgtcattctctgtagagttccgggaacgcgtcctatcgctgctctatgtcttcctctgcggatttttccgatgaggatgatttcagccagaaatctggctccgcatccccagctccgggagacaccttaccctggaatttgcctaaacatgagagatcgaaaagaaagattcaagggggctcagtgctggaccctgccgagagggcagtgcttcggatagcaggtaagagcatctggggaaggggatggagtgggggaagagagttgcggaaattcgcccatctacctcctggggggccatagcgggagctgatgcactgggcaggaatctgtgctcaaggtgggggaggatgatgaccatgtttactttatgccttgttttaccgatagagccatttgccctgcctgctggtgactaagctgtttggccctgccttctggttggacgaatcgattcctttgaaatgcaaggaaatatttacagacatttgcactaaactttcctaattactgcattagttaccataacattctgaaagtattagctccagtgattgctagtatatttgcgggaagctggaagtgagcagcctttattttcatttttgcccaggggcactgagctacgcagattgagaagatccatggtttttggtacccaggattgcaaagcatattccagcaacttggatgttgtttttctttaaatgtagcatctctgtctgcatcattgtatccatagcagctttctgtccttagtgcttttgagggtttggccatcacgccttcctgattaattaatacatgagatgtgccaatgtttctgttctgtgttacccggtgttcccttgcattggccctaaaagctgaaccagaagtgatggcttgttttacccagctgaaagctgagaacactgtggaaatcaaccttccaacccctgcgtggtttgtgtgtatgtgtcctgtgcatgagaggtgcttccaggggtgttgttcctttcttccctcaatattttttttttctttctttcttggaaatggtaacagggcaggatggaatgtgtccttggggactttcttgcaaaggcagaaggccaggtgttctttaagtttgtttctgcatccagtggttcaggcttcctttccttccctctcttccactcttaactctgggggtccctttccacagttgttttttttttttttttttgcctcctatactgtattgcaaagttggtactttctcttcctccaagggggctggaggggaccagcccagattccggccatcaaggcagctgagaaccccctttttgtccccccagtgggattttctgattacgggaaaaacaaacagtgcctagccagccattctctagtcagggtttctggggcaacagccttgagcttcttctggcttccgctgtgagatgctggctggtctcacccaggcctttgaagagcaaggggtggagtgagaaaggggaggtggagggaggatggagactgagagtgagcaggggtagacttggagagtcaaggcagaccagaaaatgtttagtcactgaggcctgcctccttgccctgttgagaactttcccgcaggtctgaggctccagcgaaatgaatgcctatacagatgacactgcccataccagatgtttgactcagcagaaagggaagatagatgaaaggagggtgtgagtgagaagttactgggggctgatggcccacttagggcatcaaaatgggatacctgttctatgtattttttggaaggtagaaggtgcttctgggctgagagttttgatagtagtggcagagatggatattttgctttcagtaatgaaggagggagttatgacagaaagacagggcaggtgtttgttagggggaatgaaattagataaattgggaaaaactctactgggcaggaagtcatgagaaattggtagtactaaccatcattgtacactgcaggtggggaagatattgaagaactctatgttctaatgggatgcagtgtacatgaaggtgctgatgctattagtagactgtggagtcattgatgcaggggccatcgcttgttaattgtaaaatgttcactgagtttgtagggatagctgtgaagttggtggcaggtgatgcactggggatctcaaaattccattctttagaatttacaggccaggtgtcgtggctcatgcctgtaatcccagcactttgggaggcccccgtgggcggatcatgaggtcaagagatcgagaccatcctggtcaatgtggtgaaaccccgtctctactaaaaatacaaaaattagctgggcgtggtggcgtgtgcctgtagtcccagttactctagaggctgaggcaggagaattgcttgaacccaggaggcagatgttgcagtgagctgagatcttgccactgcactccagcctggcaacagagcaagactctgtctcaaaaaaaaaaaaaaaaaaaaattgcatgaattcttcaaaagcagaaaaaaataaaatgaaacaacaaacagtagggaagcatatgatttaatttaatttaattaatttatttattttgagacagattctctctctgtcacccagactggagtgcagtggcataatcttggctcactgcaacctccgcctcttgggttcaagttttctcctgcctcagcctcccaagtagctgggaccacaggcatgcaccaccatgcccagctaattttttttttgtatttttagtagagatggggtttcaccatgttggccaggctggtctcgaactccgtacctcaagtgatccacccacctcagcctcccaaagtgctaggattacaggcgtgagccaccacacctggcctatgattgtattttaaataaatattggtaaattagctttttgctaggcaaatcataaacaataatcatacatggaggatagacttggggggccagtccataaatatctgtttaacttataatgtggctaaattatgaaatttagatatattatgtgttaaactggccactcatcacccagtgtgaggatgagggtacaggttatctaatggaatttggtgctgtagatactatgaaaacatacaattgaaaattcaacttctaattttgttatatattttcatactcttcctgaaacttaccccctccctgaaattcaccctttttaggaaatgaggtgaagttcagaaatggtgtgaggatgtctatagtggtcattacttagtaataaaagagctgagagtttagtattttcatttgtttttaaggtcctaaaaatagaattgattgtgaaagtgtctattgagtcaaaaagactatgtggtctgtgggataccttaattcacccacatttagcaactacttattgagcccctgcaataaaatgaagattagcatacagttctgcctttaaaaagtcatagtttcaaaagagattggtgaatggacacaaacttacagttaaaagaaatgagtcctaatattccatagcagagtaggatatctatagttagcaataatatattgtatatttcaaaatagctagaaggaaggacttgaaatattaccaatacatagaaatgataaatgcttaaggtggtggatacctcagatactctgacttgatcgttacacattctatgcatgtaaaaaatacttgcagtatggtgccctcattaatatataaaatatcatgtatcagtaaaataaaaaagaataagctggaaaataaaggtcatagtctaatatgataaatggatgtgttgttaaacagttacaacgcggtaattattagttgttacagggattagttgagatggctataagcacctaaaattaaaagaacccagaggacagtgtaattaacctgaggggagaagggaggcatgggaggttcctgaaaggtttctgagaggaagtgccacttgaattgagatttaaagagcttgatggaattagggtgaaagggaagcccactttagagggatggaactacaagaacaaaggtagggagatgggtgtaaatgggaactgcaagtaaagtgtgttgctaagtgtgggatttggaagggaaagacagaaactgtaaagatgtttgtgtacaatcctgaggcaactggactatttatgttgtaagtgctagggaaccattgaaagatttttaagcaatggaatggcataatcaggtttacggtttggaaagtcatattagtgaaggcgtcacatgtcttaacacttcttattatttatttgtttatttaaaaatttatttatgagttgagggtttgctctgttgcccagggtggagtgcactagcatgatcacagctcactgccacctctaagtcctggactcaagggatcctcccacttcagcctcctgagtagctaggactacaggtgtgtaccaccatgcttggcttattaaaaatttttttttatagagatgggttctcattgtgttgcccaggctggactcgaactcctgggctcaagtgatcttttctgcctgggcctcccaaagtgttgggattataggagtgagccacagggcctggccaacttcacttttttttttttttttttttttttgagacagggtcttcctctctttctcaagctggattgcagtggtgtgatctcagctcactgcaacctctacctcccgggctcaagcgatcctcccaccatagcctcccaggtagctgggactaaaggtgtgtgccatcatgcctggctaatttttgtatttttgtagagacaggcttccaccatgttgtgcaggctagtttcgaactcctgggctcaagcaatctgcccaccttggcctcccaaagtactagtattacaggcgtgagccactgtgcctggcccaacttcacatttttagtctttagtgcttttgtatctgttgtggtttcatcatattaaaatctgagactatagtatgtttacttcttatctcctagggtcaatgtgagaataaaacaatgaaatataaggaaaggggcttttaaacacccattgtataaatgctttttacatatgagcaatacagatctgctgttgttagctacaggatattgtaagttgggtttttcagtcataaactacctgtaaagttacatggtttgtcagtgataatgctattttaagaaaaggatttttgtcctatccaaattcttcgaagttggaattgaaggatcaaaggagaatcagactttgaactcaggcagacttggttttaattccttctctgtccatgactagttgtgtttacttggacaatttaccaaacttatcttagcctcagtttccttatcaaagggtcatggttgtggtgattaaatataatagtgaatgcaaacaattctgctacctccttggcacatcaaatgctttataaatgatagcttacccatggccagatgttcttctaagcacttaatatggtatcctatttagacctcccaagaaccccatgaagtaggtactatgattttctccattttcagttcagaatctgctgagaaaggaagaaaaactttgccaaggttgtagtgtcaagaagtagtagagctaggatctgaattcaggcagtctttactccaaagtccaagctatttactgctacgcttttgcctcttctctatggaatacactattattattagcatattgacccaatgttacccttccaagaatgcatggggtaaaggctgtttttaaaaacaatcccaaatgttgcttctgctcattttgactggttccttaaatggatgattaaaattactgtgtgctgactatattcataaaactgggtgctactgggtgtcagtctctgatgaaggctcagacgtgccttcaatgaccttactcattgtaaaggagacatttttgagagacctatgtctatacatgtgtggtctgtaaatgaatgactttcagggacttaattgctaacccttttatttcaagaaggtgtcccatatgatgcctggttgttactttatgaactaatgtgcatacaaatgcatatcgagctgtaagaaaactctagtaaccttaaagacttactgggacagtggttcaaactcagattataaaccagtggtcaggatagaaaaaagagatgtggtcttgctttgtttggagtaacagaagtaggccaattgctgaggagtgctccagttctatctcaagtcagtttttttttcccacgagtacacaattttttctttcaagaggaactcatccctatctaagcattaatggaaaatggtccatagttcacaacacccaacgctaacaaagaaataaaaaatcatggagggcaaaaggtcagtatatgtgaaaggaggaaatagggaaggaagatttagacaagacgtgaagttgacataggtcagactgtcaacaatcagctgatttatctaataatagcagtagcaatgaggtatcatcctgtcactgtactccagcctggatgacagagtgagaccccacctcctaaataaagtagtaggtgcagcagctaatccttatataacaccagacattattctaaacttcatttactatacaactttatgagttaggcactactatcgctgttttactgatgaagagagtctcagagaggataagtaacttgcccatgtgacacagtaaggagtgaagattctatgtacagcagcctgacttcactgttttttttttttttgagacggagtcttgctctgtcgcccaggctggaatacggtggcgtgatctcggctcactgcaacctccacctcccgggttcaagcagttctctgcctcaacctcccgagtagctgggattataggtacccgccaccacgcccggctaaattttgtatttttagtagagacgggatttcaccattttggccaggctggtcttgaactcctgacctcgtgatccacccgcctcggcctcccaaagtgctgggattacaggcgtgagacaccgcgcccggccagtcattactcttaaacacatccatttacatgcctgggtatcagttggttcctccaatggacgcttaaactcacccactttagtatatgatacacatatatctaatttaagggaactgtatccattttactcagtttaatggatactagtactatgtagaatgaataataaggagagagcaggagggaggtgataaatatggggcagttgtgaacctataggcccgccgcggagcccagcagcagatgcgcctgtgggctctggggggcagaagggagggaccgcaggctggtactcggcagcctcgcggcggccgggagctcaggcgcaggcgcggcccggctgtcaggcgctgatgcgcggggccacctgcagaggcctcctcaccctgtccccgggatgtcccctagacgcggacccccgtgccctccttgccctgtgctgtcacagagtgacctgaatcctcccacgccaaaaagatgggtggaagaaagtatttccaaccctccccccgatcatcccttacccagggagagccgctggcccctcagcagggggctgcgcacagcggtggagcgatctgcggctttgtttctcaggcacctgttgtggatcccaaatagaaacgtcgcccttggggatccgggaccgggcagccagtgtccgggggtgggcgtgcttggccgcacggtccaccagggtgggcgggcctggggagggggcctggggcgcgtggctctgcctgggagggaggggccgagaggcgccggggccggagctgagccagccggggcgctgaccgccgcgctcgccccctcccttccgccctccgccctccaccctccaccctccaccctccactctccaccctccaccctccaccctcctccctccctctctccccggcgcgggcgagtgtctgcggcgcggcggccaggaaatgccgcagatgcgccgcgcagcatccccggtgaaggcagcgcgccggtcctcccgcaccgctgccgcggcctcggcccggcccgaagcacgcgcctcgtgcagggccagcagagcggtcagcgcggccgcagagggtccgggcgcccgccggcccccgcccgccctcgccgcacgccccgctcctccgcttggcgtggcgctgctcgtcgccgcccctgggctcgctgagatttgccgctgctgaaacccgagagggactcgggctcccggagccgggcggcccaccatcggcctgcccggaggcctgggcgtttcctttgccggccctggcgccggcagccccctgcgcccccgctctgcgtcttcggcttccgtgcttctccccagcgtgctgctccttcctcttttccagttcccaaggctgtgtcttgctgactgcgatactgtccgggggttacgagggggagaggggaatttgtcagtcatcgcttagataaacttcggcatggcgggttacctctcccctgctgcttacctgtacgtggaggagcaggagtatctccaggcctacgaggatgtcctggagaggtacaaaggtatgtggtccctgccctggggctgcggagcttggcactgatcagagaggcaaccgctgcctttccttaatcagagccaccactccttgggcacgagtaaacaggtgtctggaccagtcttgggaatggaccaggtctttttgcacgggatttagtacccccagcgcagggaggatggtggggtgggcgacagtccggagacgcccttagatgagcggtagagaggggggaagggggttgtttccaagaagcacattgcgttttctctcccttgtaaaagctcttaagcactacgcgtaatcataattcttcctgggagggtggataccgattattctctatgggattactaaggcattgctgctgctgcttggctagggtattggttagccctgtagaaaaggttcagcatcactagatcattttccttaaaatgatctttcttatttgataaagtttgtgactatatacttactctgatatattgtaaaaattattttatagcgtgatggataaaagactttagtgagtttgttgtaaatttaaatgtaaagaatgtattttgagatttttttctgcccatcctttatgttcaggaaattctatgccaatctgatatttatgttttagtataatgtttacttggacttcatagttgaatataatgatgaaatacaaattgcagctgtccattttttaagtgtttttgtgtctggaaatgtatttttaagtgtgtgtataccatctttttattgtggctcccaaaacactccgaactcaagagcagctcacagaggtttaaagtatttatagtgaatagtgacccatttcataggtaggattcagatggttttatatcttttgaatatttgctttgggtttggtaactcaatgtcagtaatttcagtggtattatatggttaatgatgcatgtagtttttctattagtagaaagtagaaataaaaaaaaattgaactaaacaataaaattccaaagccccaaaaagcccaaatacactcacaattgttttctctctttgtaggatatgttttataaccgaaattcttgcaatccttgtagaattttgtaaacagtacaatgagaattcctttgtgccaagactcttattgtgtataatactgccactgagcaagtgcagtgatattttaggctaaagcacatttgtgacatttgtgtgtgtgtgtgtgtgtatgtgggtgggtgggtaatatactcatgtttacctgcatcactccattttaaagtaaggtttgtaattagttgtttccagagctttgaaaaggagaaatattgcaatatagaccaacaaaccttattgaagaaatacatctgtgctctatacagtcagaaataaaaaaatctgaaagttctaaagtagatacattttatacttttgaaaaaaattatagctgaatgaatttttgtcacatgaagttttacttaagtgacacgtgggtgatttcaggtgactgaaaacgagtgcttatttgactttgtctaaaagaagtaggcattgtttaaaagcttgtctttgcctttggaaataaaaggaaattaaagatctgaaggccagtgtacaacaatcagtattgcccttaaacagatacattttcaaacatattgttcagacgtcactgaaaaaatgatgggagttttcctcatttttacttaaggtttttaaaatgcttagttcatcaatttgtacttgggctttatagctgtgctatgtttcatttagtcatggaaaggaaagtaagagtattgggcagtgtattccatgaaaagctggagacctggaaaactcattgtttcccgatgtgttttgaagccagttatgatttcccatcagtatccagtatgatgacttcactacactgcttattatcctggtgacttgctgtggggactgatctaatcagaaaagaattgtaggctttgaatagggagtgtcagttcactaaacgttcagagtacggttgctcactttctgaaatcatgcattgttcaaaacattttatgttctcatttaaacttaaagggaagtcattttgattttatttctgacagagttccttggttacagaatgagtttgcattcatctagaatattatcaggttgccaagttatcatatgcctcagctgttgagtagtgtaagtggtggagtcagctggaaccaattcaaaatctgcctgttgtcagaaatgtagaattgtaataatctataatgttaggaattatgagcattagatttagaagtcgagagttttgttaggtctagtcttcagacagccttgagaggagttcaaatcagactctgtagaaaaacaagaaaagtggagagtgagcgctaattatttatggtgtagtcagtctattcttgtatcttgttttggtccattacttctgagcaaaaataggcaactgtttgctgaattagaataacacagaaagagctatttgctacaaagaagggtgcagtgttctgattcatattcgagtcctgttacttgtaaaatatattcatggaatattcagggacatctgattaaaaaaacatatttcttcagctgataccaaacttcggctgaataaaggcatttatttttgagtaaaacataattctttattattgtttaggctagaaattgtctacatcagaatggctttcttttatatctatagtaaattatccagtgtatataccgtgtaatacaaaacattcttagtagcttagcttaaaagatacagtagtatcttattttttttcttaagtgtaaggaaactaacccatatgctgttattataaatgattaattagttctcatcttatgaaattctgctttttgagtttatcattggaatatttgttttcccaacacattgttactttgtagtatgatgttaagtgagaaaatgagataatgtgaattcaatacatttcattctataccttatagatgtaattttaaaatgttacattattttgttccaccaaaagggttatttttctattgatctggaagtaaatccgttgtacctagacaaccgtaatgaaagtgttgcatttatcattctctatgaaagctgcatggaatggtcgttttggttacttacctgtaatatcactaaccccactccaccccctcaccccctgcaaactgctgtttaggcaataggcaaagttttctctgttttttacaaataccttgtataattgctttagtttcttctctcattagggctataaaatctgcttatgtgcatggtgacaaaaggaacgaagattaccataattttcattttcagttcgggtttattgcctttattgataggtgattagtaaaaattctgtcattttactctgtaaatcggctctgacactcccttgaattgaaaattggagtatacaggtttcagggaatttctctgcagcatgtaatgatctagctcagtggttttcatttggcttccaggattctgaaaaaacttgatttcaaatttcttctgctcatgctctgttcataggttaatagttatataataaatgaactttaactgtgctgcatcatgataatattatagctagtcataatagtataagtctgggatttttgttttcttttaaaagtgaaacaggttgaatttgctgagtgttagttaagattatgtttgactgtttgtaacagaaaacaaatgatactgcttagccaaataggtgttttctttttcttaggtactgagaagtcctaaataggcaaaactgggttgtagggtacccccatttgccagtagggactcagactcctctatttctgtgtggctatttatagtgtatcttgtggttgttttgtgatcacaagatggctgctcctcttccagcccttatatctccattccaggggacagctgttccaggggccatctctatctgcaggtagactaggaaatgtagatttttaagccggcttcatttagtgccctgaacaaaattgaagttttgtttgtaaagaataaggaaagaatggcaactggttttgcaatcagcagtgtctggcacatggagggcaaagtgtgctaaaattgggaacttaaaatttggatacatattaacaatcatcacacaatatatttgacttcactaaagtttgaagaagatctgagagcaccatgaggtttcttagtattttcaaaatgacgcatttgaatgttttatgttacaacatgggtttgaaaagtcattctcaccaaataattacgattaaattgtgtttattgcctcacacaataaggagtgtatatgagttcagaaatgtgggaaattattaggtattgttagtgaatttaattttaaacttctactgatgctcttttcagtttcttttgttcttagagagttatctcaacatttatttagcccagagactttaaaaagaaggcttatgctttttaaaacttctaggttttttttttgttgttgtttgtttgttttgtatttgaacaatttggagatgcttgttttctggctcaataactttttaggtaatcagtgtaaggacaggtggtgaaaacaatttattgtcttactgctatcttgtagtctgacaaagaagtgcttgtatttctgccgttgggtcatatgtgcctcaggatcctggctctgtggggagctggaatatttgaccaaagcatcttcatgcaattggagattatgaaaatatctgaagctatagaggtgataacaagatggaatatctaggctgtcatgttcatttctgttttagttccacaactgagtataaaagtgcacaagaacacacccaaatcatgtgacctggtggactaattgggaagaaaagatgatttgtagtttcgaatgtttgttatttcatattaactaaacacagatgcttctgtttcatggaagtctctctataatggctttgaataaaaaacaggaaagacttctgtgtccatttcttagctcttaatatttcagggattacattctacctatgtccaaggaggaatttcaggtaattatttgctgaagtatgtcattgtttcagtaagtgatcaaatgagaccccttcttattcattttttttttctgcttgtcctttaatgcaattttgtttgcttttgttttctgacttgcttcatctctcccaaaagaagaagcaaataattctgcttaggctggggaaaagctttgtatttggggtcaaatgggatttcaccctgtgagaaggtgaaaagtaccagggaggaaaactccaagaggagaaactagcatgactgttccatttcattgacataattgccaaaatcattttgatcgttggctgaagtgcaccgcaggtttcagggaaaggattggttagaatttgtaggaagatggatatggatgaatgatggagggttatgctgtaccagattgaaagcaatcttgagtgcctattctttaggcagtgagggtgaccctttatgatccccagcaggaagttagatagatattagaaagagcactctggcagcagcgcggaggactgagtggaagggaagactcaggcagggaaacaggttaggtgggtactgtaaaattatagtggttggaatggaaggctgattcaagagaaatttcagaaattgtcaggatggccgattagttggttctgcatgtggggacaggaggcgggtgcagcaacttttgttgttgaagttatgtccaaaaaagtttgaaatgtttcctttttaagtttttaaaaaacttgtagtatgtatttattagaaaaggtgtttttaaaacatttttattattaatcacagttagacctttcttggtagttaaatggaacgaaagctattttgcttgaccttggaaatacagcaagtagtgtgccctagaaaactggaatgctctatttaatgtagagcgctttaagtaataccttatcagtctgtttgttgtgaatcctctgagcatgattagtagcatcttagagcagtggatctattttccataagcaaataaaataattgaattcatatccttttaaaaggtaaatatatatggtgaaaaaactttcaatatatttcaataatttttaatatttgtttttatttcaaaaatcttaattttttctttgtttattttctttttttctttctttttttttttttgagatggagtctctctctgtggcccaggcgggagtgcagtggcgcaatcttggctcactgcaagctccgcctcccgggttcacgccattctcctgcctcagcctcccgagtagctgggactacaggcgcccgccatcacgcccggctaatttttttgtatttttagtagagacggggtttcaccgtgttagccaggatggtctcgatctcctgacctcgtgatccgcccgcctcggcctcccaaagtgctgggattacaagcgtgagccaccgcgcccggcccctttgtttattttctacataaacttcagcaaatatgtagagttagtttggtttggtgtataaaaagttaagtggttttatgttcatttaagttctcggctaccctacaatttgagcattaagccttaaattttaatttaaaattgcaaaacagtaactaccatttatatgtcaacctactcatatgcctggcatgatgctgggtattgcatatgaaatacatatatgttatgtatatatgtaagtttaaagagtcgcatagctatagtggtagaaatggcatttgaacatcaaatgtatatttggcctaaactatatatttttagtgtcattatattgactgggagatactgcagaaatagttatgaaaatatatttattaagattctgattttgattaatactacaactttctcagatatgttaaatgcatgaaattaaagttaatagtttatacatttatagatattacttttattcaaatattagattttggaagtcaaactgttgtgtcttagttgtattatcaattctaatgattagttataaaaagacaataaaattttaacatgagcatttccagtgtgtatttgggtcgagaagattttgaaaagaactgtttttgtaaatgttaccaatgaatgtgactgctttgatacatgcctgaaatgtttcctggaaagaattgtcaaagagcgttgacaaagtcttgattttactctagtgggtgaaaatatttcccagtgaaccctggtattaaagatattatacaaacatactattgttctagtgcccctgtattcagtgctatggttttccatgctgggcatgccagtgtaatgatgtattttcttgattttggtgtgaaatactactacttgtctagtgaggtagatagacactgggttaataaaggcgggataaaatagggcatatggaatattctgagcagtagagattatgtaggtagtcaatgaattaggtagatctaagaactcaagtactgtggctcttcctacaccagtagtcttttaaaaaatgcacacattattttttagagcagttttaggtttatagcaaaattgagcagaaactacatagttcccatatactccctcttcctcccccatagtttctcatatttatatcggtactggtgtggtacatttgttggaattgatgaaccaatattgataaattgattcatcaattacgtagttgattacaagattaatagtttacattagggtttcctttgttgtacagttctatataggttttgacaaatgcataatatcatgtgtctattattgtaatatcatacagaagagtttcactgctcccaaatcctctgtgtttgacctatttgttcctctccagctccagaacccctgacaaccactgatcgttttgctctctctatattttatgtttttacagaatgtcatatagttggaatcctgcagtatatagacttttctgactagcttcttttacttagcaatatgcatttaaagttcctccatgtcttttcatagcttgatagctcatctctttttattgctaagttcattgtctggaagtaccaagtttacttatccattcaccgactgaaggacatcttggttgctcctaagggttgacagttatgaatacaactgctctaaacagttgagtgcagatttttgtgtggacatgttttcaagtcatttgtgtaaaggagtatgattgctagattgtatggtacgtttagctttgtgagaaacttgtctaacttgacttccaaagtgggtgtactgtttttcatttccaccagcaatgaatgagagttcctgttgctacacatcctatcagcatttggtattgtcactgttttgtattttagcctttcagataggtgcgtggtggtatttcattgttttaatttgcagttccctaaatgacatatcatgtaaatatctttttttttttggagttggagtctcgcactgtcactcaggctggagtgcagaggcacgatcttggctcactgcaacctctgcctcctgggtttaagtgattcccctgcctcagcctcctgagtagctgggattacaggcatccgccaccacgcctggctaatttttgtatttttagtagagatggagtttcaccatattggttaggctggtttcaaactcctgaccttgtgatctgcccgccttggcctcccaaagtgctgggattacaggcatgagccaccgcacctggctggtatctttttatatgcttgtcatctgtgtatttcctttcgtgaggtgtctgttcagatcttttgcccgctttttaagcattttttattttgagacatggtctcactctgtcacccagactggatgcagtgataaaatcataactcactgtaaccatgaacttgtgtctcagcagctcctcctgcctcagcctcccaagtatctgggactacaggcatgtgccaccatgttgggctaatatttttatgttatatagagacagggtcttgctatgttgcccaggctggtcttgaattcctgggctctagtgatcctcctgccttggctttctaaagtgctgggatttacaggtatgagccatcatgtctggcccttttgcccactttaaatttttttttttttattgttgagttttggagttttttgtatattttggataccagtcctttatcagatatgttttgcaaatgatcagtaacctttttataccattacctccttttgacacctttgagccactgcatattatagctattatttaaataaataaggacctgattatttccttttatatggtcatagcattcttaagtactattttgttttagctatgtgtgttatttattgtatctgcttcatagagttgtatgtggtgactctgagttcagcaatctgacagtttgctttggtgtatctaatatgctgttgtagctgcaattcaggtatccagttggttggcagctatgatgctttataacacttgagtctaaaattagtcgaactgttctattttaagcatacactgaaattagtagtccatgtcctgtaaaacatgtgaaagttaaaaactcttaggatattgaattacttcttttaaaatgtaatcagaagtagagttggaaagtttgtaagtaagaaagtagttagtgagaaagttttgttatggtaatttgattatggcctggatgtagtgctatatgtatacagtatccacaaacacagtttcacactgttgcctcttagagttaagacagtgctttcacgtaaatgattacatgtgattttaaaaacatgagttgagttacagcaagattatttgctttttttctgttaacatattttagaagagtcgtagttcctaaatgtttagaattctggaacactattgactgcctttgctagaaaaaagagagtgattaaaggagtacttggttgttcgtcttgcgatcttgtgataaccttatttgtgtaacagaaactagataatgttgaaaataagtcagggcatggtagctcatgcctgtaatctcagcactttggaaggccaaggcaggtggatctcctgaggtcagtagttcgagaccagcctggccaacatgtgaaaccccatctttactaaaaatacaaaaattagctggatgtggtggtggacacctgtaatcccagctactcaggaggctgcggcaggagaatcacttgaacctgggaggccgaggttgcagtgagctgagatcatgccattgcactccagcctgggcgataagagcaaaactctgtctcaaaaacaaaaaaagaatattgaaaatacttagtagataaaaagcggagtgattcaaattaagagtttgattttgcatataatatgaattttatacctcttgaagcaatagtttgtgctatagaggcatttttttttttttgcagtgttatttgactatctctgcattagtctgttttcatactgctgataaagacataccagagactgggcaatttacaaaataaagaggttggacttacagttcctacagttccacatggctggggaagcctcacaatcatggtggaaggcaaggaagggcaaggaggggcaagtcacgtcttacatggatggcagcagacaaagagaaagaacttgtgcaggggaactcctgtttttaaaaccatcagaatctcgtgagacttactagaactagtaagttctagttactagtactcacaagaacaacatggaaaagacttgcccccatgattcgattacctcccactgggtccctcccacaacacctggaaattcaggatgggatttggccaaaatatgtcagtgtcctttaaacaatctcagaagctctaacaatttaactactatagataatgtgtagtctttatactttttctttgaacctttttggaaggtctaaagcaggactgaaggattctaaattacagaaagcaagatgcaaggatgctttagttttcttgtggaaaaagacctgtacttatatatccctttccatttagaaaactatatagaaatttaaatttgtgcttcagtagaagtaaaatactgtaaatggaatgaaatacttttataattagcattttttgaaagcattcaagcagcattgttcccaacctttctcatatttctagtcagaaattaattgatcatatgcttcaagtgaacacattaccatctagtatattctctattccctcatacccatcgtattttgtactcagtctttccctggaaaaactgggaagagatgaaggatttagaaccgggagaagcagatcttcaccagtttggaacatgtggtttaattccaaatacttattgatcctatacattaaaatatgctaaggaatcagggcctacagaaggaagaggaacacaggtttgtagcctctcaaagagcagagtttggtgacgaaagtggaccagctacactcattatatgtgagtgctacacaagaggagtgatacgagcatccaggggtttcacaagcagggctggcatttgaaggaaggcagaatttcagtgggagctggggaagggagaggctttgtgttatgtgtgggtggatggtgcagacagagatttttcttggttttaccatgtcatttggacaatctgaccttgcatttcaccttttgcattctaggaaaagtattatcacaaaattgaattactactttaatataaacaagatagattttgcttatacataaccggtgttgagttgaagattttatcctccatttttaagaactctgctttatcatacatatgttatgaaacctgagggtttagtactgagaaataagttttagccatggctcagcaaatgtaaagattggatgtgacactcttaatatggtgtaggaaactctcaattagattgatgatcataataattttagcactttatacttttttttacatatatgatacaatttgattcttataacaattctctgagatgggtaacataagtgccagtgcccttattttataggcaaggaaatcaggcttccatgattgcattgactaggtggtggactggggctagaattctggtcttctgatagccagtctagagaacaccatactgtaggtaattgtggctcatccttatatgcagtcaaagttatcattaataatgtggactataggtaatatatgtggtgagaagtaatagtctctgtttaagtaaacagcagttgaatattgctgttgttctggaattacagtccatagttaggaagaagtatggcttaccttttgtttaatgtggttttgggctaccacgtccataaactttggtgaaaagttctgttgctgactgtagaggatttagttacttgagggaaaaactccattattatctcttgctttcgttgttaattgaagtggctcttaaaattagagggttgtacatttagacagaaaaactatcctgttgactaaagatgtaatttctgtagtactcagtgacaaaggaggaaccatgtaagtacttggggaaaatatggaaagaaaacttatgacatatacttggtaacatttttggaaaataaagaagtggacaaaagtagacaaaatgagtaaaaatctgtaattcaattacctatatacgttaattttatgacatatgtccttttccatttcttttttctccataatatataacatttaaaaattgggactactgcgtgtacagttccatatcctgcagatgcacttaatatatcacagcattttttaatgccatgaaatatcatttcaaaccattttcatgacaatgcacaatgtgtggtaaacagtctgatgaaacatttaagcagttttgtatcctgacagtttttggttaatattattacattggtatttttccatgtaattacaagcttcagaaacacagtttttcaagataagaaagaagtcatatgggtgacataaaccaattagcaattaaatatttataagatagtgcctagttcatgattaagtagattcttgagttatatatccaattaagaaattctaatcactatgaattttagaaattcaacaataaaggaagcaactactagtactgaggagacctgattttcattcctaactcatgctaagtagctagttttggatggcttatacatgaaaatgaatgattgccaaggttctttatcatcctgttatacctgccttaattaattacttcattatttatttatttcttgagtgtttcttgtgtgccagcaactattttagattcttggggtgctagacataaaaaaattaatggtcttttatatttttaaaaagagttttgaatgtatcacttcatactgatatgatctggttacttttgacatcattttctgacatactttccattgtttatggcatacatctcatttattattttggaaatgatcaccacattcatggttttaattttttgtagaaactactattgattccatttgaaaacccttttaaaatgccttccagccttttgatatagtttgcaatcatttattgcatttgtatttcattacttgtgctaggcttcaagactgtattatttattaatggtattcaatcaaggagtactttggggcattagatttatctgtaacattgccaagtcaaactttggaagaaactcacacttttaaaagtgtttttactctcattacatgtattaatgatatgtaaactttaagtgtgtgcaaatggcctcttttgagaagttttaaagttacctattttgtcactatgtgttgttcttgcatgtctaggtcagtatttcttttgtgtttggctaagtgatcaccatatacatgcagttttcaggaaaggcctaaatgttgtcccctccaaggctcctttttccatttccagttaatggaagatttttttcatagtacttttaattccactttagcagtgaacttgaacaagctatttctggttggccatttctttctccaagatttttaaaccagtgttctgagtcttgggggaactacagcttcaagactagggactgtggtcttcagctttgaagtggcttcattctgggggattagtgaagctttctagatttgtttttcccttctcttattctacccttcccctcctccccattaacagaactataggataatatagggtacagaactatagaactactcttgggtagttctgtttgtaaccctgattctgctctcccacctgcccagcctttgagaattaccattgcctgtagggaaaagatgtaaacattgagtatgctgattttcacttatttcattttatcctcaagaaaactaaagtccagaaaaggagggtcagtaaaggaaaaagcaagctctaaactaaggtctcctgattattagttcttcacattgctcagtctcctttgtttcttactggtgtatagaagctgctttcactggctatatccaagttaatgaaaagtaagggcaagaatctagaagaaatgagtggaaaaagtgaagcaatagcaaagacagaagtagtgatatcagtgttattctttacatgcaataagaggaatgctgaggtttcagtgttaccattgatgtttctgtattttagggccttgcattatgttggtgatagtacattgcatgcagcaggctatcagtgttctggggctttaagaaatatattcagactaatataaatcggcattataacatggaactaaaatatttcccaccttgaagagttggatgaaaatttggctgctgctcttggattagtgtgttgctctctggctgtttcctagttaactataagatccaggctccggggaggcagatctaggccactgaccacctcagccatcacccctccccatggcctgcattttgagagtatgctggatctggatccttcccatgtgctctggatcaggagtgaataaaggagaatgtgatgctacatgcatcagttctaacacagctagagagtaggagcatcagtggaaggcatgaaaggtttgatttgatctcacctcaaatgggcatatggtgggtctctgtgtatgtgtgtgggggtggggtacaaagaaggaaaagtacagtgaaaaagggaaagggaatgtatctcctgctgtttctgagagtttgggagacagaagcttttagatgaatggtagcccaactccgtttcttatcatttgggtctccacacatatattttacattccccccaactcttccgcccctgcttagttctatttcttctggctgtcctggtgtcctcagttccctctatgctaacagcaggtaaatgcatggttgggaaggatgtgatttggaaagtgtgattctaatataaacatgcctacagtttattaaatatactttttatagctccaccgttctatattcaatttttattctagattgactacaaaatgtcaatatatgttttacattgataatattgttgctattgttttacctttttttttttttttttttttgagacggagtctcactctgttgcccaggctggagtgcagtggcacgatctcaggtgactgcaacctccgccttctgggttcaagtgattctcagcttcctgagtagctgggattgcaggcacacaccaccacgcctggcttatttttgtatttttagtagagacggggtttcaccatgttggtcaggctggtctcaaactcttgacctggtgatccacccgcctcggcctcccaaagtgctgggattacaggcgagagccaccgcgcccggccctgttttaccattttttaaattaaaaatgtagttgtacattagcctggatgacctaacctttacttaaacagcatttttaagagaaaatgtgttataagttggtcgtttggaactgacaagtgaatttctatagcacaggccattagttaatcggagatacatttttgacagtgggcaagcctaagagagatttaaaggattttttaaaaaactaggagtagtttttttaaagttagaaactacttttcttgttacagtcttctaaaagcacttattataacatccagcactggcaagaacatggggaaacagtgctctcgtgcactgcttttgagaatgtgacttgttactgtctttggagaaaggatgctgctgaagacacatctactccttgacccagcagtatttcagaatctttcctgtgggtagaatttaagtgcaaagatatttatcgtgacattgtttgtaatagcagaatactggaaacatcctgaatgaccaggaatagggaatagttgaataaattttgatattcaaatgttaagcaactaataagtaatatgaattaaatctctaaatattgacttctaatatctctgccatgtagtttaaaggaaaattaaaaggcacatgattatgtgtttggctttcttgtaaaaaaagaaaaaaattctatatgcaaacagagagagctatgaaaatagagaaaccaaacttaagagtggttagctctcaagaacaagttttcttttcatctctgaatttgacattttaaaacatatttattacttctataataaatataaataccaccacaaataaagtagaaagtttaaaataataaaattattaaatattttcatgcatataaaatattgccagtttttgagaaaagcttcttccatgtgattctgacaggtataatttataagcaacattgtgggtattaagtgacattgacttaatagaccatctggtactttcataaacaatttatagacttattgtttgtgtggtcatttatggctgaggtgggccattatggccctagctattattttcagtgtctgatttgatcatacacttgcaggctgtctttctaggcaaagtacagtgggatgagaagacactgccttgcataattcagacatgtgtaatattggtccctaagaagggccatcctaagccaaaggatccgtttgttttgtttcttatctaactttacttttttcattcatttatttaataaattatatatagtgttattgagtgccatgacatatacaaagatgaaaaaagatgatgttgctttcctttaggagatctcagtctgttggggaaaaccagcatggtttgtcacaggacaattaaggtgctgtatatgcagtacaaatgaagtactctaagagccactttcttaaaccctttacctggtgagcccagtgtgttctgtacccattatcttgtttcacagttttaattatctgacagtagggatcaagaagttttagtcctatatagtacaacttctttttctgcgaattgtaatagaaattaaccccacagttgtcaggaaatacctgatactaagagatgatatggaaatagtagggagattagagaaaagcaagttgcatatttgtttataaaaacagaagatagaatacttttgatatttgcaaaagcaagttagaaaactacagaaattttttttttttttttttttttttagtatttattgatcattcttgggtgtttcccagagagggggatttggcagggtcataggacaatagtggagggaaggtcagcagataaacaagtgaacaaaggtctctggttttcctaggcagaggaccctgcggccttctgcagtgtttgtgtccctgggtacttgagattagggagtggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaagaatttttcttagtacagaacaaaatgaaaagtctcccatgtctacttctttctacacagacacggcaaccatccgatttctcaatcttttccccacctttccgccctttctattccacaaaaccgccattgtcatcatggcccgttctcaatgagctgttgggtacacctcccagaccaggtggtggccgggcagaggggctcctcacttcccagtaggggcggccgggcagaggcacccctcacctcccggacggggcggctggccgggcggggggctgacccccccacctccctcccggacggggtggctgcggggcggagacgctcctcacttctcagacggggcggctgccggacggaggggctcctcacttctcagacggggcagctgccgggcggagggactcctcacttctcagacggggtggttgccaggcagagggtctcctcacttctcagatggggcggctgggcacagacgctcctcacctcccagacggggtcgcggccggtcagaggcgctcctcacatcccagacggggcagcggggcagaggcgcttcccacatctcagacgatgggcggccgggcagagacgctcctcatttcctagatgggatggtggccgggcagagacgctcctcactttccagactgggcagccagggagagggtctcctcacatcccagacgatgggcagccaggcagagacgctcctcacttcccagacggggtggcagccgggcagaggctgcaatctcggctctttgggaggccaaggcaggcggctgggaggtggttgtagcgagccgagatcacgccactgcattccagcctgggtaccattgagcactgagtgaacgagactccgtctgcaatcccggcacctcgagaggccgaggctggcggatcactcgcggttaggagctggagaccagcccggccaacaaagcgaaaccctgtctccaccaaaaaaatacgaaaaccagtcaggcgtggcggcgcgcgcctgcaatcgcaggcactcggcaggctgaggcaggagaatcaggcagggaggttgcagtgagccgagatggcagcagtacagtccagcttcgactcggcatcagagggagaccgtggaaagagagggagagggagaccgtggggagaggcagaggcagaggcagaggatattttttatgtaagtctttttaatacttctgctgcttatcatggtgcttggcatattgtaaatactcaataattattttttctaaaaaggttgaatgaatttctactgcaggttttgggcttttaagattttctgaattcagtttcttaaccaagctaactctagataatagttccagtcaagtacactaccttcactaattttctcccagcaatttaaaaactgccaagcagatgaagtttgaagtaagttttgtaattttcaagaattatacaggccaggtgtggtggctcacccctgtaatcccagcactttggaaggccgaggtgggcggatcacaaggtcaagagatcgagaccatcctggccaacatgttgaaaccccgtctctaataaaaatacaaaaatgagctgggtgtggtggcgtgcacctgtagtcccagctactagggaggctgaggcaggagaattgcttgaatccgggaggcggagattgcagtgagctgagattgcggcactgcactccagcctgccaatagagcgagactctgtctcaaaaaaaacaaaaaaaaattatacacatttccttatttcatgctacataatttctttacgtggaagataggcaaaatgaactgttgccatagtgaaggacaaaattctagagagaaaagatgcaatttagataaaagtaacatagtgctggaacatgtggaacaaaaatactgaggggaggctcagaataggagtgtgcctttagacaacaatggcaaaattcacggacagacttacttagaaatttgttgggaactcagagaatagtgttgtcccagggtgttctttgtttactttagagatagtgtaggctcaccacctgtaatcccagcactttgggaggtcgaggcaggtggatcacttgaggccaggagttggacaccagcctggccaacgtggtgaaatcatgtctctactaaaaatacaaaaaaaattagccaggcttggtagcgggcacctgtagtcccagctactcgggaggctgaggcaggaggattctccttgaacacgggattcggaggttgcagtgagccaagattgcgccactgcactccagcctgggtgacagaacgagactccttctcaaaaaaaaaataaataaataaaataaaataaaaataaataaataatagtgtagctttttttttaaagtggctgtatatagttctagaacctctaaatataaaaggtctagaggtatactgctagggtcagcacatatatagcaacttcaggtaacaggaaatttaatgttacctattctatcattttaatgatttatttgaggatctgggaaatttttgttgctgtgaacttttactttttacttcagaggcaatactcttgattctgcctactcctttctgatggttcttcacctggcttcatacagtttctttacacacatatacatggtactcaggtaagaatgcaaccccttgcagatctctgggatttgcttttgtgcagtctcttttggttctctgctctgcaaattctagttgtcttgacctcctcagatgaactgtctcttcacctgagggagaactgctgcctccccctgcgtcccatcccctccctggtttcttcttcctgtaccatatcctggaaactctccaggcagtaagctgagggtaatagtaggactcaccttgtctatttctcttttctcagagatgacactcccctgtgctgcgtgttgtttattgccccaaaactgtgatttcataaatttgtgtctgtatatttagttatttacagtggagaataaatcccgtctctgtcagtatcatgctcagaggtagaatgtcctccttttctctttaaataaaattcacatgtacataaaatttgcatgaattttctttagaattagatagactatagaaatgttgtgggcttataatccgcaaagtctttaatatactctctatccacatctctcttaataaacgtggataaagtgcatattaaagactttgatgaaagtctttgatggaagacttggatggaagctctggactgagcttggtgatggtatagcagggaaaaaagtctagtctgagttcatgtatttgcctttgtgttaagctaaccctaaaaatattaaagttgggtcatagctggataattaagacatgataggtcagatttctatattttcctactaatgtgaatgttcctatgtgatatttaaatttggatcagtttagtaaaactgttttcatagggcagtcagagaggaaagattctttttgtagtgacagtacatttattctgaatgataatagggcagaatcataatgccaagattgtataatttagctcctgcattttatttctgagaagaattaggttcagagatattcagctcatagaactagttagtactagagttggagctggagcccagttattctcatttctggtttaatgctttttccacttaatcatgctgcccagagaaagtccttgtactctttaagcccccagacatatgcagtatacttctacctcctggtcctgaacacatagggtgagtcttgagggcccagccagcttgcttccttgcaagcttcattctgtgctgtgtaaacattgccacgaatttgacatgaatcgaagtacttagctgatccctttgaacacattatttatgccatgtattgcactagatcccaacagaagacatgcagtgagtaattggagtacctgaccattattttgaaagttaatatttgtgtttcagctagagtgactgtgggcctgtttgatattgacttgagttgctaagtaatgtcagaaggtcaaaacaattttaagagatgtgtggactgtatctgatgacagtttggcacttagcttttatctccttaaggtggcctccatattgaagcatggcagattagccgtgttattttaaaagaatactgaatctgttgggccttggcagtttggaaaggcaaggcctctgtctggtgtaattgtaggcaaaggtatgtggtcctttagggacacatttttgaaagggaacctcagcttggcagtcaagtttgtatacacagcaacgtatagggagaagaagtaaagataactaacatttagatttgtcatccttttttttttctgtgaaaaagaaactaaaagtaaaagaaattagagataacttgtaataatcactataataataggcagtaatgtactggtaagtatttggcaaccagctatttggggaaaaactcttgattttatagcagtttttcattttctggtgtgaatacttttactatggctgatttcgggtgaccaagttgatgtcactgcgtgcagagttgggaagagatatgcagtagcatatctatatcatacaatatttccactatacagatggactagatgtaaacaaactcgtgtaaagataatagcaaatgtaaagaaattagttaagtgatgagttttgaatatttattatctttgttgttggtgtaatttatttaattgaaggctgatgtaatttaatttttaatgaaggctttgcttaacaattggctaacacaattgtgaaaattcaacagtccactctcaagttgttatgagttggctctagcatactactgaaaacaggtaacacttacagaacatgtacactgccttccaagcatagtataagtgttttctgtgaattatgtcatcctcaaagcaatgacttgaactaggtacttaaagtatccttattttgcagttgctatagttgaatcacatagtggttaaataacttacctgaagttacggtttgaaaacggcagagctgggattctaaaccaggccatctgtttctagagcctatgctcttaaccagcttgccatactgcctgttgaggttacagatattcttgaatgtgaggcagtagtagctatgataaattttaagtaaattactcatggttcagaattattttatgacttgtttcaataattgtttggattttatttgagttttatttatgacgaaatgttactatccttaatatatgaatgcttatataaatcaacaagaaaagctattctctcttcagtaggaaaacagaccacagacttcaataggcagttcataagaaaagaactaacaatggccagtaaacattgaaggcaaggacagtgtccattttgttcattgcaacattaacccaacccttgcagagtgcctctataaatgttattgtagtacctgttaattttttatacattttaataaagtacataaatatttcctgtccttttgcttatactaagctattttctaatgttgcctttaaataattgaatttttaaagaaagtgtttctgattatatagttagagacattttgttattaaaactccctaagttcaaacaaggatgaagaggcctaataaattacttttttcctaattataactaatcaatgtatgccgttgtatataatttcactaagtaaaatggaggttcttaaacttaagagacctactgaaattatgagaaatctctgtgtaatttctagaagctttaagttacaagtagtgatattttaatgcattgagctattttatctacaaaccttgttgaggaacagtgtaccctggaagttcagagactgatgtttttcctttgcggcttttcccagtttgccatctctttctcctctctggtagatgttttagccgtgtcagagctcaaatatacttctgatggatgttgtgaattattttgagaaataataaaatgtatcagaacaatatttctggtgctgacagctcctttttggagtttaggaatttgaaatttctgaaatggcttaaaggaagtgttttagttgcattactagacttgtcatccttggtatagataagcccttgctgtagtattttttttctgaagatggaaaagtcagtaagggtaaaggtgggaaaaatggacaaacattgattgaatgatgatccagggtcagacccagtgctaagtgtatacatgcgttattcatcaaagtaaaagctttcttattcagcaattcggaaaaagcagttggcgggggtggtaggaaaccagttcctatggaaagtatgcagttcactaaaaggtaatagtattgctctgtgacattgtttacatatcagagtactttgaaacctttgggatcagaacccttttctgtgttccagaaacatcccaaataaagttggccagaatattaagtttttggctgaagttatattactctgaattttatgttgatcagcatatatctgactgacaatgcagtgtgtcttatacttactaaaaaggaaaatcaattattatttattatgtttagttcatttgggagatgacacactcttcaaatcattggagctatgaaggatggagcatgaggtggagtaaaaggggtgtttactatggaaaaggttaatgattgttgctccatttggtctgtcatatgacttctcatgccatcacagatcaatgtattataataaaagatacaaacagtatgcattacccatgttatatatacacccatgtttcctttgctgagcctccaggaggcagaaacctttccttctgaaccttagttccccccctgctttccctccttcccttcatgataacagtggtccttgtttttttaaaaaaattggcatttttccctagaaggaaattgtattagtttcctattgttgctataacaaataatcacaaacttagtagctgaaacaacacaaatttattaccttacacttctggaggtcattagttcaaaatggaccttacaggtatcagcaaaattgtgttccttctggacattgttggggaacattcatttccttgcattttcaggtttctagagacgggcttcattccttggctcatggctatgtcacttccaccactgcttcatcttcccatcttctgtcactctgattccccacctccctcttttgataacccttttgattacattgagtccacctggataatccaggctagtctccccatcacaagatccttaacttaatcgtatttgcaaagtcccatttgccacttagggtaacatattcatgggttctgagattaggatgtgcacatctttggggaactattattctgcttgccacagaaatttttagaactttaaggtaaaataccaggtagcacaaccattcctgtattggtttatcataatggagaccagggatggtgtctgcaacctttagagaaatcatcatgatttcctttaacacataaaaatatgatttcataaaaaatgaagtatgacaaacttggctaattatgtactgttttgaatacaaaggggagaaatactcaaaggaaatatgacttgatattttgccatagagttttgtaataaaatgctaaggctattgaaacaaaacaaacaaaagaaaactttttttccccacagtatcccatcaaaagttttattttcataaattgctttccaaacatccaacctgcatatctaatgaccatcttttgtcttcttcatctgaaaagtaagataaagtcatatggcccttagattcttttagaaagcctatgttattttcttagttgatttaagtcgtgaagttgcttttattaatagaactatttctattcttgttcatttaagaaaattataatattagatcagtaaggttacctgaagagacactagaaagggagatgccagagtgaaaagtagtagtccttgttagtttttttataagtatttttagtcctctctttttccctcctcattaaaaaaaaaatttaatttactttgtgtgtgtgtgtgtgtgtgtttaagtggcttaaagctacacccatttatctcactatttccatgggtcaagagtctgggcattccttggtaggtgagttctttgaccagggtttcacagaggctgcatttgtagttggtttttggaacattgtgaaattataatctagcagagactataaagatcttcaggagagaattttaaacataaatatgaacattattgctaacaagctgtactttatatatggtaggaatattctgaagagcatagaaaaagcaaaaaaaaaaaaatcagcctatttaaaatagctttctccttctacttagaatatatttacgaacataggaaatttgaaattaagggaaacatagaccaacccgactgcgaactttgaggcttgttgagtgtctcctgctaactactgccacctcagtcctgcacgcgataggggattcctatggtattgtttatttcatagataaggcttgttaataaactgccaggatgcttataatgagcaacgagaacaatcacaaaagagtgctgttgctatgcagttgaaccataggcctataataatacattagggacaaagataagtgtgcttacacatgccacagcttttgggtgctcttctaaatctctttattggctgaatctgcatgaagtggatgaagcctcttctgtgtgcagaagagggcatattaaaggggctgtagaaacaggtctcactattctcctcagagtatcgaagtactttttgcattagtttggcgctacaggaagcgaaaaaaatatcaggtaagcagtttgtcaaggttcttaaattttcatcagctgattaaaccctgtgactttgggtttacctcatgttattgaaccgacttcagtaaagggggatataaaattggaattaagtcagcaggaagttttaggggagagattgtgatattaatgagattgagggagtactcctttcagggtgtttatttttctaccctaaagttgcccctttgatcagagatgctttgtacggacatttatggctagaaccctaaaatctcacggagagtggaggaagaaagaaaagtagataaattactcaatcttactttttttcagagtcagggaatgagaccatgatctttcatcattttgttatcagatacccaaattgtatgaaatcatctttgtgtcctgaatgccttatgtctatttagatgctagcaaatatttgctaatagtagattaaaacacattttatttaatagtcttgcagtgttttttttcatttaatataattgatattgtttgggtaattattggctaaaatatttaaattagagtgggaaaccagatgtttacaatattttataatctactttcagggtcagctgtgcttgtttaactttagttgcactcctggtgtcctctgaaatggctcaagctctgaacttaggggaggcagaggtgctgggacttgggcttcagaggcatcttccatatctctttgtgaggatcatctttaaagggcatgtgcacagacctttcacccagttctaaaagcagagtatttctgtgatttaaaaattgcttgaattggtcataatcctttttggaaaaagatgacaaactcaagctagataaatacagtgcttaattaatttgctcagtgtagatatgatatactaaagctgtcctgccctataaaaataaagtggttataaatgcctcaaatttaaaatttgtgtttatacgtataccttggtgtgacaggcaactatgaataaaagaaaaacaagtcttatatatactgcacattataggaagctgtgtgcattggccttatttatagctccattttctattcataccctattctcctccctacttttccctttcaggctaatgtttctgtaaaactttctgcttgccagatactgttctaaatgctttatatatgttaaattaatctgcatagtgcagtaaacattataatttttattttatggatgaggaaatgggtgcacagagaggataagcgacttgcccacggccacaccgggattatagcgagtggcagagcggtgattctaacctcggctgtgtggctctgcagcctttgccccctcatgtctcacctacactgtgctgtctctgccaccgtcctgcctctcatttatcttgctgtaattttgtaagtgacttcaaatcatttttggaacatggtgggagtaccactgaacaaacagataaaagctttcagtgtatattttgcctctctttttgttcaataatattttgattcagcaattaaactttaaatatatcattagttatttttgacgaagtatacctctagagttacctttggagtcttctgccaaacatcttaagagtagagagttcattttcatttttcagggtttgcttttaatagttctgtggcgtggtgcaattaggcttttcttttctgaaagcacagctgtaacttgctgtgacaaatgctgttgaaggaaactgctgcattgtgaacagagtggaaaaagagatgcctcaaattaagtgttttctttggtctgtcatagacttattaggaggttaaatcctgctctgcaggactgttagtggcaggtgctatttctgtcaccaggacggtctctgctaatttttaatgcagcgacatccccaaatagaagcattctgtcattctctcagtccttccatttgtggaaggattttgatcaaagagtgtttttgctttttatttatttagtgagcaatagcatcatatttcatacaaaaataccttgtgtaatggtaaaagtaaaacttaacaaagtgaaatagtttgttttctttgctcattttccacatacatgaattttgtattttaaaaatgaagtaatttagaaatatgccttcattatgcgaacctatatttgtttatataataaataataatgtgtagttttgtctatatattgagaccatcacaattactgctttcttgtttttattttctctttgagaatcaatgtatttttgagttagtaatacaaaaagcatgtatagacttagtaatttctttacatgagtaatgaaagatacagatttttattttatttgactacatggtaacttttttttcctcatgcttaaaataagatagatctgttttaatacctacaaggttcttaatgattaaagttttaatctcttggggcatgtaatcttggattccaaagaacagcatcataatgaaactctagtataatggattagaaaaatttccacagaaggaatagacctgtaaaaacaaatagcaaaatattaaggagcaaccacaaaaacaccatctcatttttgaattttcatttcccctcctttgctatagcaattatccattaagaactgtttttctgaaattcggctggcttaaaagaatgtttttctgaaaagcgtatctcaaatttatatttcaattgcttgttaaatagtaggaaactagttttattatttatacgtgttttatttgtattgtaaaggaataactgttggtaggtaaaagaactggaatattttaaatatttctttgtagtttctttaggcaaatttgtatttcttaagaaatagcataagaattaagtatattaacatcgaattttaaaaagtatttgcttcgtaagtggacattttattttatttttttttttattattattatactttaagttttagggtacatgtgcacaatgtgcaggttagttacatatgtgtacatgtgccatgctggtgtgctgcacccattaactcgtcatttagcattaggtatatctcctaatgctatccctcccccctccccccaccccacaacagtccccagagtgtgatgttccccttcctgtgtccatgtgttctcattgttcaattcccacctatgagtgagaacatgtggtgtttggttttttgttcttgagatagtttactgagaatgatgatttccaatttcatccacgtccctacaaaggacatgaactcatccttttttatggctgcatagtattccatggtgtatgtgtgccacattttcttaatccagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgcggaatcaccacactgacttccacaatggttgaacaagtttacagtcccactaacagtgtaaaagtgttcctatttctcgttaagtggacattttaaattaaatgagaatatttgcatctagggttgtaatatggtagtatattgtgaggtttgatattcaagactgttttattccagtgttttatggcagaatttgagattttcaataatgtcccacatttaagacatttgtctactttatttagcacacatgtttcagaatattaaaagctgttttattggcaagtaaatcttagtttagatctctcatttgaaatatttcatcccttataagatttacctcagaatgttttctcctcctatagaatacagtttatgtttcaggtttactctttttagatgtttttctgaaaaattttattttagatttattagtaaattttcatcttaattagaatgagttatgacctgattaagacatttctttcacttctgtctttttttagccagtagaaaaacatttgagtttatttttaagggagtgatttcagtttcaaacaaacaacaagaaaagcctgatataaaattaagtaagctgtttaaaaaacatgctatccatgttacagaactgtgaagaatttttgtcagatttatatcagttgccatagaatattttcttttttcttttcttttcttttcttttcttttcttttcttttcttttttttttttgagtcagagtctctttctgttgcccaggctggagtgcagtggtgtgatctcagttcactgcaatctccaccttctgggttcaagcagttctcatgcctcagcctcctgagtagctgggactacaggtgtgctccactacgcctggctaatttttttttttcgtatttttagtagagatggggtttcaccatattggccaggctggtctcaaactcctggcctcaagtgatctacctgccttggcctcccaaagtgctgggattacaggtgtgaaccactgtgcctggcctgcttttgtcttatcaaggaacttatatttctaatcactttatctattaataaagaagtgagtgctttctcttgttttcaaagtggtcttgacattgatatatcagattgtggttggtgaaaatgagaaagacctttggcaggtcaccttgtgtttaccaggcaaatgggaaaataaggctgacacagtttcatcatcagctggtagttaactttaagctttgtttttttcttctccattttaaatgaaagatagtatccaatttacaaatggatttgcttcacagtttctttttaaatgggcttaaatggatctcataatagcacatttccttaacatgttctgttaggaaaccaaggcataatattgatgatgctatagcatcctgacgttttacttcattccattcagaaaatccagagctgggtccatggcccatttccttctggtagcagggggagaggacctggcttttctctggatccctccctggtgtcagctgagagactttcctggcttactcctttctctactgtcagggacccagtacttcctgcttcgtctctcaggttggggctgggaacatgctccccatcctaccttttttttttttttttttttttttttttgagacagggtcttgctctgtcgcctaggctggagtgcagtggcacaatcacaggtcactgcagcctctaccttccaggctcaagtgatcctcccacctcagcctcccaagtagctgggactacaggtgcatgccaccatgcctggctaaattttgtagtttttgtagagatggggggtctcactatgttgcccaggctggtcttgaactcctgggctcaaacgatcctcctgcctctgcctcccaaagtgctgggatttcaagcaagagtcaccatacccagcttcccattctacttttttctcccaggttttttgctggtcagaactccttgaaaacctgaggtgttccagcctgaaaggaggctgtatcttgttcttcttaatgaagatgacatgatgtagcaggaggaataaaacacatttggagtcaggatacctggagttaccctgatactgccttttttttttttccctgtgagaccctgagcaaatcatttgccttttaattttggtaggggtggtgggtgtttagtgtatgtggtgtgtagtttgcattatgttacatctgatgtccctcactgctttaacattacataccacatatttcagaagaggatttgcaaatatgatcacatatttcagaaggggatttgcaaattattaggttcttaaaaggtaggaacataagatttttaacatagaatttatgaacttttacacatggttgaacaagaaactccttagaattcagatgtttatacttgggtatgttatgaataactgacatagtctcagtgtattactataaaatgctgccatttctggaaggggtggtatcatgttgtgtgtagatataatacatatatttttaagagatgggagtcttgctctatcacccaagctggaatgcagtggcacagtcatagctcactgcagctttgaactcctgggctcaagcgatcttttcatctcagccttccaagtagctggaacgtgccaccatgcctggctaattttttatagaggtggggtcttgctatgttgtccaagctggtctcgaacttctggcttcaagcagtccttctgccttggcctcccaaagtgctgggattacaggtgtgagccactttacctggcccataaatatattataactaaaatttgctctttaactgtttactgaaagtacgggttgtcatccttttattttctataggccaacacgtttagtgctactaggagacaaaaataataaagtaatactgataggtaaaaatgctatatttaaaattcctaaaaatttgcatatcaaaatttaagttgttcatataatttcttaggggaaaatgaagcagaaagaagtttatttaaaagttatacccttgtgattgaaaatctgtctaaaatatatcagtttcttttcttgttctagttcaaggtggtaaacataattaagctttattgagtatcttgccacagaatgaatcatgaatggttacgtttactatgattttatcaatgatctatgtggaaggtgggagattaaattaaatgtgtgcaggcatcagccaaaaatttattaaatattttaatgctttacattttttctttcaggtagaactatgagagatagtatattgcaggctctaatttctttggtttctaatgtttgactatataagaatataatcatcataagatggcaatattcattattaaatttaatttatgctaccactcaaatggttaggttgtgaaataagattgtttaatagtgtttgaaagatttgtatacccctgagactctagctagcaccctgactgatgccctgacagaaaaagatgattggagcattcagaagttatgcctcactcggggaggggcagttgagatttgttccctgataccagacccattccttgaatactttgtgactgatgagattgactttggagtgggagacagagaaagaatttggggtgcggtagtatcttggaggcttaagggagagcaccaagaagcagatcacagggcagaagagggatgagtgcctttcaagagaaggtggggaggtttgagaggagtgagtcaatagtgtagagtcctcacacaatcctgcctcccagctgttccctttgccatcagatgctgagtgatttgacattacagatgaccatggagggcagtgtgggtgatgaggaaggctgcaccgcactgtgggattcacattaggcagtccaatataaaccagacttacaccagactcatgcaacaaatttgcccactagccattattcacaaattactgaagttatcactgactgataaacacagaataccagcaggtgggaggaaatgttgtctagtttctattattagcttgtgctccatctgctgattataaaagtttcactggttcatttattttaacctctcaattgaatcttactgcaggaaaacaaattgtagaatacatcttactagttgtgggaaatcaaatttaatttgaatagcaaaaagtaaatagaatgatattttatgctgaatctaagtagccacatccgtagtcttctttattaaaggaatgttgggttagctcaattgtggataattttattattttcatttaggaaacaattacaacatattagataaatggtaaatcattttttaccctttcttctccatgatttaaaaaataagaatggaaaacatgaattttacatttttttcccactgcattaagttttattattactgtggtttgtttttatttcaaacttttcatgtttcatgtctctcaacgctttttgtcctcaaactttattgctggagtatttaatagcaaatataaacgattcctatagacttttgtatttttgagaaaaaagtagcagcacggacaatctcagttggttttttttttttaaacaaagtactgtttttcaaaagaaactataacaaacagttgtggactttgttagggcttgggtaggtgggccagaagtcatggggtgttacttggatgacgtcatagctcagggtctggttcttagcccagggagactcaccctttctaggtaaacaaactccaaggtgcctgatgtttaaaccagaacttgtttattaacgtatagtgaaaagaattcaacagccaagtggtttggacattcatgttggatagaagactagtacatttttttctatcagaaaatctgtatgagaagccatagtatgcctggaattggaagtaataggaattatgttttgaccagcaaaaaatttttattgggatgaagtccagcctaccaatttttttcttttgtggttcatgcttttgatgacatgtctaagaagttgttgcctaactcaagattataaagatatgcagctacatttttttctagaagttttatagttttgtcccttacatttaggactgtggtctgttttgaattaacttttgtgtatgatgctaggtaatatgctagttacgtatgaatgtctagtttttccagcactatttgttgaaaaaactgtcctttcttccgttgaattaacttggcacctctgggaagaatctgttgaccctatattgctaggtctgtctggaccctgttcagttccattgacccgtgtgtttaattttatgccattaccacaccatcttgatgatgatagctttaaatgttgcaatcaggtaatgtgagtcccagtttgtccttttacgtaattgttttggctagtctgttcctttatatttccatgtaaatttttaaatcagtttatcagtttctataaaaatgtttgccatgattttgattgtaattgtgttgagtctaaagatcagttgggaggctggatgcagtggctcacacctgtaatcacaacactttgggaagccaaggtgggtggatcgcttgagcccaggagttcaagaccaatctggacaacatggcaaaaccctgtctctacaaaaaacacacacctctagtccaggctacttgggaggctgacatggggggactgcttgagcctgggaagcggaggttgcagtgagctgagattgtgccactgcactccagcctgggggacagagcgagaccctgtctcaaaaaaaaggtcagtggggagaaattcacaagtatcaatattgagtcatttgatctatgaacgtagtatatatttagatctcctttaatttctctcagccatctttataggtatatagagctataggtatattatatagactcatatctgggttcaaatcatggctctgtcacttatggagtgaccttggtcaagtttcttagcttctgtgagcgtcatcttccttgtctataaaatagggataatatgtcattggttttgtctaagggttaagtgaattgatgtatgttaaaggcctaatgttatgcctggcaaaaagtttactgcacaatacaagttgttgtcattattatcatcattgtcatctttaccatcaagtaatgatggcctgttggatccacctctgccaaatagttattcttgcccagcaaccagatggttagtagcagctgctcagggctccctttatggtcagcatggctgatgaacactgccacacgcttgcttttagggcctctcttttctctactccacactaccattcattctccagctgtagctgtttacacattcttcctttggattatgttaataccattgattaggccacagctttccttgcatttagtccagtcttcctttgattttccaatattgctttctgcttttgcttggaagattttgctctttttgtatgtcactgtcttaatctctcctactatgtgtttatgggtttaattttcagagtttggggctagctcactatcaccccattttccactggagtattttgtagattgggcaataacttaactagaataacatactttaagtgtttgcacagaatatatatttttaaattttgcctcatttatgggaaagtgggggagaaaatgatattttttatttaaaactttttagaagatgagatgtgaaaataatttgatagtgactaaatcaactggttgttacactgttattctcagtcttatgaattcagaaagtccactgttttgaaatcagaaccttgtcacttacccccatcctaatgaggtttgcatgtcagcactgtcagggtccttcagggaaatgcaaagcaatttcttacggggagatttgggatatctgtgtctatgtgatgtctacatttttgtacagtcatgatttaacttcagaaagagtctgtatttgggactaaatattctattcctttctgaatcatcaaataatcattacattgtattcagtattggttttagaacaaaatatgccacttcccaactgtttaaatctgggcaaagtgtgtatcccatctgtgtatcagtttccttttctctgaaatgggaatgatactagtacctgcctgttttgaggattaatttaagttacactcttagaatggtgccagtaggcacatggtagataataaatgttagcagcttattgtagttctttgaaaagtgacatcccatgcttgtcttattcaataaaaatcatttaaccaaattgatagtttaaccagttgttttgctctttaatcattctgcttaactaggaaatactgaaggtgtttttttttgtttgtttttaatgtgaatctgttcgtttttacttaagagctggtataactactgtagtagttcagggatagtattttgactccatggtgatattaacttcaaatttcagttaatagtaagttcagttttattttttaagataacatggaaattttgtcttccaatagtgaatgtgattttccaaagaccttgtattttaccttgtttctatataaactaactcagtcataaggaaggtatttgatttgctgacacccacataggaaatcaaaactcttggctgcctcgtttgtttccccagtcccagatgattcagtttctttagaaactgcatgatgcacatgatttatgaattatttatcaacttagcttgagaactctgtcagttgtttagaccttgttttacagacaaaagtaatctgagtaattttaatgaataaatgatgatttgtagaatatatatttatttaaatgtttaaaattaaatataaaattaaaaatatggaaatgatctttatataatcagaacactcacaattttgtaccctaaatgaaatttaatgaaaaatttagaattaaaagggatataatttttacatcttgtaaagtgagttcaaaattagttaagcaacctcagcttgaaatgacagcttgaaatgacactatagtagcaaaacttgctgattctactttttatgaatcagtaatgggcgagaagtgttcttgtatgtaagggattactgataattattatcaacagaataaaggcttactctaacaagatctggggaggattatagtttggcttaatacagttatgttcatttcctctgtgcatatgtatttaatggaacttctttagcgtggtcgttagagcattgtctcttctatgatgtggccttaaaaaatgtactattgcagtggaattttaggtaaacctgtattgagcctcagcagattttaattgtcaaaagaggctaagatatattaagatttctttggagcaagcaatataatatttcttgttatttctttctctttaaatcagtatatagtatcaatagtaaattttagtaataccaaaacagttatctctgtgaaactagggtcataattaccttaaatttttttttaacatttatttttaatcttacttaacgacagcttttcctagaactgtatttcagaggcattgcaataacctggttttcagaatttggaaattgtgtaaatccttctcattgcagagtcacagatgatctctctgattaccatgcattcaatccttacggtaaaaatctaattgtggttggagcccttgggatgttttactacttaattatgcaatatatacaccttagtgtatcctgtgtcttggtagtttgattttgtaaatgaaatctatgatttaaacagtatattcaaatttacgcagtaaagatagccagctaaattgtaacaatttggaagactgaatttggtcatatgtttggtattgaggactttagattcagtgaaatggggtggtgacccttgacctttgttctttgctttcatttatgtgatgggaaagctgccttcatttctaacacaaatcttcccttcacttcaaatctcccatttttggagattgggttacaaagaaattgtatctgtgcttttcagatttttccatgaactacagaaattcctgtggcactgctccctagggagttgttctaagctttaacagaaggcatcttagaataatgtaaaaggtcggggttaccacagtattaaagtatttgaactcttggtctgtcaggatgggagttgactttgttggccagcctggtctgcctgtaagattcatatcaggggttgtacgagttggaaaagcatctcctcatatcttttttattgaaagggagctctgcctctggcagtgcagaaaatgattgcgtgaaaagtttgataattatatcaaaagaaaatggtggtagttaggttaaatggaagatgcttgtactcacatggtcccattaaaggctattctattgttttttttcatattttgcagtctccttaacatttaagaaactgaaggtgtatttaatcaatagtgtcactatgatagatattaagaaagaaaaaaacaacgccgatggaaaactaagcaaagttaccaagtaagattgcagcataaattttaaaagtgatttcccaaggaataggctatatccagacacttggctaatattattgcccttgttctacagttaatggtaggtacgctgtagtattttaggagcacagggttttacagttttggttctgccagttaacctaagattgactttcctcacctgcaaaatatggataacatccacttccctgatttttgtgagaatcaaatgggatgatttatgtaaagcatttagctcaatgcttaacacattaaaaacagcccccaaatggcagctattattgcagattttcatctcagctacagtattttggattatttgtcagtactgtactatcttttaatgtatgatattctttctgtgttctgggccttcttaaagtataatgatttcccttttctcgaattgaatttgaccttttcaaaagtctggaatttactgaagacaaagaattatccagtgctttatgaatggggatgtttatattggtttggctggcttccaggtggcaaacaacattcaaaagcagacataaatttttcccttccaagaggccacatggtgctcctttcctgcatcaggctcccatggatatcaatgggtgtaatgtgtgtaaagcaagggaaaggtcttgctactaaaaagtagggcactgtgctatatcagataaattagtacgttcccatgagctcatgctttgtcctaaaagatgtctttgtcttaatgtcctgttagagtctagctggcagttaggagtcaatatttgatataattctcagtggttgaatcctactaggatgttcatagtttgtgtatatatgtatatatatatacatgtataaaactagtagtattaaagcccaaacaaaaatatttattaaaatcttacatgctacactttgttaaagtgttattggctgagtttcccgttaccaaatttaaaaggttgacttacattttttccctaagagttttaagaaaagtggtacttaaattcatagagctaagaaaattgttgctcattgtccatggatatcagaaaatataattttgattgtttatagaattataaaaattttaatagggtactcatattgttaattccatgtcatcattctgctaataatgctcagattattccttaaatataaaaattaaatagatgaatgaaaaaacaaaaaatagaaatggtagtagatattaaggaattagaaattggctttagtttctctcttaataattattatgtggacggctgggtgtggtggctcacgcctgtaatcccagcactttgggaggctgaggtgggccaatcacctgaggtcaggcattcaagaccagcctggccaacatgtccaaacccctcctgtactaaaaatacaaaaattagccaggtgtggtggcacatgcctgtaatcccagctcctcgggaggctgagtcaggagaatcgcttgaacccgggaggtggaggttgcagtgagctgagatcataccatcgcgctccggcctgggtgacagagcaagactccatctcaaaaaaaaaaaaaaaaaaaattattgtgtgacttgtattagtaagattagaacattaaatacattttatattatcacttctttagacttacattgtgatttttttccttggggcttctcaaacattatatgtaagtcctttatgaacatgtcgagtctttgggttctccatgtagttataaagatgaagttacatatttggcgggttggggtggggaagagaattttaattctctctggacattttataagagaagacattttagatccttgactagcttgtgaataatatgtattaagcaaatatacactcccagtatgaaaacagtttatagggccttttcatattattatcttattagatattctcagatagcggtatttcctcattctacagcaaacagacctgagaatcagagaagttaaatgttttggttaaatttatacaaatgaccgtgcttaaacaagtatctcctgagtgtaagtgaaaaacagcctttgagactggggagatacgacaattaaatgcattgtcgtcctggatgagatcctaaaacaaaaagaggatattaatgaaaaactgatgaaatccatataaaatctggagtttatgttttaaaaaatgtggcaaaggttaaaaattctttggggcaacataatgtaaaaagtttgaagacaaccgaacagattaaaattttgcacatgtgtgagtagataggaggtttttttttttttttttttttctccctgagacaatgttttgttctgttgccccggctggagtgcattggtgtgatcatggcttactgtagccttgagttcctgggctcaggtgatcctcccatttcagcctcctgagtacctggggctacaggtgtgtgccaccatgcctggctaattttttgtattttttggagagatggggtttcaccatgttgcccaggctggtctcgaactcctgggctcaagcagtcctcccacctcagcctcccaaagtgctgggattacaggcgtgagccactatgcccaaccttagataggagtttttattttttttgtttttattttttatcaggttgttgctatatacatggcattgtaactattaacacctctgaaaatgcttctctacaactttttgaaacttgttgagtttcttgaatcttccaccagacaaaacctaattttctgttctagagagaggcagattctttttcgctggggatgttctcatcctaggatatcagaggcaccatggagattggggataggagtttttcattgtgctattgcttttcatagagaaacttcagaaacaaactaaatgcttatcagtattataatggataagttagtgattgtatagttgggcaattattactatgtacagttaagaaaatgaactagaattatatcaatagagttgactctaaagaaattgttagtaaataaagcaggttgccagttaaaaacaaacctttgaataactttcaaaacactatactatatgcacatgattacaaaatcaaacagtacagaaggatttataacgaaaatgaagtgtttcagttccccttcttccctttgtctactcggttcccacagtctatttggaattatgtttaaatgtgtctggtggttacaggcatatcttggagatactgtgggttcagttccaaacctccacgataaagcaggtattgcaataagtcaagtcagagaaatgttttggcttcttggtgcatataaaagttatgcttgtattatattgtagtctattaagtgtgcaatagcattatgtctaaaagaataatgtatacaccttaattaaaaaagattgtattggctggacgtggtggctcatgcctgtaatcccagcatgttgggaggccgaggtggggtggatcacttgaagtcagaagttcgagaccagcttggccaagatggtgaaaccccatctctactaaaaaaatacaaaaattagctgggcatggtggtgcgtgcctgttatccccgctacttggaaggccgaggcaggagaattgcttgagcccaagaggtggaggttgcagtgagctgggattgtgccactacactccagttgggcaacagggcaagactctgtctcaaaaaaaaaacaaaaccaaacaaacaaaaaacacaaaaatgtccttattgctaaaaaaaaaaaatgctgaaggtcatctgagccttcagcgagtcataatctttatgctggtagagggtcttgccttgatgttgatggctgttgactgatcagggtggtggttcctgaagatttgagtagctgtggcaatttcttaaaataaaacaacagtgaagtttgccatatcaattcatttcttttcttgaaagatttagctatagtatgtgatttaaaaaaaaaaaaaagagagatagtttcttgctctgttgcctgggctggagcacagtggcacaatcatagttcactaccacccagaactcctggactcaagcagtccttctgccccagcctcttgagtagctaggattataggtgcaagccactggagccagcctgtgatgctgttagcattttacccacagtagaacttctttcaaaattggagttaatcttctcaagccccgctgctgctttatcaactaagtcctatgtatattctaaatctttgttggcatttcaatagtgttcacagtgtcttcaccaggagtagattctgcctcaagaaaccactttctttgctgatccataagaagcaactcctcattcattcaagtttgctcatgagattgcagcaattgagtcccatcttcaggcttcacttctaattctcttgctatttccaccacatctgcagttacttcctggactgaagtcctcaacccttcaaagtcatccatgagggtttggaatcaccttcttccaaactcctgttaatattgatattttgacctcctcccatgaatcatgaatgttcttaatggtatctagaatggtgaattttttggtgaattttttccagaatattttcaattgaatttacccatatccatcagaggaatcactattgatggtagctgtagccttacaaaatgtatttcttaaataataatacttgaaagttgaagttacaccttgttccatgggctacagaacggatgttatgctattaggaatgaaaaaaacattgatttgcttgtacctctccatcagagctcttggactaggtacattgccaatagcagtaatattttgaaataaatctttttttttctgagcaatctcaatagtgagcttaaaatagttattaaacccttctgtaaacagatacgctgtcatccaggcatgtttttctatttatagagcatgagcagagtagttttgcgtaattcttaagggccataaaattttcagaatggcaaatgagcatcaacttcaacttcagctgtattagtccctaataagtgagtcatcctgatttttgaagctttaaagccaggctttgccttctctccaactatgaaagtcctatgtggcatctccaataaagagatatctatggtatagtcttccattggaagactgttttgtccacattgataaactgttgcttagattcaccttcatcaatgattttagccagattttatggataacttggtgcagtttctgtatcagcaattgttgctttgccttgaactatgttatggagatggtttctttccttaaatcttacgaacctactgctagcttcaaatctttcttctgcagctttctcacctctctcagccttcatagaattgaagagagttacgaccttgctctggattaggctttggttaagggaatttctgtctagatcactgaaactttctccacgtcagcagtaaggctgtttcttatcattcatgtattcactggagtagctttttttttttttttttttgagacggagtttcgctcttgtcacccaggctggagtgcaatggcgcaatctcggttcactgcaacctccgctcccgggttcaagtgattctcctgcctcagcctcctgtgtagctgggattacaggcacctgccaccacgcccagctaatttttgtatttttagtagagatagggttttgccatgttggcctcctgacctcaggtgattcgcctgcctcagcttcccaaagtgctggaattataggtgtgggccaccatgcccagcctggagtagcacttttgatttccttcaagaacttcgcctttgaatttacaacttggctagttatttggagcaagaggccttgcttttggcccgttttggctttcaacatgccttcctcactaagcttaataatttctagcttttgagtaaagtgagagatatgtgactcttcctttcacttgaacacatagaggcccttgtagggttactaattggcctaatcttaatactgttgtgtttcagggaataagggggcctgaggaaagggagagaggccaggggtatggtggctggttgttggaacagtcagaacacacatttcttgattaagtttactgtcttatatggttgtggcttgtggtgccccaaaagaatttaaagagtaaccttaaagatcagtgatcacacatcatcataacagatataatgataatgaaaaagtttgaatattgtgagaattaccaaaatataacacagagacaggaagtgagcccatgctgttggaaaaataatgccattaaacttgcttgacacagggttgccacagtatgtaaaatgcaatatctgcacagcacaataaagccaagtgcagtaaaatggatatgcctgtacttctgtattctaaataaaatgcttatgctgtgatttttagaaaaatatgcaaactgcagacatttgctcttaattcctgttaaaatagatgaggatttactctgcttatagtcccctcccttcctttctctctccttccttccttcctccttccttctctccctccttccttgttacgttactacagtatataacaatatttattttttaaaatttagttttttaatcagattgtttatgtagatagtttaaaactgaaataattctataaatcttattatgaaaatctgcagttgcttctgtagccactcacccccaccactcccaaccattgcctgcatcctagagacaagcatttcacactgcaggctgtttcttttgatatttaaatcatatcactagataacaaatttttggatctacttcttgattttctgttttgtgccctgtgtattggatttcctctctggaagaagaacatttagctcactctcaccgtttctaccactagacaggtcatactctccattctctgtcttcccaatgtagttaccacattcattagtctagatcactattctttgtcacattattgtgatttagtaaatgctattcacagctgagtcatgagtaaattatgactgtttctttcttgcatgactttccttgtttgtgctctgtagttaataattgtcttgcttctttgcttagttttctatgtatttatcataaattcacccccagttgttaacgttattttctccaaacattcagacacattaggtattgcatctttttgggtcttacttgcacagaaccttgtgagctgttctgtttcgttctgtatggttgccccgtatccctggggcacagataaccatcactccggggttgctgtttgcctctttctgtgtgagatccctttctgctggatcctgtggtctcaagacttgattacaaccttgttttgacaaactgtcttctctagtagtaccatgaggaaagatgcatggaagagaaattttgtgtgtcctggaaaaattttttattggtgctcttgcacttaattggtactatctagattggaaataatttttcctttagaattttgaaagcgctgattgatctgttgtcttctgggctttcattattgctattacaaaatctcaagatcatcctcccttctctctccctcccccactctttcttgacattataggattgtgattcttaaccctggcttcactttagaattatctggggactttgaccaaatcctggtatgagagattttgaagtaattggtctggagtggagcccaaacatagatatttctgaaaagctccctaggtaattctaagatgtagccagagttgagaactactgttttagtgtcttttctttgtctctcattgctgaaatttcttgatgatatgctatgatgtaggtccctttccatccgttgtgttaggtacttgattgttccattaatctggaagtttatgttaattttggtaattaaaaattttattttctcccgttcttctgatctattattttaaaaatcttgttatttgtagttcctctgcttgtctctctgattttctgtaactttttccttttgtttacagagtgatttcctcagtttgatcttccatccctttcactgagttttccttttctgtaatcctattttaatttttctgagaattcatttttttgtactctaattattctgcttttatggactcctgtttgtatttaaggatgcagtatcttccctcctttctaaggatattaataattttttgttaactttttatctcccttccttgctctgtttcctctaaattactttttgaaaatctgttacttgttttggcctcctggtttttcctataaggggctttgctcagaagccttccttggctatgtacctatttatgtttaaaagctaattatggactcgctatctgtgtggtggacttctcaaccttagcctttaccataggatctggctgggtcattgcagtgggggaactcctgggatcagaatcttgggatcttttctcttgggctggtcatattccttagagagtactcttttcaactccacttttggaagctgatttggcagaagatggctggaggatgacttttaggatgtgaaggcatgcttaatttgcctttctcatttatgtctcttgtcatgctgattagagcccctgtctctttgactctctccagagaataaacctccagcctcctgggggttgggcaagggagaggaatctctgtcttagacttgtcctttctgtgtcaaggcccaccccaccccagctttcatggctacctgctgctatccttttctggtgaggtttttgtggggtttcaaggtatgaatcagattgcttctctcagctttcctggctgctggcttagtggtcacctctctgttgagtcaggtacaacttgttcttgggttttccagctaccaaatgcccttgttcttctcaactccttttcctttctccttgttggtaagtatgtaccctaaacacagattccattactgtcaacgtaatgtgttttcaggagagagtggaggtaagctaaaggtcatctactctgtataatcagaactgaataatatgattgtggtaaatgaaaaataaagagatggtaaaaggcttcagattgtcataatgattctattttgcatgtcagctctgaggttcagtcgaaatacttggtgtgtataatgtctgcagaagcgtagcagtaactcatacttggtgttctttggttggtggcagatcatgctgcaatcagttggactgaaagttaaatttggaaaagttatttaaactcttctgttgcaatgcaggttgacagcctgtattaaaataaaatgtttggtttagaaaccctataaacactgtgttggtttcaaccaaaaaagcttgacttttctccttaaatcagtcatgactgtattaacatttaaaataccattttcttggtaccatttatacctcagcgatgtcacatagaaaattgagaaattataactcattttcattcttttattgtgcatttaaaatataaactctataatgtaatgtttcactttaagatctttttcttctttaagggaattgataacatagcactttaaggaacttttaataaaaatactgttttttggtaaattgattgtattattatccgagacaatatgtacattcttcactgcatgttcatgcaaatttagaaacccagtctgaaatttgctgcactaagaaaaagccagattaaaactttttatactaccaaaagcaacctttaaaaaaatcttgtttttcttttcaaaagcatagtgttcttgtctgtcttaggacctcttttgttagaattctctgtgggtagtttaagagaacaacattttattttgaaaaacttaaagtctacagaaaagttgaaagaatagttatacaaaccctatgtatacctgtcaccttagttcactgagtgttaacattttgctgaatttgtgctttctcagttttttttactgaaccattaaaatttaagtttagacatcatgacatttttgtctctaaataattaagtatttgtgttgtcagaataaggacatcctctttacataatcataataccattttcaactctaagaaacaattctatgataccatctaacatacaatatgcatccctcctggattttccctaacctttaacttctagctcttccccaccctccaggactccaagatgcaaataaggattgctagaacagtgccctctcctaaccttttgctttttttttttttttttttttttttttttttgagacagggtctcactctgttgtccaggctggagtgcagtggtgcgatcatgggctcactgcagccttgacctcaggggctcaagcgagtctcccttctcagcctctgagtagctgggactacaggtacatgccaccatgcctagctacatttttgtattttttgtagagatggagtttcaccatgttgtctaggctggtctcaaactcctgagctcaagcaatccacctgctttggcctcccaaagtgatggggctagaggcgtgagctaccatgcccagccaaccatttgtcttatataatgtcccacaatctgggtttgtcttattatttccttatgattggattcaggttagaacatttgtggcaaaattattacagcagtgatagtgtttacttcttattgcagcatatcaggaagcacatatcagtgtattccattaatggtggtgttgaatttgatcacttagtcaggtgtggtggtgtacccctgtgttcccagctactagggatattgagatgggaggattgcttgagcccaggagttacaggccagcctgggcaacatagtgagaccctatctcttaaaaaaaaaaatcgatcatttagttgagatggtatctgctagatctcttcattgtaaaagaacctgttttactactttttctctcctgtaattaatggataaattgggaaatttgtacatgtcatgttcccccaaaaccttttacctaatagtattccttgatccttacctgaatgagttattaatatttaattgtaaaaatggtgatcatttcttgtttattagctggctttcttccacaaagaagagctttccctcatctcctccttttctcttctttaatgtcattgttgtctctttagaaaaaaaaaacaaaaaaacctcagtgtgttagaattcattatcattgtgattatttttgatgattaaattgtcccaagtttggctagtggcagccttttgaagttggcttctgtgtccttttaccatattctcagtaatctttaagcatttcctttgctttttggcacaacgagatgtttcaggctcactttgtgctttccctgccccagagttggaatagatgatttctctaagaattcagtttgtttcagtggttcttcatatttataaatcaagatttgggcactagatatgtttattgctgctgattatgattatatccataccctttcaataggaatatctaggaaatagatagctttcttttctttctttcttttttttttttttttgagacagggtctcactctgttgcccaaactgcagtgtagtggtgtgatcatggctcactgctgcaccctcgacatcctgggctcaggtgatcctcctacctcagcctcctgagtagctgggaccacagacatgtgccaccacacttggctaattttaaattatttgtagagacgggatcttcctatgttgcgtaggctggtctcgaacttctgggctcagtgatcctcccacctcggcctcccaaagtgtggggattacaggtatgaaccactgcacctggctgggtagctaatttttaaatcatacatttattactgatattcgctattcaaatttgatactgtaggtttcttttttttaaaccttctcccacttttatatccctggttcccagcagtgagaactctggttcacaacattactgtatttatctaattgctctcacctacaatatacacaatacagtgtctcagttactatacctatacctttaccagtcttatttgtttgtttatttgtttgttttttgagacggaatctcgctctgtcacccaggctggagtgcagtggtgccatctcggctcactgccttaccagtcttatttggattcaaagtacagagattaattcaggctactggaaaatgataaaggataaaggattcgtgtaaggatacatagtagcatggatctaaaaggtagcttctggcatcagctactctcattcacccactctcttggccttctttgttggcctctctttctcattccatgtgtctctgcatcttgtctctcaccttcaacctttctaagtgggaaggaatttgttaggttgattatttaccctctaagtagcatttctgttggacagcttgtgatccaggtatcttggtcttgttggccaaagtgtgggcaatggggacttcttttgttcaaaacaacggaaagctttcttgtatttggtcagtataatcactgggcacttttaggttttatggtccagtacaaactggttttcatttttcttagtatagtgatagatttcctttaccctggagtgtttaaagttcatgagtaattttgaaaataaggtagtaaaatatatttaatttccagctgccagccagaaaactgtagtctatttctgaacaaatgaaactcagtacacagacatatttagtgattaatgacctattctaagaggaagcctgaaaggaggaagaaggtgtgttttctccctgggctgtgaatgagaagataaagtaagtatccaaagtacataaatctgatattctgagattaataataggctttatctggggtaggtgttagtgactgagaattaataagacagtttttaaaatgtagcatgcatagtgaaaagaacacaggctttcaaatatgacagacttaaggtccacatttggcttggctcattcaaactctgtgacactgggcaaattaccaatgtactctgagcctcaatctcctcttttgtaaaacgggcatgataaaacttactatctatcatagtagatagtaactatataaatgagaaatcacagatgattggacagttaaaaatttttttttttgctttctggcaagaaaaattccggctctggagaaataatgggaaagtccccagtgtcagcaaaggaaaacatgtccaggaagggtaacagaaggagaagtatgacctgaaaacctgggagcagtctaggcatgaagagaaatgagctcacctctttgagcttcactttactcatctgaaataaaagaagagagcatccctggtagagactggagtctgaaatatcatgaggtcaagctaggaagagttcctgctgtgtatgaatatttgtaaataagcacagatattgtacatagcagcgttatttacagtggccaataggtggaagctaagtgtccattgatgggtaaatggataaacaaaatgtcgtatgtacatacaatggaatatcttcagccttaaaaaggaaggaaattcggacacatgctaaagtgtggatgaaccttgaggacataatgctaagtgaaataagccagtcacagaaagacaaatattgtatgattccacttacatgaagcatctagagtagtcatagtcacagaagcagaaagttaaagtggtagttcccaggggctgggggagaaggaaattgagagttgtttaacgagtatagcattttagttttacaagatgtaaaacttctagagattgattgcacaataatgtgactattgtaaatatacttaatgctaataaactatacttagaaatggttaagatggtaaattttatgttatagttactttactgcaattaaaaaaagtaagcacagcattttaaaaggtatcatttgtataatagaggtgtgtacatatgcatatataactatatatattttttcaattttatttaattttttaggtgcagggtttcactgtgttgcccaggttggagtgcagtagtgcaattatagcttactgtcaccttgaactcctgggctcaaatgatcctcctgcctcagtctcctacgtagtgaggatacaagtgtgcatgacaatgcctggctaattaaaaaaaattttttttatagaaacagggtctcactatgttgctgaggctagtctcaagggatcctccattcttggccttccaaagtgctgggattataggtgtgaaccactgtaccactatatattaatggttataaaatacaaatatttaacaattaatcatatgtatttcatattgtaccatttaaaacaatgtttctactaagactaaaaatcatacaacctttctgcaggacaaggtacagattcatgttgactctgaaattccactttcaggaattataaggaagcatgtgtacaaaagtttaacaagtttaatataagtatgcttacaaaagtttaacatgattcacagtactatttgtagtaatagcaaaaagttggaagcaatcataattgctcagtactggagaattcattaagtaggttatggtacatttatcaactcattgggatggagtattgcagaaatgtatcttgacattgaaaaatatctagactgttaatacttgggaaaaaagtagtttgcatgtataaataacagaactcatttcttaattttacatattgtgctgtagccactgtaacaaaatatttctcttgtgctatttttattacttacacaattttgttacttacataatttggtatttataagcttttgatgttcagagtacctgatgataaagaacataatacttaggctgggagcgatggctcacatctgtaatccaagcactttgggaggccaaggtgggcagatcacttgagttcaggagttcaagaccaacctgaccaacatggtcaaacaaatacaaaaagtagctggtggtgcacacctatagtcccaactacttgggaggctaaggcaggataattgcttgaactgggaggcggaggctgcagtgagcagagatcgtgccgctgcactctagcctgagtgacagagcaagactccgtctcaaaaaaaaaaaagaagaacttaatactttcgatacttgctataattaaatgttttcagagtctgatttttttttttttttttttttttttttgagacggagtcttgctctgtcactcaggctggaatgcaatggcgtgatctcggctcactgcaacctccccctcccaggttcaagtgattttcctgcctcagcctcacgagtagctaggattgctgggattacaggtgcccgccaccatgcctggctaatttttgtatttttagtagaggccaggctggtcttgaactcgtgacctcaggtgatccacccgccttggcctcccaaagtgctgggattacaggtgtgagccaccacacccagcctcaaagtctgattttgaagagaatatatgcttcataaagttgcatttttcttacctaatattcatttaatcaagttaacattatagtactttcatagaagaagttattaaacactttcatgttagaatctaataaccatgattgttttaaaacaaagtttggcatttatttggttattaatcactcaaacataattaatcactatggttaattactgtgtttctctgtaagttttgatattaattctaaaggatagaagtctacatattattttttgtggtttgtgttacaatttcatatttgtccatgccaatcctggtgagaattgcagcctgtcttagctgttgaagtacttcagcccataaaatacttcaagctattttgtatcattttgtatagtgtctaggaatgtagactatttagtctagtttgttggactcaatcctgtacttccaagtgaagtcaagttgctgtttgagcggccctggctaaattacttcatctctttgagcttcactatactcatctgaaataagacatgataataaatagacacagccttattttttgtgaatagaatattattcattccattatagtgcatttcactatatgtgctcagcatgcagagtctatcctaccaactcatgctcctgagagagcttaagaattcccattccctcagtggttctcagttctctcatcctctgatagtttgaccattttttgtgtctccagttcctcatgtataaaatgagaacattgattgtacctacttcatagggttattgtgaaatgaaattatttgttgtgtgtaaatttgttgaaacggtgcctggcacatggtgactaataatcctgtgaatattagttattgctgttaccttggttcagagtatgtaatgcattaattttaaaaaggaaccacattgcccacattcaggtgatggatgatttttttatcccctcattgatggactctcagtatcctttacttggcacttcctaggttcttcttgggttaaaaaggtattggggttgggagtggtgattcccacgtaatcccagcactttgggaggctgaggcaggcagatcacctgaggtcaggagttcgagaccaacatgtgaaaccttgtttcttctaaaaagacaaaaattagctgggtgtggtggcgggtgcctataatcccagctacttgggaggctgaggcaagagaatcacttgaacccaggaggcagaggttgcagttagcccagattgtgccactgcactgtagcctgggtgacagagcgagactctgtctcaaaaacaaacaaaacaaaacaaaaccaaaaggtactgggactgggatgttaggggcatgatatcaaaggaagtaatcagcaactatggagcttggtgataaacacataggaaacagcaagtaggtcttagggtattctcattattaggtgatcaggaagtcagatattgtaaatggccagacaagattagtgttaaattctgaagaatgcaggcttactatctgctaatagaacaaacacacatctgtcaaatacaaggatgtctatctaagaaatgggtgaacctgaaagcaataaagactacattttgtaacaattcaagacttggagatgggggaatgaatcattgctagtagtagactctttaattgtttttcttcaacccctcccccccaaatgaaagacacacactcatatatgcacacgtgcacatatgtgcatgcacacacaaacacacacagttttattcattaatgacagcttctgagttaggtgctggggacatgaaaatgagccctcagagagttaactataatacaatgaaagtttaatagaatgataatactgatgtgtgaatatagatgtgataatgttgataagtgaatatagatagagcctaaagctgctcagcttccctcaagtgtaaggaaacagttacaaacaagatcaagaataaggaagagggggaggagccaagatggccgaataggaacagctccggtctgcatctcccagcgtgagcgacgcagaagacgggtgatttctgcatttccatttgaggtaccgggttcatctcactagggagtgtcagacagtgggcgcaggagagtgggtgcagcgcaccgtgcgccagccgaagcagggtgaggcattgcctcactcgggaagcacaaggggtcggggagttagttccctttcctggtcaaggaaaggggtgacagacggcacctggaaaatcgggccactcccacccgaatactgcgcttttccaatgggcttaggaaacggtgcaccaggagatgatatcccacacctggcttggagggtcctacgcccaccgagtctcactgattgctagcacagcagtctgagatcaaactgcaaggcggcagcgaggctggcggaggggcgcctgccattgcccaggcttgcttaggtaaacaaagcagcctggaagatcgaactgggtggagcccaccacagctcaaggaggcctgcctgcctctgtaggctccacctctgggggcagggcacagacaaaaagacagcagtaacctctgcagacttaaatgtccctgtctgacagctttgaggagagcagtggttctcccagcactcagctggagatctgataatgggcagactgcctcctcaggtgggtccccgagcagcctaactgggaggcaccccccagtaggggcagactgacacctcgcacggccgggtactcctctgagacaaaacttccagaggaacgatcagacagcagcattcgcggatcacgaaaatccgcggttctgcagacactgccgctgatacccaggcaaacagggtctggagtggacctctagcaaattccaacagacctgcagctgagggtcctgtctgttagaaggaaaactaacaaacagaaaggacatccacaccaaaaacccatctgtacatcaccatcatcaaagaccaaaagcggataaaaccataaagatggggaaaaaaacagagcagaaaaactggaaactctaaaaagcagagcgcctctcctcctccaaaggaacgcagttcctcaccagcaacggaacaaagctggatggagaatgactttgacgagttgagagaagaaggcttcagacgatcaaactactccgagctacaggaggaaattcaaaccaaaggcaaagaagttgaaaactctgaaaaaactttagacgaatatataactacaataaccaatacagagaagtgcttaaaggagctgatggagctgaaagccaaggctcgagaactacgtgaagaatgcagaagcctcaggagctgatgcgatcaactggaagaaagggtatcagcgatggaagattaaatgaatgaaatgaagcaagaagggaagtttagagaaaaaagaataaaaagaaatgaacaaagcctccaagaaatatgggactatgtgaaaagaccaaatctgcgtctgatcagtgtacctgaaagtgacggggagaatggaaccaagttggaaaacactctgcaggatattatccaggagaacttccccaatctagcaaggcaggccaacattcagattcaggaaatacagagaacgccacaaagatactccttgagaggagtaactccaagacacgtaattgtcacattcaccaaagttgaaatgaaggaaaaaatgttaaggagaaccagagagaaaggtcaagttacccacaaagggaagctcatcagactaacagcagatctctcggcagaaactctacaagccagaagagagtgggggccaatattcaacattcttaaagaaaagaattttcaacccagaatttcatatccagccaaactaagcttcataagtgaaggagaaataaaatcctttacagacaagcaaatgctgagagattttgtcaccaccaggcctgccctaaaagagcgcctgaaggaagcactaaacatggaaaggcacaacaggtaccagccgctgcaaaatcaagccaaaatgtaaagaccattgagactaggaagaaactgcatcaactaacgagcaaaataaccagctaacatcataatgacaggatcaggttcacacataacaatattaactttaaatgtaaatggactaaatgctccaattaaaagacacagactggcaaattggatcaagagtcaagacccatcagtgtgctgtattcaggaaacccatctcacgtgcagagacacacataggctcaaaataaaaggatggaggaagatctaccaagcaaatggaaaacaaaaaaaggcaggggctgcaatcctagtctctggtaaaacagactttaaaccaacaaagatcaaaagagacaaagaaggccattacgtaatggtaaagggatcaattcaacaagaagagctaactatcctaaatatatatgcacccaatacaggagcacccagattcataaagcaagtcctgagtgacctacaaggagacttagactcccacacaataataatgggagactttaacaccccactgtcaacattagacagatcaatgagacagaaagttaacaaggatacccaggaattggactcagctctgcaccaagcagacgtaatagacatctacagaactctccaccccaaatcaacagaatatacatttttttcagcaccacaccacacctattccaaaactgaccacatagttggaagtaaagctctcctcagcaaatgtaaaagaacagaaattataacaaactgtctctcagaccacagtgcaatcaaactagaactcaggattaagaaactcactcaaaaccgctcaactgcatggaaactgaacaacctgctcctgaatgactactgggtacctaacgaaatgaaggcagtaataaagatgttctttgaaaccaacgagaacaaagtcacaacataccagaatctctgggacacattcaaagcagtgtgtagagggaaatttatagcactaaatgcccacaagagaaagcaggaaagatccaaaattgataccctaacatcacaattaaaagaactagagaagcaagagcaaacacattcaaaagctaacagaaggcaagaaataacgaaaatcagagcagaactgaaggaaatagagacacaaaaaacccttcaaaaaattaatgaatccaggagctggttttttgaaaggatcaacaaaattgatagaccgctagcaagactaataaagaaaaaaagacagaagaatcaaatagatgcaataaaaaatgataaaggggatatcaccaccaatcccacagaaatacaaactaccatcagagaatactacaaacacctctatgcaaataaactagaaaatctagaagaaatggataaattcctcaacacatgcactctcccaagactaaaccaggaagaagttgaatctctgaatagaccaataacaggctctgaaattgtggcaataatcaatagcttaccaaccaaaaagagtccaggaccagatggattcacagccgaattctaccagaggtacaaggaggagctggtaccattccttctgaaactagtccaatcaatagaaaaagagggaatcctccctcactcattttgtgaggccagcatcatcctgatcccaaagccgggcagagacacaaccaaaaaagagaattttagaccaatatccttgatgaacattgatgcaaaaatcctcaataaaatactggcaaaccgaatccagcagcacatcgaaaagcttatccaccatgatcaagtgggtttcatccctgggatgcaaggctggttcaatatacgcaaatcaataaatgtaatgcagcatataaacagaaccaaagacaaaaaccacatgattatctcaatagatgcagaaaaggcctttgacaaaattcaacaactcttcatgctaaaaactgtcaataaattaggtattgatgggatgtatctcaaaataataagagctatctatgacagacccacagccaatatcatactgaatgggcaaaaactggaagcattccctttgaaaactggcacaagacagggatgccctctctcaccactcctattcaacatagtgttgaaagttctggccagggcaattaggcaggaaaaggaaataaagggtattcaattaggaaaggaggaagtcaaattgtccctgtttgcagacgacatgattgtatatctagaaaaccccattgtctcagcctaaaatctccttaagctgataagcaacttcagcaaagtctcaggatacaaaatcaatgtacaaaaatcacaagcattcttgtacaccaataacagacaaacagagagccaaatcatgagtgaactcccattcacagttgcttccaagagaataaaatacttaggaatccaacttacaagggacgtgaaggacctcttcaaggagaactacaaaccactgctcaatgaaataaaagaggatacaaacgaatggaagaacattccatgctcatgggtaggaagaatcaatatcttgaaaatggccatactgcccaaggtagtttatagattcaatgccatccccatcaagctaccaatgactttcttcacagaattggaaaaaactactttaaagttcatatggaatcaaaaagcccgcatcaccaagtcaatcctaagccgaaagaacaaagctggaggcatcacgctacctgacttcaaacaatactacaaggctacagtaaccaaaacagcatggtactggtaccaaaacagagatatagatcaatggacagaacagagccctcagaaataacaccacatatctacaactatctgatctttgacaaacctgagaaaaacaagcaatggggaaaggattccctatttaataaatggtgctgggaaaactggcaaccatatgtagaaagctgaaactggatcccttccttataccttatacaaaaattaattcaagatggattaaagacttaaacgttagatctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaatttttgcaacctactcatctgacaaagggctaatatccagaatctacaatgaactccaacaaatttacaggaaaaaaacagacaaccccatcaaaaagtgggcaaaggatatgaacagacacttctcaaaagaagacatttatgcagccaaaagacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactcttggtgggactgtaaactagttcaaccgttgtggaagacagtgtggcgattcctcagggatctagaactagaaataccatttgacccagccatcccatttctgggtatatacccaaaggactataaatcatgctgctataaagacacatgtacatgtatgtttattgtggcactattcacaatagcaaagacttggaaccaacccaaatgtccaacaatgatagactggattcagaatatgtggcacatatgcaccatggaatactatgcagccataaaaaatgatgagttcatgtcctttgtagggacatggatgaaattggaaatcatcattctcagtaaactatctcaaggacaaaaaaccaaacaccccatgttctcactcatagatgggaattgaacaatgagaacacatggacacaggaaggggaacatcacactctggggaatgttatggggtggggggaggggggagggatagcattaggagatatacctaatgctaaatgacgagttaatgggtgcagcacaccagcatggcacatgtatacatatgtaactaacctgcatattgtgcacatgtaccctaaaacttaaagtataatattaaaaaaaaaaaagaataaggaagactaatgccacatatctacaaccatctgatctttgacaaacctgacaaaaacaagaaatggggaaatgattccctatttaataaatggtgctgggaaaactggctagctatatgtagaaagctgaaactggatcccttccttacaccttatacaaaaattaattcaagatggattaaagacttaaatgttagacttaaaaccataaaaacccttgaagaaaacctagacaataccattcaggacataggcatgggcaaggacttcatgtctaaaacaccaaaagcaatggcaacaaaagccaaaattgacaaatgggatctatttaaactaaagagcttctgcacagcaaaagaaactaccatcaaagtgaacaggcaacctacagaatgggagaaattttttgcaatctactcatctgacaaagggctaatatccagaatctacaatgaactccagcaaatttacaggaaaaaaacaaacaaccccatcaaaaagtgggtgaaggatttgaacagacacttctcaaaagaagacgtttatgcagccaaaagacacatgaaaaaatgctcatcatcactggccatcagagaaatgcaaatcaaaaccacaatgagataccatctcacaccagttagaatggtgatcattaaaaagtcaggagacaacaggtgctggagaggatgtggagaaataggaacacttttacgctattggtgggactgtaaactcattcaaccattgtggaagtcagtgtggtgattcctcagggatctagaactagaaataccatttgacccagtcatcccattactgggtatatacccaaaggattataaatcatgctgctgtaaagacacatgcacacgtatgtttattgcagctctactcacaacagcaaagacttggaaccaagccaaatgtccaacaataatagactggattaagaaaatgtggcacatatacaccatggaatactatacagccataaaaaatgatgagttaatgtactttgtagggacatggatcaagctggaaaccatcattctcagtaaactatctcaaggacaaaaaaccaaacaccacatgttctcactcatagatgggaattgaacaatgagaacacatggacacaggaaggggaacatcacacaccggggcctgttgtggggtggggggaggggggagggataccatttggagatatacctaatgttaaatgatgagttactgggtgcagcataccaacatggcatatgtatacatatgtaactaacctgcacgttgtgcacatgtaccctaaaacttaaagtataattaaaaaaaaaataactaacagatttgaaaaaaaaaaaaaaaagagaaaagaataaggaagactctgggcaccagtaggccctcagacctgtaatcctcttgcaatatttctgcctcagttctgtaccatgataacctggacaattttgatttgtttttatcctaattcatggtgttgcttagggagacagagatgaatgaaaggctcccaattccttgatttcatttatactactgacttaaagaactatgctagtagaagcactccttggatttactcaatttttgtgcttatacgtgatataataaatttgtaactggaataactgaaccaaggaatatttacatttaagttttcttagaccttcttttgcatttaaaaatactccttacaggccgggggcagtggctcatgcctgtaatcctagcactttgggaggctgaggtgggggaattgcttgagctcaggcatttgagaccagcctgggcaacatggtgaaaccccatctctacaaaaacagaaacgcccccaaattatccaggtgtggtggcatatgcctgtagtccaggtacttgggaagtgaggtgggaggatggcttgggcccagaaggctgcagtgtgctgcaatcatgccattgtactccagcctgggcaacaaatcaagaccctatcttaaaaaaaaaaaaatcctatgtgggaaatgcttctttcctatttctaatgattcacttcatatgacagagaccccattagtgtaatatttatgccttcttgtgccttttggaagtgactgaatgtgattggtgagtttcaaattagaaagtgggtttatttggaccactcactttttcctctttcttttatgagcaagctatctgtgatttagcctgttccatcatgctgtaagttttacagggtcaggctgtcccacttgcatgacactgcattgcctgtgactgggagggtaagtcttcaattatgggacttagtgtttggaaaccatctacttgcctgtagtaagtaatattctttaagctaggttatattgttagtaaaggtaatattttgctccttttgccttcgtatttctcttatccttctatctaacttatttctcttacttcttatctattttatctcacttctcagttgattcagagtttattcagaaacagggtttcctatttgttggattgccttaaacataaatgtcttgtacttccttagataaatcagggttaattcaagtcaagtgttaggagccactgccaagtaaagaataatcagcaataagagaagcatttttgtctctgcatgaagatgagcagtattcattcttaatttctagccaatttataaaacataatggaccatgttaggatgaccaaacagtatttgtgtgtgattccattactataattgttaaaatttcaaattaagctgtcacaatgcctgtctcctcaaaactgacttttccctggtatgttgatgagattcaagtcttgatttgattgtgatgtttaaacaatttgcttcggtaatgctattcaaaataaaatctctggatgtgataaaggtcatttagtgccagtaagtttttaaaaaatattttgaaaataaaaataaataatttaggtgtagagtttgcctttttaacaatattttttattgtgaatcttaagtctgcagtcctctttttcactcttgaaaggtttcaaaatatgtgacccttttgaaattaaaaaaaattttaataaacttttaattttagaatactttagattttacaatagtattaaatagtaatggatttagatttaggatagattttagatcttggcaacagaaaagttgcaaaaatattacaggtaggtcctgaacaccctgtgtccaacttcccctgttgttagcatcttaaattagtatgtacatgtatcataactaatggaccaacactggtacataatctttaattaaattccatacttgatatgagtatcattagttcttccctaacgtcctttttgtttttttgccttctggcatcctatccgggataccacattacatttcattgtcatgtctctgtagtcttctctggtctgtgacattttcttagactttccttgtttgtgatgattttgacagttttgaggagtagtggtcaggtattttgtagaatgtccttcaatttgggtttatctgatgtttttcctatggttagattgaggttatgggtctttgcaaggaagaccacagaggtgaagtgccattattaacatatcaattcacatgtcttatcaagggtaggtgctacccacatgacttgtcactatgatgttattatccttgattacctgactgcggtaaagtttgccaggtttctttcctcccccatccttacttacatcattatttggaagcaaagcactgtaagtgcagcccacaacgggggatggggaattaagcttcacatccttgagaggagaatatctacataaattgtttggatttttgtgtgaaggaaacttctttcttctctaattttttaattcattcagtcacttgatgtatgtcaatatggacttgtagatatttatactttggattataatccaatgttatgctacttgttttgttgctcaaattattccagctttggccattgggagctctttcaggtttgctcctgtgtgctttcgctatgctcctttgctttgttttttgagcacttccttccttttctgacattccaaggtgcttgaggctcatcttgtgtatttcctgccctagccctgaaatcaaccatttctctaaggagccctggttccttttattggaagctgatattagaaaccaatatctaagcgctgggcctttgaaatgttttgccatctatctttaagagtaatactgctattttgaaatcatagcttataaaactttagacctattttagttagtaagtgaaatactttttggtacccattgtctatgtaattaggatggccacagttccatttagagataaaaaggagatattcaaggttaaataaacaaagcagcctaaaagtttgtggatagtaatgacgttggctatggatgcaggtgtgcttgggtttaacggagactgttagggttgtttagaggatgcctgttggctgaagaggatgaggagaggcttattttagtaaactgttcttcctctcccagatcaactgtaatctcttccttgttctttctgttcttcctgggagaatttagttactcttgtaactaaaattcccctcaaaacttattacactctactattgaagctgtttgcatcttgcttttgcaagaatctgtagactcccggatgttagggatttgtatttcttttcctttttttttttttttttttgagatggagtttcgctcttgttgcccaggctggagtgcaatggcgccatcttggctcaccacaacctctgcctcccgggttccagcgattctcctgcctcagcctcccaagtagctgggattacaggcatgcactaccacgcctggctaattttgtatttttagtagagatggggtttctccatgttggtcaggctggtcttgaactcccgacctcaggtgatcagcccatctcggcctcccaaagtgctgggattagaggcgtgagccatcatgcccggccttgtatttcttctttgtataatctttagcacagaatttagtaggtgatgacttcagggtattctgtaattatggtttgaagtgaactgaattcagttttgtagatagcatatttcatcatagttagtgaacaatataaatgtctgaaaagataaacataccaggttcaaagaaaagttcaagatggcagtaaaagagccattgaactgatatgtgttgaatggctaaatgaatatcttgactgttgtttgttgcaggactttagaggatgatgggctgtcagggaagtcttacctgaggaagtgatatttggtttggttttaagctatgggtagggcatggatggggcaagttggctggaatattgtgggtgggaaatgacttttttagagagtgttggataggcctgtctgccgtaacagaacatttcaatagagactataaggctggagaggtaagtttgggtcaggtagattgaagaggtatgtgaatgtcagctttctcagttagagaaccatggatagtcatggataactcttaaatgttttgagcaggggaatcaagatctgagataaattctttttttttttttttttttgagacagaatctcactctgttgcccaggctggagtgcagtggtgccatctcagctcactgcaacctccacctcctgggttcaagcgattctcctgcctcagcctcccaggtagctgggattataggggcataccaccgtgcctgttttttgtatttttagtagagacaggttctcaccatgttggccaaactggtcttgaactcctgacctcaaatgatccacccgcctcggcctcccaaagtgctgggattacaggcgtgagccaccgcgcccagcctgagagaaattctaggaagactgatctagagtagaggctggaaattggtggctcacaggctgagtccagatggtagatatattttgttctatatactgtaacaattttaagccaatattcaaaaattgagaaatatcataaaaatagagagtttagggtcttcgtataaaagcaggtgatctggcaacactgggcccacatactcacatggcagcagttggttggggttgagcagaagacagcaccctaagaaggcacattcatcctgatgttcaccactgtccccaacctccccattaccttatgcttagtccacttgacattgcctgaatatctcatatatatttgaatttgggattcttgacttagagatatagtgtatagacttttgtggtatttttaatagtgagattcaggggacccaaatctgggtggttgcaaaggaaatgaaaaaagtatatatataagcagtggttatataagagacagggtgaaagaataactaaataaatctggaccaataacttataaggtccaagaggctaaaaaaaagaataaaagatgactgtatctgttacctattgctatataacaaattaccccaaaacctactagattaaaacaagaaatatttactgtatcacagtttctgagggacaggaatctaggaattgctcagctgtgtgttttaggctcagggtctcccatcaggtggcagtcaaggtgttgtagtcatctcaaggctcagctgagttagtggatctgtttccaggcttactcacatgcttgttggtccacctcagttccttgcttgctgttggccagaagccacagcatgctcaccacatgacagcatgctttccctagaacaagaaaccaagagtgagggagagtaggcacccaagctgaagattttgtcttttataatgcaatcttggaagtaacgtaccatttttgctgtatacagttggtcacaatgacaaccctagtgcactgtgagaggagactgtgtaaggatgtgcataacagaggtggggattactgggattcctcctggaggctggctatcacaatgactctgaaggaccaaaatatttgtggcagcaacattcctgaggaattttcgctcatgtatgaaatgttgttttggggcatcctctaatgaaaactacttgtgattttaattgttctgctccactaattgaccctgattcttgtttacttttgatatactcttagataactttagaataaaataattagcagttttaaaggtcatatggggcattcctttaacttcataggttttaaaaattgggatcccgaaagataatgacttgatcggaatcacatggctaatcagttgcagttctaggagcagatcgaagagagttagcttgcagtatgtgccgtttctgctctgccatgcagtctcctgccccacgctcttctagtatgggcagtatcatcacataaaaacatcactttaagaaacttctacctatgattcagctaataagtaacatgtatttttagttcttattttccatcacatgaaataatttagatgttatattgcaaatttatgtgtttttatatgtaaatttgacattcggctttaccaaatgattaagcatttacataaccgaagcctgctaaagaagcctaaaaatatacctattttaaaagttgagattttgacatgtcagctttcttggcattactcaatcctcatgtctaaaataacctggaccccacatgctagggtgttactcttccctacttttatttcagtttcccttttggagaaccttttataactaatactggtattcttttattttctcactggagtattaatactttatatataagtcattctgcctgtgtcttagaggccaaagtacatgtctagtgactcttcaatgcaatgttataatgggatttttctcctggttagaagtttttgggctgaggtaaaaggtcggttactttctaagtttgtaaggtatagttttgtatacatgtatatgtgcatttagaagaaaagtccacagggttcatcagattcttgcagagagctatgagccaaaaactgttaatgatttctagtgtttgatgcagttttttccctgtagttgtgattgattttgctcttacatgtgtgcattttgtattcatggcaagcaatgtccaggtatttccagttttttagataggaaaatggagcctcaacatcttgtccataaatagtcaataataaaatatatacctaaatattttgatgcaaggcttttgtgtttatttgatgatgatttatacatttagaaatgttagaaaaaaataaaattacagcaacattttaatactctgcattcagtacaggaaattatagtgtctccttaaatgacaccacattctttacctattatatcacagacagatccagaatgtcagttggacaactgctctttgcagacaattttagtcacatactagtgtgaggattatcattagcctaaattgggggccctgtgttaaagaatttatgaacttctaaagtaatactcagatttctaaggtaatatttatgattccattcccttttaaagagactcttatataaagggaatatagttaagattcctcctagtaattgtataatcagagttttttttttttaagataaattattttgggatgtggtagctctaaggctgtgtttatattgaccagaagagatatgtttataaatagagcttttcttttctcaaattcctaccttactccttgataatttaggctccttgctggatttttctttttttttttttttgagatggagtttcgctcttgttgcccaggctggagtgcaatggtgtgatcttggctcacgcaacctctgcctcccgggttcaagctattctcctgcctcagcctcccaagtagctgggattacaggcatgcaccaccatgcacaggtaattttggatttttagtagagacggggtttctccatgttggtcaggctggtctcaaactcctgacctcgggcgatccacccacctcggcctcccaaagtgttgggattacaggcatgagccactgtgcccagcccctttgttttcatttttaaaggcagcaggttttactgtaagagtcccattttacaggtgtagcaaaaactagcctgggaaaaatcctggttcatcatttcaaacccttattatgttgcagcactcaggtaaattgactgaggatgccaacttttagtttatccagtagtgaacctgagcccccaactctatgtggatgcatggaatgaaatagggcatcccacactctgcgttttattgtattagcagggtttgaaattaggagaaattatgatctttataaattaaattcagctgattttcagcttaactaaattatttttattgagtcactgccttttacaacttgaagataacattaggtccaaaaattatatcatactttatggcgtaacaccaataccatgaggcctgggagtcaaacagaccaaatgttgaaaacctggctgtaccatttttaagtgggacttttcatgatttgtctaacttctctgtaccccagtttctttaccaaattaatggtttcctggttactattgcatcattaaactctcttatctgctgtttaggagtcttatctgctgtttagacactgattaagttataacaccagaatggatgctctgaagggcagattcatatgcaatgagaacatatagtgaggcttgactgaaggaagtcagcaaaggaacatcaataaataactctttagccaaaattttgatgtaactgtattgatttccttacacatgagttttgatattttatttctacttttagtatccttttcgtatgtgttaactccatgttggaagtgggcagagtatggataataaagtaataagagaataagctttttgaggacaggaatacattttttctttccttctttgtgaaacggggtctcaacttgcaacgccacttgcccaggctggagtgcagtggcgtgatcttggctcactgcagccttgacctcccgggctcaggtgattctcctgcctcagcctcctgagtagctgggactacaggtccctgccactacacgtggctagtttttgtgtttttttgtagagatggggttttgccatgttgcccaggctggtcctgaattcctggactcaatccacccgctttggcctctcaaagtgtgaggattacagacatgagccaccgtgcctgaccaatttttttttaatagacttttagagcagtttaagtttacagaaaaattaggcagaaagtacagagttcccgcatccttcctcttctcacatcatttgggttaatgccttgaagtgtaattgctgaattatatggtaagactatgtttagctttgtaagaaacaactcaaagtagctgtattgttttgcatttccaccatcagttaaagagagtttctgttgctccacctccttgccagcgtctggtgttgtaatctttttagattttagccattccaatagatgtgtatagtggtgtctcacgttgttttaatttgcaattctctaatatggtgttgagcatctttttatatgcttatttgccaactgtatatttcctttagtaaactgtctgttcagatattttgcccacttttaaactgagttgtttgctttcttatgattgattttttaagatttctttgtatattttggatactagttctttatcatatatgtgatttgcaaatatatgtgtatattgcgatggagtctcactctgtcaccaggctggagtgcagtggtgtgatcttggctcactgcaacctctgactctctggttccactatgccctgctaagttttgtatttttagtagagatggggtttcaccatgttggccaggatggtcttgatctcctgacctcttgatccgcctgccttgacctcccagagtgctgggattacaggtgtgagccaccgtgcccagccatgatttgcaaatattttctcttagtctgtggcttatcttttcattttcttaacagtgtcttttgcagagtggaggtttttaattttaatgaatccaacctatgttttttcttttatggatcatgatgttggtattgtatttaaaaattcatcatcaaatccagggtcatctagattttcttttatgttatcttcctaaagttttatagttttgaattttacatttagtctgtgattcattttgagttaaattttgtgaaaggtataaggtctgtgcctaaatttgtatattttttgcatatagatgtccagttgttccagtaccatttgttgaaaagattatccattctctgttgaattgctttttcttttttgtcaaagatcactttactaaatttgtgtgggtctatttctgggccctctgttatgttcctttggtcgacttgacttttcttttgccaaaaccacactgtttcgacaactgtagctttataataggtattgaaattgggtagtattagtcattcaacttgttattttctgggattgtgttgtctattctaggttggaataattttttataccttagaaataagcacttggtaaatattctgtgttgagaaactttttctcggtacacaatggttacctttttaaacacaagtcagatctgttattcttttgcctcagctccctccagtggcttcctattttagtgagaatcaaattgaaggtcttcgaaatggcttatatggtcctgtggtacctggctcttctgttacctctttagcttcatcttttaatactttttgtcttggtctctttatttcatacctaatggcctccttgctcttgtttgagtacaccaggcatatcctgtcttaggtctgtagcagtggctgttggctttatctgaatgtctttcttccagatatctgtatggctaactccttcatctcttttaagtcttattcagatgccccccttctcaatggggactctctgatcattttatttaaaattccatcttgcctctcacttgtccctcaacctccacaccctcaatttctcttaacctgctctgttttatttcacagccatcactatgaacatcctctaatacttatttgttttatttatttatttatttatttatttatttatttatttatttgagacagggtcttgctctgtcacccaggcaagtacagtcgtgcgataccagctcactgcaacttccgcctcttgggttcaagcaattctcgtatctcagcttcccgagtagctaggattacagatgtgcaacaccatgccacgctaatttttgtatttttagtagagatgggatttcgccatgttggtcaggctggtcttgaatgcctgacctcaagtgatctgcccactttggcctcccaaagtgttgggattacagatgtaagccatcactccctgccacttgttatttttattattattgattgctgtttctctttttgttagaatttaattccacattgtcagggctctttgttttgtttaccagtgtatcttcaactcataaagcatagtaggttttcaataaatattagttttaaaaaatgtatgaatgtgtaagttgagactgatagagcattagctgtgtgcaagaatgctgattcattagatcttacctgatctttagctgatgaccttctaagatgaactgaaaactgaaaccaagccaaagaaatgtttttagaaaattcattgattttttttgacaagctgcagctgcttgtggtggtataaataggtttccttactgtgttatttaagagtagcttaagggcatgagccaagtcaaaacagaaaaaaagcactgactcattagatttttaaagcatgggttgtccacttgtgtttctaggttaagagaattggggtttcccatataatcagaactattaaaggtactgcaaggctgtgtgcggtggctcatgcctgtaatcccagcactttgggagattgaggcgggtggatcacctgaggtcaggagttcgagaccagcctgaccaacacggtgaaaccccgactctactaaaagtgcaaaaattagctgggcatggtggcgcgtgcctgtaatcccagctacttgggaagctgaagcgggagaattgcttgaacctgggaggcggaggttgcagtgagtcgaaatcacgccactgcataccagcgtgggtggcagagcgagactgagtctcaaaaaggaaaaaaaaaaaaaaaagataccgcagcaattgcagagaaaggccttatatgtctgatgagaaactgcaagctttagaaagacagcagtgctatcttcccaaacaacatgatagccagcatgtcaaagccagatttcttttacccatctttgtatctcggcatctagcctggttagtacttggcatgcagtaggtgctcagaaactacttgttgaaagaatgcattgtcagtgaacagtggtcacattcatgatgtggaaatgtcatggacatgggagacattatactcatgtgttctcatgtgttcttgttttataagaacatgctttttatactgtatcatagaaattgtattaagcaaattgactttgacttgaagtctcaggcatgtaagctttctacaaaatgtgaatccatgcttcaattaatcaatctttgagagataaggctcaactttcacagttagagtggatggattgggttttggtcccatgaggctgtagtgtaagaatactaacttgtgcgtgtgactagctaagtaggacaaatccttttgctcagattctctttgcccacatatagttcaagtaaacacaatgaacccaaaaccaaatttgctaagtccttagaggaaatgttacttaggtgtttttagaatgtttaaaatttttgagtttttgggtggtagagatgcctttgttttcctgcttaggaaagttgaataaaaggctgtcatagctccattcctgatagttgtcagggaccaataactgaagtctgagtaaaatctttggagacttcttccagatgctagtaattgctttaacttgagtctgtctggcagtacctcaagatctctgttatatctcataactcatacttcaccattcatcttaacatctctgttctctaagcacagattgctttttgctgcctctcatcacctctgcctcaagacagaccagaaatctcttgcatatctcacctctgcactgtacgtttattttacagtcttctcctttatgatatcctggcatgcatatgtttcgtgcattatttctactatggttgattggaattcattctcttcattggcagttctagtttctacctgacttcttccttgagtgacttcttatgattctagaatagtaatttgataacacttgcaagttctgttactgcatttcagtatttgttatgaaattcaaaatatctcaaaacataaaattgggggcaaatgatatctgcagaaactagtaaagaaggtcaaggctttgcttttgaaaatatcattgaaaatgggtgtttgtcatggtgactttcacaaacatggtggactttgtataaaacaataggatgttagaatctacaggttatggggtctcagagattatagactattgtccagtagtcttacagataagaaactggaaccactgaataagttattcctactcttacggctagcaagtagcaggcaatcatacacagatttcctgagcctgaagttagtgcctattgcttcttaccctccctcccttcctccctccctccctccctccctccctttcttccttccttccttgatggagtctcactctgtcacccaggctgcagtgcaatggcatgatcttggctcactgcaacctctgcctcccgtgttcaagcaattctcctgcctcagcctcccgagtagctgggattacaggcatctgccatcatgcacggctaatttttgtatttttgtagagatggtgtttcaccatgttggccagcctggtcttgacctcctgacctcaggtgatccacccacctcggcctcccaaaatgctgggattacaggcatgagccaccgtgcccagcctaacatccttctttttagtgttcttcccactccttcttttttaaattttcttctttcttcccataaatatttgaatgtcttctgtcagctaggcagtgtgtttactacaaacagacatgaaacaaggtcattgctctcaagttttgccattaggcaaagctagatgagtaaagttagggagctagatgagtaaacataccgcacctgcagccaggggatcccaggctactagtgcaaagggagtgtagaaaatcaagcagcatgtcgtggggctccagaaattgcagaatattgaaagtgaccaaagaaagtgaaagaaaaggctacaagccaagcagaatagtatatggtatttgcccttacagtggtttgaagagaaaacgttttggagattgtgcttgttgctttgcttgttggtgacttgcatttttcagttcagccactggggagcatagaaaaactgggaagagaggttcacagaggcccttgtctaggcagaagtggtcagaccagggttgatgtctcttccagaggcatctgaggctgtgtgtgtgtgtgtgtgtgtgtgtgtgtgtgtgcatgtgcactttgggaaaaggttttgactgtgaggaagggtgctcaggaacaggtagatgaattttgactgcagacttaatactatacttaattattggactatcactactgataggttagactattgcatattaatctgtatatttatagtatgtagtttcattagagggagctctccaaactggagaacagaaatattttcaaaccttaggtcattgtgtacttagtctaagtacattttcaaagtgaaaactggaagtgatgtaggactagagttccttgtgggattggaccagcattcctcaagacaaatggtaatttgctaggcacatcctttggttttctcccccccacccccacccatccctatatgtgtgtgtgtgtgtgtgtgtgtgtgtgtgtgtgtgtgtgtataggtattttttttttttaagaggagtctcgttctgtcggctggagcgcagtggtgtgatctcagctcactgcaacctccacctcccaggttcaagtgattcttgttcctcagcctcctgagtagctgggactacaggtgcgtgccaccatgcctggctaatttttgtacgtttagtagagacgtggtttcaccatgttggccaggctggtttcgaactcctgacctcaggtgatccttctgcctcagcatcccaaaggactggcattacaggcgtgagccaccatgcctggcccatccctatatttttaaattaattaatcatagtgaaaagctaggacatgttggacttgatccaggcataaagaagcagcgctttgacttattaggtaagtgatcaggaagagaaggcatgaattaatgcttatgtggacctgcctgaaatatgtaaggagaaaactagaacacatggtcatgtatggcaaatccctgaggtaaacaaggagaaaatgctttctataaaggtaatgttctcggctgggtgctgtggctcacgcctgtaatcccagcactttgggaggccgagatgggcagatcacctgaggtcaggagttcgagaccagcctggccaacatgtcgaaaccccatctctagtaaaaatacaaaattagctgggtgtggtggcacatggctttaatcccagctactcgggaagctgaggtaggagaatcgcttgaaccggggaggcacatgttgcagtgagctgagatcacgccgttgcactccagcctgggcaacaagagtgaaactctgtctcaaaaaaaaaaaaaaaaaaaaaaaggtggtgttctcgtaaatttgttttacctatggtatagtacaaagtgattgttaaaataagttcttattgaatgagagcaataaactaatcaagcaaaaatatctcacatttcaaaatccaaaaatatgtgtagaggtaaagagatgaagggaaagtagttgcgcaggtattttacattgttctgttaagcaaacagttattgggtgactcttaagtgaaactgtgatagtgaaagaaggggactacaaaagagttatgatagcattcttgtctttaaagaagtatatagttaagaaagggaggcagaagtgcacagataatatcaagggatgcagtacgaattgtgagtgcgggcagccattcccaatttccagatagcaacactggggctggactctggaggagctgcttttgaagcccacttctgctttgtaaatttttgttgggcctgggcgaaggcaagtaggccattctgagatgatttctaaagccccttctcactttcaagttatgtgaaactgttttaaaatttctagagtcttgtcgggcacgccagcactttgggaggccaaggcgggtggatcacctgaggtccggagttcgagaccagcctgaccaacatggagaaaccctgtttctactaaaaatacaaaaaattagccgggcgtggtggcgcatacctgtaatcccagctactcaggaggctgaaacaggagaattgcttgagcccgggaggtggaggttgcattaagttgagatttcaccattgcactccagtctagacaacaagagcaaaactctgtctcaaaaaaaaaacatttctggagtcttgtttaaagttgacatctgtgccatgatgaggcagaagattggttaactaatagaaattgcttttggggttttggatactcagctataaggtgcactaaataaccactaatgtgtagtgaaagcaaaagctgtattcagattcataaatcaagtttctatatataattatttggtaaaaagtgattgtgatgtaagttcttcttttttgacttgaagtatcaagtgagtagaaccgaataatctttatcttagttgtcagaaggaaatttgagcacagttgtgagaagtcaagcttattttttttttttaataggttcctaacctggggttaagatgctaggacccaaccctaggcctgttcactctttgaggatgaaacccgggcatctgtaaaaagttgtacaaatgattttaatgttgagaagggctgagaaccactctactatgctgtttaacttgtgtagttggaatttgaaaacatttgtggtgtttagtaaaattatagcttggttaaattcctattatcaatgataaaaaccacaattacttttgcaccaacataacatggtgtgcatttatctgaccagtagcagctttcagtactggactgcttgggtttgatcctggctcagtcacttgttagctgggttagttatttctagccgtataacaatttgccccccacttggcagctaaatcagtaagcgtttaataactctgtgggccacgaatttgggagtggcttaagtgagagtaaggttaaagttcagatgttgcccagggctgctgtcctctgaaggcttgactggggctggaagatctgcttccaagatggctcactcactggcagagggcaggagggcctcccttgccacgtgggcctctccacagtgctgtttaagtgtcttcaagacatggcaactggcttcccccagggtaagtgatgtagaaatcaagaaagaaaccacattgctttttatgacctagtctcagaactctaacacagttactttagttatattccattaattagtgtccctacatgcacagtgattggaattagctcttgaagggagaagtttccatgtatggacatgttttaaaaccaccacatgagttgtctgtgcagtttcactacacttttttttgtttaatctcagtctcatccataaaagggagatttaattatactatccactttatgttgttattgaaggatctgatgactttaatacatgaaaagtactcaaaacaattcctggcatataataagtgctcagcaaatgctaccttttattacttaaagatatgtttagtagtattcaaggtagtaattcctatattgacagaataagggaaaatcaaggatgcattttcagccaccttatgggcaagagctgggggcaaatataatacttgcttgtatttataattaccctggcaccaaatgcctttatctatggcctgatcagcttgctttttacttaaccaaattctggccaaaagatctgagctcataaatatctgaaagctgatacacattagagtttaaaaaggaagaagattaagcatcattacacagtgggtcttactggggtttagtggctgatacacatggagagacatacaaaaaataaagtagtattaagagatgctggaaactaattttaaataagttttaaataagatacattaaaaggtgtattttaataattcattctcaaagttgtttaatgtccttacccatattaccccaaaacatggcttaatcatgtggcatttcttagcagttcattctatggatttgctattaaattatttgcctctaggtacatatttcaaagttagatatgtgtctttgaatatatttagaaatgttcagacttgtgcaattttcttttaaatttgtgttctctcaaagttattttcttttttgcttttgggggacatggaagaaccaaaatatcctttatatgcttttattttttgagtgggtataaggagatagaaatcctattatttgttaatttaaaaaataaaaggattttgacatatgcagtgcatactctatggttggaccacaaaatgattctgtgaaactattagattcttcaaggactcactttgcttagaggacaagaatggcaggtggaaggagtgctctttgccttgcctagagtgtagtgtctttgatggggagtagctgtttaatgagaggctttaggacacatccagtcagattcacacgcgcctctggaactctttgttttcaggctgcagttccttggctgtgtcagcatctttattgtctgagctcagaaaccccttagtgcaccaaaccaggaagggaaactggcagcatgcaaatgactgacaaagggattgtaatatattagaggtctctgatagtcattaaaaattttgaatggaaaaaaatatgccagcagttaataatatcaaataaattaaaactacaaagtcattcctgtagctgtaaaattagtttcttgagatagacgtttttgctacttgtggtttttgatttatttatttatttattgggatggagtctctcactctgtcacccaggctggagtgcagtggtgcaatcatggctcactgcaacctctgcctccccgattaaagcaattctccttcctcagcctcctgagtagctgggactacaggcatgtgccaccatgcctggctaattttttttgtctttttaatagagacagggtttcaccatgttggccaggctctccaactcctgacctcaagtgatccgcccacttcggcctcccagagtgctgggattacaggcgtgagccactgcgcctgggctgatttatttttaaatattggggtacataagtattctttataaatttgctgcagtgacccacaataatagtggctttaaatgatcatttgtatttccacttatgtagcagtcgagaggtggggagtgcaggatgataatgcagctcagcttcatgaggtcagccagggctggtatgatgctcagggtcaggcgctgtatgggttttaaaacatgtgtgcaacttctttgctgcttttcccattgtgcactctggttgaatctggttgggcacctggctctcttgtaaccagtagaataccacatgactttcatggttatgtcaggaaaggtgatgcagcctctgccttgctgctgggtccgttgcttttagaaccttgaattaccacaaagtagtttgactaccttgaagctgccattcagtgagaaagtcaggccacatgtagatgacacctgtggctgttctcgctgactgcttcaaatgaggttccagccaatagttaacatcagccaccagccatgtgagtgaggatgcctccagatgattccagtccccagtggtcaagccacccagctgttgagtgttactagctgaggcccagacatcatggaacagcagcaacctgccccccttgtacctggtttgaatttctgacctacagaattcttgaacataaaaaaatggttggttttcatagttgaattccagtgtagtttgtcacatagtaactggaacagggacccaggttccttttgtcacattgctttgccatctaggttgttactcttacatgtttttttagatgtttcaccaccacatctgcattccagccatctggattgaagaagtacaaaaaaaggcactgtattccccttcaagggccctcctcagaagtagcacagtcacttctgttctcatctcaatggccacagctgaactggaacatagccacatctagctcaaggaaggctgggaaatgtgtatttattccttgtgtatttgcacctagctaataattagagaatttgtttctttgagaaagaaggatacaaggatatggggaaaagtttctgctacagttgtacgcgcttgattataccaagttctttactttgtgctgtattaatggtagttgtttctttcctgggaaattttccatttcaaagagctcttagtagtaggtttgttggaaagcattgtatttgtgggtaggattaggttggctaatattggttctattttgcacatgaaaatgaaacaatagtaactttaagagaaggaagtttacttttctcttacttgagagaagtccagcaggaggcagtccaggactggcatggttatagccaccatccacagaggctccttacttcttgttcctgcagacttaggctgctgctttgtggtcctagatggctgcttgagccatattcatcgggtctgtgtccccagccagtagaaaggaggagggaaggaagaaggggcaaggggctcatgccagatgtcttacaaagaaaatttctagaagctgccatataacacattagcttttatttcatttactggaactttgttattgaaagtaaggctggggaggtgtagttttattccaggctaccatgtgtccccatcagaatcagggtttcttttactaggaaatgtagcacagctcacagctgtgagtccacagctcacatcatattccttatactgtcaatttgaaaagagctatgtggtttgccagaacttgggccacactgtatattgcaccataaacagaatggttagaaactgtgcatttcagaatgttgtgatttacgtttgtgttcacataaaacttcagccattctttccccattattataaacacttgggtttgtagggacatctgatgtttactggcagatgacatgccatgtacagactgtcagtgttttagcctcaactctcaaagcctttcctgaaaaaaataaatcccatttctagtgtatacataatagggccatctgtcactgtttctcagttgtttaaagttgcattgtttgaagtcctgcttttctaaaagtgtatttttttttcttcctggaaccatctctgttcctttgctttaaaatgaaaatagtctgaatgagtattttagccctttctggaatgagactgagcttgctgcaaggcattgattcatccagtatcacatacagttgctgagagcttttgtcttattaatacttctcttgaaaaaagaccatgactctttgttgttctctgtataaaaccaacttttctgccctgtgtactaggcttgaaagatttaattcatgattgaacttggaaatgcagagaaaatattgtcttttatggctgatctagtcatctttatgagtttcaccttctgattagtgagaaaatgtactaaaattgaatctgttttaaagcatagtctgatgtggcaaatcgaacagtctcctctgatctttgttctgtcttagataaaaatgcttggttgttgaaggcagcttcctctccctctctttttctctgcgtgtcttgagggagagatgtggcttttgcaaccttgcatttctggggaaaacactgtgctcattcctgccagcgtctttatcctggcttttaggacccctgcttcctgggtgatttgtaccccttttctgtcttggatgcctggcaccttgtgggccactgattcttaagtcagctaccagtgaactctggcccattcttgtgactcaggccgtgtcccacattgatgtgacttccccttggctttccactagtgctccacacccatctgcagtctttctgggatgcttgattgttcctggcccatgtgatcttctctgtatcccttgctagagagccccctctccctgctaggatgacccctctgggaggtgtcccagccagacacacagacacttctgtgtctggtctgtaccaagcagaaccaagggtagcctcctttacacggtaccagatagggagtgggtcaagagccccctgtgccttccacatcactccttattcactgaatgcacctcctcctctcagggccaaagcctgaacaggaaaaattagtcttgactcccctcttgactccgtcgtctttctcctacatatactatatcatatcctccttttagctagccctatggctctgctgtcatcgctggaagtggcgtgtcttttctaccctggagaagagctagatcaggcccctgattaaaaggaggcagggaagggagacagaaataaaagcaatttggaaacatctttccaggcaatagtatggctagcaaggctatgtgtcttgctgaataatcctattttataaaccagaaatggttattcctgtctttttatagaatttctataatctcttttttaggctgataaacacttcatgccaaaaggcaaaagagaaaatgggaataaatttcaaaatattattttataatacttgccttaaagtctaccaaaatttttgtcttcttaaactttacatcatcaaagtcagtctctgagctagtagtgtttagcaagaataggggatttggtaatctgaagacctgtgatcaagccttgattacgagatcagtgataaggataagctgctctcattgagtagtacctcagtttcttcatctttaaatgtaagtatctgccttacttacagagtatatgtgaatgtaaagtggggtaattacatgaaagtattctgccaatgcagtgtgattttattaatactagtttccttgtctcacattatgctcatttccatttgtgtatttctgctactgctacctacaattgtcttcttaaattttacataatcaaagtcagtctctgagcttctagctacccacaactgtgcaactcctgtacaactcctcctgcgtgcccacaggtctgttacaagtactcagggttacactggtaactcttctctcagtccctattctgcatgtagtcaaccggtttcctatttagtgtctaatgtcttgttttttttttttttattttcttcattagatttgaaatgacttgatggcaaggaatatatactttatatatgttttatacatttcatacattttctggtattttttatagtcctggaatgtacttcggagctgaaaaaaatagacattacttggtattactataagctagtgaaatagaagggataatccaattatattttctttataatcctgttgtttatctcattcctttctgattctgaagagtacctaacttctgaataacttatactaactgaaattattcaggacttatgaactaaagaacatatgtttaatttaaatactttatccatatctagttttgactgttagaaaatatttttaggttttacaaatttatcttggaaccatgaagtcatttattttaccacactaaaatattcatgggtcaaagatttaattttttaattttttttaagagttgatttgtttgaatccagctctaatatatgtaacatttttattttagtggctgtgtttacatagctcttggatcttttcaggggctatatcttcagtttctgtaattcagcagattttgtctatattttgctaataaatatttatgaggttgccatgtgggagaaactagtgataatgagaatggtctgtatttagaagcaattgagcacatttactctcaaggacctgtgatagatgacatgctaaagtagattaaatgaagtctggatctctcaattaagaacatagaacttagaaagaatcagtcacacagaccccatcgcagaaataaaatttcatagaaaaattgtataaattcagacagaaatctgcctttattatgaatgttacttattttgtttacactttttaaaaggttagcatctacaaataagttacgtatttcttttgttgaattaattgatttccttttagaagttgtactttataaataagttactttactcttaccagagatcacttggaatggcatctatcactatatattcttcagtttctttcttattcctattgctaaaagaaaccgaaagtcatttcttttgtaattgaaaatttcattatcagtggtatgaagtgaatttccaaaatggctcatgtaaacaaaaagctccattttaagaagcattactgtgttctttgttctaggctgcattttggaaccatggacatttcactggctatgctgttatgctgttactctaactggacaatcagttgtgttttaagggtagacataactatgaacaagtgtctagttaatgaatatgcctccatgatacatgtcctgttgccacttccaaacctcattttgttaacttgtgcttactcatttcatttttttcctaaacattttctccagagaactttggttaacttaatttaaaacaataggtttcttggagtcccatttgataattctgtggttactaaagtagatagagattagcagaagccagaaggatgcctctgatgttgccattactagattgcaggaaatatttgagatcaatgcatttaagtctatcaaatagcactaagaagaactacagttttatgttaagcattctcttaggtgcataacattcattatttctttttagcttctatgcaagtgtttgaaatgggtgctatttatccctattttacagatgatgcaaataaatcttagggagtctttaataagactgttgctttagccaatagagttagtagcagagtggggatttgaggtctggtatttctgcctttgaagttggtgctctctaaactgagaggaaaatgcttatatgcagccatttgaatgttctgttcactgttttctgttgccttcctgatagactcccagctttttagcatggcatatctttgtaggtgttttattctagtgtagccattcatgactcttctgtatgcattgcataccatatccactctcacagttatgccttcttctaccttatactcgccatatcactgcctcctacgtaaaaccacacaaatacaaatcaaagagatgaaacagatagataaactcagtcttgtggtggctcacacctgtaatcccagcactttgggaggccgaggcgggtggaccacctgaggtcaggagttcgagaccagcctgaccaacatggagaaaccccgtctctactaaaaatacaaaattagccaggtgtggtggtgcatgtctgtaatcccagctactcaggaggctgaggcaggagaattgcttgaacccgggaggcagaggttgcggtgagctgagatcgtgccattgcccttcagcctgggcaacaagagcaaaactccgtctcaaaaaaaacaaaaaaaacaaaaaaactcaatcttgtttatagtaatacaaactgctattgtattggaaagtgtccaaacagccttagtaggtgattgaataaacaaactggtaagtccatacagtcaaatgcctctccataatcacaaggaacaaatcactggtacatgtaatagtgtggatgagtcccaaatgtattatgctgagtgaaagaagctagattcaaatgactgcatgcatatatttatgtgaaacatagaacaaccagagctaatcaatctacagtgtcagaaatcaggttgcctgtgggagtgggggtgggtattaatggcaaagaggcacaagataactttgttgggggatgaaaatgttctttatcttgttttgggtgcgggttacaggatgcaaacaattctcaaaactttttgaacagaacacttaaaatttacttattttatgttagttgtaccttgatttaaaaaaaaaaagcataaaatcaagccaagctctttttgcatagttctgtcatagcacttaccatgcagttttgcaaattctggcttcctagtctgtctcccattggactaagacaggatgactcatgatgcctttttgtattgccagtgcttagcacttgcctggtgcttagtgggttttcaagagatgcttgttgactgaatggaatgctaccttgttaaaaagcctggcccattaaaaaaaaaaaagaatagtttggaaatactggagacccacttgtgtgcttgatacaagctttagaagcatggaaatctaagcttcataagagttgtgattcaagccattattaacttatagagatttgtatgcaaaaagtgtagactgagtttctacatttttagtaatttgctttgagcttttctagtcaggtgtcaggtgatgcctgaagtttaaaattctataatatccctattctaccctcctctcttctcttttattttggaatgattttggcctggagcagatccctgagtcatacctgtggctttaggagtcttgaaattacttcattatggaaaaaaattttagtttctaagtttaatttcgtagttatacagaagctgctaaatgctcacttggtctgtaggtaatgggccacatggtggttctctattctctgagggaacccagtggcttattatctcttgggaaaaattccatagcattttaaatggctgcctgaacctgggattgcagctttaaccctgtatgttcaagctgacaccagcagtagtgtcacacattttaaaaagtattgtacaaattgagagattctcaaaaccaaaatatcacaagaatgcctgctgtaaaaaaataattgttaaaaaatagatattctttgaagaaaaattggaagaaaaaagatgaaaataaaaattactgattatcttaccacctacatttaattactaatgttatattggcatatccccttataatcttttttcttaggcacttccaagcattttttccctattggtgacgtctatttaatcaatgcgtaatctttttttgtggctctatgataactgacttgataatttttctattcttggatgtttaggatgtttttctactagtagctaataataatagctaaaaaatattgactattaacaggcatgacttgcatttaatgttaaaataaatattttcttgttttgatcttcatctgaagtttggatttttttttagattccagaacctgaagcattgggggttaagagcatggattctggggccttgaacaaattacttaacttctgaatgcctctttttaaaatctgtaacagaggaacaataaccatctgctgttgtgaaaaatgtaaatgcttgggacagggcctggcatatagtcagtgctatataaatatgagacattggcttatagaacacaaaacattatgaacacttttaaagcttttgctcagtattgccaaattctggaaaggttataccagtggagtctcccatcagtgctatctcagggtgattgtttttaccacacagaattagctattaggaaaacttcctcagtatgtgtctgttgctattggcacatcattcattctttcttctttactagccctgatttttgttagataatttatctacttcttaataaaagtgtggaaacaaagaaaaatgcatttcctcttcttttcttttgcatattttcttttttttgtcttagggactagaaggtgactatgttactttctcatgaagatagataggagggactgtggaatttgaaagtttgagaccactcttctcatagtaggcaataaagaagcgtatattatttttaaaatgtctgtaaggagatctcagaaaggtgtccagttcttcaaagtttgcctttggttttcaggacaagcaagtggacaaggcaagagttcactataaagttaaggtatggtgcttgctttggcagcacatatactaaaattggaacgatacagaaagttgaggtatggagatgatcaacccaaggtgatattctctagtgggtaaactcttctcctctgactccagtcagagctactttatctctgtctgttttacatgttgtgttttgggtattgactgggagaatgagtccttagctaaaacaggtttgaagatctttttaccaagaggaattaagcctcagagagaagtctgcgggcaccccacacacttaacatttaatgtgtgcctttccttttgctcatctgtactcctgggtgtggctgcagggagaggggtgcagcgatggtggtggtagcggcagagcccttctgggatggtgttgggttagtgtggttgtgttgagtgtggttcctaaagcccactggggcatgcatggtgatcctgtaactaaagcagttgtccataccagctgtaaactacagttaaataagcaactttaagtgggaggccatgtgattatgaacaaacccagaatgaaaattttttccagtggttcagagcagttgtctttggtgttctccacccatttattcctgctgatgactcactctgtgactggccctgttctattataggaatgaaaagcattacacatgtgaatcatacctgtaatttccattgccttaaaaaatgtggcctcacaacctgaaaaaatactcttaaactccctggtcaaattaaagagaccacagtgatatgaaagtagttactaagaattctagatcactttttttcatgaaaaatggaacttcttatatgaatattaggccgtgtattaaggtatatctgattttattccttaggccgtattcatggtaccagtccatacttatcaagaaaaactgattatgttcagggtaaacggaattagagcattccactgtgtagtaacctacagtatcagagaaaggcaagagctcccaagctcttattttttatttttttgagacacagtcatactctgtcacccaggctggagtgcagtggcccaatctcgtctcactgcaacctctgcctcccgggttaaagcgattctcctgcctcagcctcctgagtacctgggactgcaggtgcacaccaccacgcctggccaattttttgtatttttagtagagacgaggtttcaccatgttggccagccttaaactcctgacctgaggtgatctgcccgcccaaaatgctgggattacaggcctgagccactgcgcccggcccaagctcttatttttgaccttgtattgatttataccatcaccttgagaagaatgaaaatttctctgtacctttttctaatttacaatataggggacttttatgcagtttatttagtgaacggcttgatcctaaacagccaaggacattttattttggtttttctttttctggaattgatatagtaagaaatcacatctgtttatcttatgtcctgtcctagttccttgatgttggagactgtatgggtttgattcacccttacctcttaattttgtacagtggaaaaggtattagaatatccgggccaaattccagctctgctgtttccttgcttacagaaatcttgggctaggttatgttctttgaaatttatttttaaaaaatcaataagaagaggatgatgatccataaagacagtagtaagattgttgtgagatgatgtgaaattctgtagtgtatagtgttgtgattttgacgtttattgcatgttctggataagaatttgctgatttaattgaagtgtctaggaagccagtgtatttcttgagagcctactacataatcttaattatactctattatcgtatttagtgcttataagaatactgtgtgaataggtgtctagtaatacctatgattctgttttatagatgagaaaacttgagttgcacagaagttaaatcattttcccaagctgaaattgctagccagttttgatgctaatatttgaacctaggtttatgtagattccttgcctcctactgattcctaaatcttgttttttgtccttaccatagctgcctaccaaagcctaccaaatacaatctagtgaagccatatacagggtatacaaccatatacaaccataaccatatatgaaaccatatataggaatatatattcttttatattttgaagtctaaaggcacctacttatttaatgaacttatgttggtatatgttgtccaggtaggctattggctgggacagaaaatagcataaaggtaagaagaaataggattctttcagaaaccaacaagtcataaaatttcaaagaaacttgaaaaactgtatttattccttataatttgttgattttatttttatctgagttactggaggtcctgctttaataaattttgaaggtatcttgtatgaatttgatttttaaagtgaaaactgttctgtttatgtccttacatatatgtagtgattataaaagttttcaaaactgaatactttaaaacaccaaattacttaaggtcttcataatataatggatttaccttacatataaataatgtagaaatgatgcttattgaatttattttcatcgagttacatatctctgtgctttggggtatattcttatctagagctctgaatctagaaagaaaggctgatagtgaaaaccttttaaaaaagtctaatttcttaaggttagcatgttacagattaagagttgcagaagctttctgtccttaaacagtgactcagatcagcagaagttagattatatataatacttaaatgttatagcagtataactataattaggaatctctttatatgtttttaggatgctcaggtaggagaaggtagattctaggagttttatattcaattcttagccaattgtgagaacagataccagtaaattccttgtcagagcagaacctgatcccctagatcccagccaacaataagattgaacctcagctgctcagcaactgcacttacaggaaggcaggagatctgatgactgggagagcagatagtggtagaggaggagatacacaaaaaagcatttgtatggagagatttatggcatttgtagtttacatctcagcttacctagcacattctaccattctactcttgtcctgtgtctggattcatgacaaatgctgacaaaaccatttgttttgttctgtggcaattaaactttgaacaaggagactcttcacgcagtataatttctgactatattctcagtaactgattctcctttcagagacctcctgtgccttcactgttttgtatctcagactgggcagccattctctgaaaaaggtatcaccagttgcaccttcacctctgctcgccaactctcacccctcccctgtcttctcccctttgccttccctcctgcagccatcagcctaagagcaagtccagtcacgcctggagtgcttaactctgccttcagaccagaatggggtactctggcatgtgtctcagtatttttttctatatcttccatagagtccaccggaatatgtaatacataaatgaataaaatacctgaaacacatttttccctcacagttattattaatagtaataaacaaatacaccctctttgtaaaataatcaggcactcaatctggaaatatgtagaatgagataggaaagacaccatctaccaacctctctccttatagcttccactctcttctactgatgaaactgctcttcctcatgatatacaccttttatatatattattttccattttttttcactgatcttgtaaacctcttttgtgttactatgtgcagattttcctttattaaaattttataggataggtgaaaggtgaactataattcattcatttagtctcctggtgactgatatttaaattgtttcaaatattttgctatggtaaacatcttagtatgctaatcatatataagcaagtatttgtttcttacaggtagagttattggttcagaaagtatatggattttaagttacagtggacactactaaattgctctcaaaagagtctttgtggccgagtgaggtggctcatacctctaattccagcactttgggaagccaaggctaaaagattgcttgaggccaggagttggagaccggtctggacaaaaaaagggagatcctatctctacaaaaaattttaaaaattagctgggggtggtggggtgtgcctatatagacccagctactcaggaggctgagttgagtggattgcttgagcccaggaggttgagtttgcagtgagctatgatcatgccactgtactctagcctgaatgatggagtgaaaccctgtctgttaaaaaaaataaaaaataaaaaagtctctgccattttacacacccacattacggtagcttgggactacctatttctctgcattcagcattatcattcttacaaatttgtgccaatatgaaataattttatctgcatttcctgattagaaagatgctttagtattaccccatatttttgttggccatttgcatttcttctatgaattgtatgctcacatcatttgtaatttaggaagagctgtccttcttactaattaataggagttattactctatttggatattattgatgtatattttacatatatagcagatgttttcttctagtgagtttttaaactttgtctacagtgtctgctgttatatcagtggtttgtcaaatttgatagttttgtttagttttttttggttcatgacttgttttgaaatattcttcccacccaactattttaaaaccattattttctatatttttaaatggttccatttgttttaagaattgtcttatttctaatattgtataatttcttcgtgtactaccaggtagtataaatccaaagattttactgtagctgtgtgttggacttgttatttccacacttctcttgaaatgtgcaagaagaaagcttttcttaacaccttacaatatttctttgtacatgcagcaacatgagagtcttttgttgccacaacagaggcagacaatatttattactgtgagaccaactgtaggctttatgtatgtgggactttgcagtagtgactaagctaagaaattacgtggaaataacagcatttgtatactttcacctatggagtcctaaagtattttggaaactttttcttaatgatgaataattttatctgataactttcctggtaaggaccttccttttaacaaaagtagggtggaggggcgagtggctggggagtggactgtggctaaggctcagagttattaagtagcttcctctaagtctgtccttccacagagataagtcacagatgagtggatgaaagttggattgactagaacatgaacatcagttgtacgtctatactaatagaaataaaccataatgatgttcctgtgggaatgaacatttgaaaagatttttcaattaaaatgagagtggggactttttcctattacccatttcaactacgtggcagctacaacctccagtcaccaagtaatgttggctgagatttctgtggttgaaggtcaaatcaggtaggcaagtgaggtgttactagagtgaggcagtgctgtcagctgatgattgggtgtgagctgatagctcacaggtggtttgagatgggattctgcagggtggtgatgtgcagcctctttgatttgttttcacccagctccctgttcaccaaccatccattgtccatctttttcaggaactgatcttttcaacgatcccaactattccttccttctttcgtctataataccaacaatcttacagctgtttacttgcaatatttttactgtgttgtaccacagagctatttccaggcagtaatggggaaactgactagcgtcctttcttctccctccatattatttctacacaactctaacacttaatgtttaccttttttttttttgagatacagcctttttcaaagtttttctccatcttttaaaattcacatctgatccttaaactcagaaatctcatccctgccttaaattctgatgtaacttcttagtgaagcattgcagctcccctccctccactctttagagtcattaagctcagaaggtaaattccatcttctgtggattcccaccattaacaatcgggccaagctttacttttttttttttttttttgagacagagtttcactcttgtcgcccaggctggagtgcagtgctgtgatctcggctcgctgcaaactccgccttctgggctcaagcaattctcttgcctcagtctcctgagtagctgggattacaggtgcctgtcaccatgccctgctaattttttgtatttttagtagagatggggtttcaccatgcaggtggtctcgaactcctgacctcaggtgatccacctgcctcagcctcccaaagtactgggattacaggcgtgagccatcatgcacagcccaagctttactttttatttttaactcattttttaaaagttagaattttatttcctaagtatgaaattataaagttgagtaggcttttacaaactgcactctctgctcttggtagctttgtgatcctgggcaagttgtttaacctctaagtgcctcagtttcttcatctgtaaatgaaagttatctcactgattgttatgagtataatgtgcagtgtgtgtgtgtgttatatatgtgtgtgtgtaattgagaacaacatctggcaaataataagtgctctctaagtgtttgctattattattatcctggtttcagtgaaatagacaggcttaggctttcgtgtagcggaggcaagggctctaaagataattggaaaaggagagataggaagagaagggctatttactaagcagatactttgaacttctcagcaggatctggtacaatttattcatttacagtatatttagaatagggttagaaaatcatataaagatgttttaaagcattttggcaactgttaatccagcagtattgtggtgtgattgaatggtggttttctattgctgaagtaagtagtgatcatttttgtttgtttgttttttggaattaactatgtatacagtttctattcaggaaggtctattggtctaacgtttcagacaagcataagaatgccaaagatagtttgtcttttgcttgtttagaacaagggttcttatgtcttgacttttcattattcatttattcatacttagaagtgaagtgctcctaaatttgaggcaccttgcttttcctgcattattagattaggggttctattgtttgatgacataaacgtttagaatcagacttcttaagatcccactttggctgtggaattttaggctagattgttaatctctacaactttaattttcacagctttaaactgaggacagtactacccaactcagaattattgtgaaatccaaatgaaaatgtatccataaggcatacataaagaaatacccaaaagtggttttctcccagaaggatgtatgtctagcctataaaggtgatccttccaaatcatgttactagcacacatatcagggataagttaaacaagttaggctggattttttttatttttattgcagggaaattctgcctggggtgttagaagagagaatgtgatgagttagttcagctgtgaaatctaacatcctattggttcgcctcattgcaaaacaaaaaaagggaattaaaactttttttaaaggacttcttaagaacaactttaaaatgaaaagaagaaatagacaatttggtttctttttagtaacagttgtatatatcccctacaaaaatagtagaggagtctggctttgttaatatttgtttaaaaggaggtgttgactagttttcagcttgcaagtaggagtgtctagtcagtgttttcttttctacatagaaagttaacaggactctgacacatcagagtttgtacggagagagtttagggaactgctgcacagatttcctgcagaatgatggggcagctcatgaaaaatgatcaagattggaacgcaaagctggtgggactgatgtgctgtatgggttagtagtatcacatatactatcactttcatgttttcagaactgggaagggaaagttgcactacctgctttggtttgcatggcgatagttcagctgattgtcgggcatctttcgaaaacctgtactgaaatcaggacaacttctgaggctccctggagagaactcccctgcctattgttgtccacagaatatgtatttatataatctcaatacttactgcgtgtgtggtactgagtgagtttagctttgtttggatttcactgaaaaccagtcaatatagattgtaataatcagtactctttttgcatttatttgttcccccccaattctgttattctttgtcttcattgtcgttacatattttcagctgttacactttataagggggatataaatatatatttttattgaaaacttaatctataaatgaaataattttcaaatagaggaatgttataaaagttcaattgtttaaaatcacaggaatgagtttccctttttgttgctgtagcaacattgctctaaatataaatctcagtgttagacatctctaactgaaatgaaataaagaaccattatgagacttgtaattggaaaattagatggtgtaatctggaatactcccttttgaaataactcccttttgaaataatgtgtatggaaagtggtgtgatttacaaagtcttcccagacttaaattattctctgactctaggttgctctcttgaagaaagttgaagcctttagaattcacattaactcttttctcattcctgtagcattgtggaagccttctcatgttaaagagcatattttggtatttgaatgggactcatttaagttgatcatggtttaaaagaagaggtttaggttgttcctgttagaaaacagtatcagaatttatgaattatgtgtgttatttagtctttgtatcttatgtactttagttacggatcataattcctagatattacctcagtagtacctacgaaatatcatgttattagcagtgcttttgagcatctagcacaacaacaacaacaaaacctcattgatcaaaagaacctttgtatagtaagtacctctgtacttagaggtaaattatttgattaaatcagctttcttaatatactgctttggtaagtaattagccaatttatctatagaatctgttttacctcatgttccttgaactataggaccagtttttattcacttagaaaagaagaaatctattttgttaacccttttttacccaagaagaaaatagtttatataatacacataatagattaaatttattttgtgacttatatggaaactctattcttgaattataaagatttttaatatattattaatttttttttcttgaggatttagcatcaggggccttggttgttatttaatgggaataatatggatattacctaggaagtaatttttttcatttactctgttttctttttgctggatgcttagaacatcactgctgaaaatgtgatatgagtgctagactttggcacagaacttccattgtttgcaatcagttgtccaaagttcacatcacatcacagagccagattccccagctccctgtctgtgactgagatgtggtcagcacttccatttgaaaaatgacagtatcttggggatagtggaagcaaccttgtagggaaacataagagttgggtcctaaccaaggctctttcaatgttaaatgattaagtcagagattctttttagtggagaaattgacacatggctggcttctgttttgctaccctacttcctgtcctttaagccccacctgactgccctggatgaggttggtccttctctcttttgtgcttgcatacatggtgagtgccatgtacttctctcaactggtgtgcttaccacactgcctttctgtcaggtgtcctctccaggtcatgagcttcagaaaccaagactagtgctttctctgcagcctggtggtctcagtgttacaggacaggggtccagattcaaaccccaagagagggttcttggatctcttgccagagagaattcagggtgagtccacagaataaagtgaaagcaagtttattaagaaagtaggccaggtgcggtggctcacgcctggcctacactttgtaatcccaacactttgggaggccgaggcgggaggatcacctgaggtcaggagtttggaaccaacctggctaacatggcgaaaccctgtctaaaatacaaacattagccaggtgtgttggcgcatgcctgtgatcccagctactcaggaggctgagacaagagaatcccttgaacctgggaggcggaggttgtagcgagctgagaataaagaatggctactccatagacatagcagccctgagggctgctggttgctcatttttgtggttatttcttgatgatatgctaaacaaggggtggattattcatgcctcctccttgtagaccatatagggtagcttcctgacattgccatgggatttgtaaactgtcatggcgctggtgggaatgtcatagtgaggacgaccagaggtcactctcgttgccattttggttttggtgggttttagtcagcatctttactgcaatctgttttattagcaaggtctttatgacctgtatcttgtgctgacctcctatctcaacctgtgacttagaatgccttaaccatctgggaatgcagcccagtaggtctcagcttccttttacctagctcctattcaagatggagttgctctagttcacacccctctgacaccagcaccaccatagcactggactcattaaatgaccagatagatgctaggatgaagagtgagtaaatgagggaagtacagaatctgcacttatcagtgaagagaactagtaaattgtttctgtttccttgttcttgctttaccaacaaattggtaatttaggttcattttgaactgtctaggaatagcaaggccgaaagacatttaggacaccattattgctttaagagatatagttgtatatactactgtatatatgtatacaagtaattctacattgttttcctcagttggattgtccttcctgaaataaaattatttcacacaatgggcatctatctgttgagcgcatagaggcattgcagcatagaggctttgtggcatctagtatgtggtagacaaagatgaatgaggtatagatgatgcccctaaggggccaatagaggaattaataaatattttgtggataatattattggttcataattattaatatcattgcttttgatagcagttttaagcaaagtgcctgggggttttacacttggaatgaggcaaataaaataattttagggtcagacacagtggttcacgcctataatcccagcactctgggaggctgaagcaggtggatggcgtgagcttaggtgttcaagaccagcctgggcaacatgacgaaaccccatctctgcaaaaaatgcaaaaattcaccaagcgtggtgacatgcacctgtagtcccaactccttgggaggctgaggtgagaggatcatttgagtccagggacgtggaggttgcagtaagccaagattgtgccactgtagtccagcctgggcaacagagcgagactgtctcaaacaaaacaaagataaaaccaggccagactcggtgtctcacgcctgtaatcccagcactttgggaggctgaggcgggccgatcacgaggtcaggagattgagaccatcctggctaacacggtgaaaccccatctgtactaaaaatacaaaaaattagccaagcgtggtggcacatgcctgtagtcccagctactcgggaggctgaggcaggagaatcgcttgcacctgggaggcggaggttgtagtgagctgagatcatgccgttgcactccagcctggacagcagagcaagattttgtctcaaaaaaaaattttagtataaattctgagcatttatattcagaattagcaaactacttctactgtctgggaatgctttctgcacccctttatctaatttttaaataagaagtagattagaagttgggggcactgaaaaggtattataggcagaatcaaaagatgggctgtatataagtaccttttttttctccctgacagtgataggaaatggaaggtgtttcaatgaggtactttggagaagaaatgcttatgaaataaaaagtacgttatatgttcctcccccccattcttattggcattaaagtaggagaactctaaatgataatactatcactgagtagtcttacaacaagttgaatttgaacagaccattgtatcactttactaaaatttccttatttccttttctcgaacatttgtgttttttcagaatttttattttcctattgtaagcactctgatttatattctcatagttacattttgtacataatatgattataacttcagaatagattttagaagtagatttgctgggaaaggtcgtaggtatttttagggctttttatgtatattaacaaattgttgtacagcagtgttgtccagtagagctttgttttagagcagtgctgtctgacagaaacttctgtgatgatgggattattctatatcaaattattctaaagtagcgctgtccagtagagctttgttctagagcagtgctgtctgataggaatttccgtgatgattagaatgttctatttctctgcttttcaatatgttagccattagctacatgtgactgtcaagcacttaaattgtgactagtgcaacaaagaaactgaattgttaattgtattttgctttaattaactttggtttaaacttaaataggtgtatgtgactagtggctacagtactgaacaacgcaggtctagaaagtttaaattaaattacattttcatcagcaatatgtgtgtctgtttcttgtgtccttttcaacatgaaattttttaaaaaataaaatcttggcaatttggtaagttagaaagctttatctgtgttactttatattattattttttgttagtgagattgagtacctgtgtgcattacatttttattgttattttattattttttggagacaaggtcttgctgtgtcacccaggctggagtacagtggcgccatcatggctcactgcagccttgagctcctgggctcaaatgacttgcccacctcagcctcccaagtagctgagactacaggtgcatgccaccatgtctggctaatttttgtatttttttgtaaacacggatttcatcatgttgccccggatttcatcatgttgcccaggctagtctccaaatcctgggctcaaacaatttgcctgcattggcctcccgaagggctgggattacaggcataagccaccacacctgacccttgggcattactttttaaaaaattgattaactgtctgtttttgcctgcttatgtattaaaatgttaatctttttcttcttgctgttttttcataatagtaacatttgtctcatattgcgtatattttccctagttgatatacttttgtttacattcaagttattctagagaacataaatacttttaataaataggacaaacattttcaaagaaactttagttatattacagtagtttaaagggggttaggaatgaagaatgaggagaaaaagagatgaagaaagagaccgagacatatcttacccccagggaaaggatggagaacatctgaattgtggtagaagaggaaagaagaccaccaaggaaggagaaagaggtagccctggaggcagaaaggagagaagaaggaaataagaaagtaaggaattgctgtctagaagtagggaggaagaagatagtgtaatacagttttgaatgctagctttaggtgttggatgattatcattctcctttgaaataataacttgatgaaccacagcattccaattgctctttctccttaaatcagaagaaaacttttctcactcttctttgtgctgtctataggaaccagggcaggatcactgtccacagtaaagatctagttggggcatttctttgttgtacagttcaacacaggaatctaggaaagaaatagcataggccaggcatggtggctcacgtctgtaatcccagcactttggaaagccaaggtgggtggatcacttgaagtcaggggttcgagaccagcctggccaacatggtgaaacccttactaaaaatacaaaacaaacaaacaagcaaacaaaaaaaacaaacaaaaaaattagctgggtatggtggcgcatacctgtagtcccagctactctgggggctgacgcaggagaattgcttgagcccaggaggcagaggcggaggttgcagtgagtggagatcatgccactgcactccagcctgggtgacagagtgagattccatatcaaataataataataataaattactacttaatattaattaagcagaataattaatgttcagccagagtctacttcaagccaaaaagtctcaatttaggccttgccttttgtcaagactttaaactatttgctgggtaatcatgaacaagtcttttatcctcgttaagtcttggtttcttattctacaaaatgggagtaacccttcctcttatggctgtgaagagcaaatgggatgtacatatggtaaagggctttgggaaattcagtgcaaggacaaggcttacgttagacaacttcatggtggtggtggtggtgatgaggggttatgggacagaggggcagagggcatttgtttaatggaggaatattggtaaatgcagtactgggaagagaccaacctgacaagcagctctttaaacactttcttacagatagcctgaagttgccaaaatttaacaagaaactttgaatacactgaagcatatcttttaaatatctcatttttgtttatattcatgatcacaaagtcatctattcatagattttaccaaccttatctttatatatattttttccttccagatgaacgggacaaagttcagaagaaaacatttacaaaatggataaatcagcatctcatgaaggtcagtttttatttcgttcacttcctggaattgtttggaatatttcagtttattttgcagtaattgattatatagctctgaagcacaacttttgaaaatcatcttgaaagtttaaattctagagaattttgcatgcattttaggcatctataattatttggtgtgtggacggtgggtaatgatggaggtggataggtaagtacccagtgatttcagtgcattctgtgacgttagtaaaacctgttactattggaatctataaaatctcagaagtttcagaaatctgtaaatatttatatgttagtgcatggaaaagctacatttcttagtaagattttttttctctctcaagattcaaaccaagttctggcctcaggtttatgtggatggcagaaggttagatgagaataaagatattgtagggacagaagtctagacttattatattcttatacttaatttaatccagtgattggtgcttatgtctaactttctctatgaagcagttaatggttatggttcttaaattaatatttacttgtgtaccatgggtaattttgagaatataaactatccagaaaatagataaacacaaaatttgcatgtaatttcgtggagttattggaccctattgaagcccttctgtaaatcttgtgtaaggaacccttaggatttcacaataaactattggtcacttcccctttctcccaccttttaaggagagccctaaagttgaaataggtcatgtttctatttggagttttctcacatagaaatgttattttaaatgtggttatgtattcttaagctagccaacaaatcttatttaaactatcatgtagcttaagagtggtaccaataatgtaaattgcgtttagtcatcttctataaaagtgatttttatttcatggatgtatcagaattaccttagaggtgtgtcagtcttgtctctctcaccacttgacagaacctttttctcaaattctgataatatccctcagggagggcacatcacgcactctctggttgagaatcacaagcgataaaaggttgaaaccctctgctttgtgaggaaatatattgtgaattctgacgcagcatgcggcagttcatctgtcctctctcaagcttttctttcattctgcacatactttatgggagaggatctcttccttacaggctaggacactctgtaaagtttggggtgtggatactgtaataagttgcctggagtgctgactcaggctagggacgtgttccctgtcttttaaataattcttaaaagttttgccttttctaaatttttatcttgttaacttaaatttaatattattcacttatttccccctgtttttttcacccttgttgtgactccaagaactattcttgtttgtcctattcctttggacagtgaggtgcttgagaggttagtctccagacaggcctttctttactggattcttttttttttcatttttgtaaaaggtatattatgttaattttgaacaaattagctttgaaaggaaaacatcttttgcaaggttatcagtctgtgacatgtacaccaaacagaggagcagaagaagcctcacctttgaggtcaggtaaatggtggtgtgtccaggctttgcaattcattatttgtgtgaacttaatctctttatgccctcatctgtaaaatggtggtaatgccagcttggtgtgaggatttaaatgagatagtctaaataagcataaagcatagtacttggcatattgttaggcactctataaatgagagcgtatggtgtagaagggtggattgacttggaaggtgtcagacaaaattgtgaagttaagtgtaagttgcttttggtgcccatctgcttcccttatctgtgtctctttttattacatcaagtacttttccttttagtttattcattttagaaaaagctacagtttggggttcagactctttttgaggagattgataggtgtgttgcctctttaccttagagttctgctgggacactgaagaatggcttacctgtggtaatcctgtagctgtgctctccttgccccctgcctacccctccacagatttttaaaggttgatttgggggcctggagtcctttttaaatctccttttcttcttctcccacacattcttctcacagaaagggagtcagtgaacactcatcttacttctgaaaggttggcagcttttggacctcaaagttagttttacttagagtcacacttggagggcatcttcaaaatcttctggttctgttccctcgtttaaaagtaggggaaacttgccacagctgctactggtagagctgcacttgaagtcgtgaaatgagaatatgaattcaaatgagacgctgtgtccagtgtttgacttctttgagcactgcaataggttgcagatcccagcaggttccccttggatgtggggttgtgtttacttttcttaacttattgtttcaactatttgctaatttttgtgacttaggaagttgtgatttatgtagctataaaaaagcatatacacagtgctcagggttgatactggcgtggtcaatttttaaaagtttatataactggcaaaagtaaacattgtggagcttttaaatgattgtataagttactgttacatttatgtgcataaatattttcttcttaaaatatttggtgaggatttttttgctcttcgatacagtttcttttgttgttttttgcttatttcaaaagcatgctcattaaaaggaaaaaagtcaaaattataaatgtttctggaaaatcagttagaaacacaaaagcaattattagaaaaagttttcctgaaaactctggcacagaagcttgaaaaacaacccatgatgtaccaaaattagcgatacttgaaaaaaagccataactgggggatattccttttcaaccaaatggctgtttaggccaaattgttgtgatgatcaaattgcttttaaccaagtgtatgccactctatattttcaaaccatggtctcatttatctttaagctttgcatatgctgcttccttagaagagggtccttttcgatctccactttcatctggctgattagtgaagaattaactagcacttgtgaactagaacccattaaaattaggaacatgaaacctgattaaaaatttcaagatttttagttctttgttttaaaagtccttgtttatccagaaaaaagcaatctctaaaaatattattgtttaaaaagttaaatatttgatttgtgacatcatttgttttattatatcatttaaaatatctagatagggtaacaatgtcaaatattaaagcaactttataagaaaacaaaattttcatgattattaaattctttctaagcccaaacttgcaacttatgtataaaaaggtaaagtaatcctgagaccaaaaagtttgagaaatattactctatgactgtatgtaataggttatttattgcagcactgttataactgcaagaggttggaaatgacctacatgttcatcaataagagattggtaaaaataattatgatacatccaaacagcgaaatacaacattaaaaagaatcaggagcattaggccagaaaatgagatgaaacacatcaatctcttattgatggtttcactgagtaggaagaggtaaaaccatctctatttgcagatgatagcatcttgtttaaagaaaatctcaaggaacctagcataataactaccagaatgaataaatgagttcagtaaggttgaagcatacaatatcagtatttaacaaactattgtgtttctatacacttgcaaagaacaatccaaaaatgaaatgaagaaaacaattctgggccaggcacagtggtgcacacctgtagtcccagttacttggaagactgaagtgggagagtctcttgagtccagtctgggtaacgtggtgtgaccctgtttcttaatcttttgattatcaaggaaaattcaggatcaggtcagagaatatttttcactcaacagtccagcagataacactaaactctgtttagtctcagtggatgacacctagccctcagcctggccttcaaccactgctgctccatctcgctttcccactggcatcctggtgccctgcacaccccagccctgggccaaggctgcttgaggatgggccctgaggacttttaaaatgtaaccttttctccagaaaaaagttaatatggccttattttgtatttttcaggctaaaattacatttgtttaaagcaaatcggctaattaattaaaacttgtatttgttggtgagcagacatccgtggcttttttccagatgtatttaaattttagtgttccggtagttcagttgtatgactaagcctgcccttgaaactgattgttctattaagaatgttttccttttgattcatcattcttcagaatacttttaagaataaagtgcagttaacacacagattatttaccttgcaaatcatggtttctaggtaaattactggtgtcaggaacatttatatattattctttagcataatttaaactgcagaactagagtaagagctggttgttattggaaatacctgtgtcttcagttagctaaattttacctggagaattgttccaaaatataaaattgatgacattcttttgtcatttacaacatttatttctgcctcttctacctatgacactaggtactccctctttatattagagggttttatataactacttgttgttactcatcatgtgcaatttgctgtctagaaattcataggacaacaatatgagaaatggcacctatgagttaagtactgatttagcttttgcttttctcggggaatggggtgggggacagagaaagaaggaaggactttattttctgaagtatgttaacagctatcattagaagactccctttaatcacttacttgggcctggaattagaacttgagccatgagagactgtgtttaggaggagtagtttaaggggataaatgatttttaggggaagattggagtccagagaagtctatataatgtggtttccttgcataggatccatctaattggcaatttatggtggaaatatattcttcaatactgatcagctatattttaaatttattccttcacatttgaaagaggatatttggtctaaatattttttctttttgtaaactttaatttattgacacataaatgcatttggagaggaagaggccctggatgccattgttggacacactctgtttgttagtcatctacttggttactgcatgggagacacccaactgactatcacagattttatcactgttccatcacgactttggaaagcttaatttactcatggcgcagatattctttgcccacatagtgaagtcagtgacttcatgactccaccaaatcaatcacactgttctttattttctgatttggtggcgggaagataatataaatcctcaagctgagaacacagtggtatcttttagagaacagaaaaaaaagctctatttcctctgtggttttgaccattgcaaagtgatcgagaataatttcacatctgtgggctcagattaaataggggaatttttttttttttttttttgagatggagttttgctcttgtcgcccaggctggagtgcaatggtgcgatctcggctcaccgcaacctctgcctccccgcaatctccgcctcctgggttcaagtgattctcctgcctcagcctcccaggtagctgggattacaggcatgtgccaccacgcccagctaattttgtatttttagtagagacggggtttcttcatgttggtcaggctggtctcgaactcctaacctgaggtggtctgcccgcctcagcctcccaaactgctgggattacaggcgtgagccactgcccccagccaaaataggggaatttttgaagcatcaactttataaagggctaatgaaaaatactgcttggtagagtgtattgctttgggttcttaaaacctacaaataagacttttttccccagaccttagatttatgttagtagttcctaaactttagccttatcgaactcacttggaaatattttaaactttaaaaagttgcaaaaataaagtagtacaaggaacactgatagactgtttacccagattgagctcttgttaatgttttacctagtttgctttattattctcccttccccagtcgtgtgtgtgtgtgtgtgtgtgtgtgtgtgtgtgtgtgtgtactttttttatctgaaccacttgagggtaagttatatataccataatcctttacctctaaatacttcagtatgtatttcctaagaatagggttattctgttttggaccacacagttagcaacttcataaatttatattggtataatattttaatgtctgtatttcagtcttgtttgttgatcttttacatcatcctctcttccccgagggcaaggaccagttcagggtcaggtattgcatttaggtgtcatgtctctttaacctgctttatttgtttatttaattaattattttttttgagacagagtctggctctgtcacccgtgctggagtgcagtggcgtgatctcagctcactgcaacctctccctcctggattcaggtgattcttgtgcctcagcctcctgagcagctgggattacaggcatgagccaccatgcccagctaatttttagtattttttaatagagacgaggtttcaatatgttggccagactgctgcctttgtctccctaggtgttgggattataggtgtgagccaccatgtcctgccaacctgctttaattggaaacagtttctatagcctttttggagacttgtatgaaattgacatttttgaagaatacagaacaagaatttatttatatagaatggaaaaatggattaatagcaaaatatcttttgaacctaaaattatttcatgacaagaagacaaactttttgttttttcttatgagggccatttaagcaattataagtcattttagtgtttgttgataaaattgtgaactatcttttcaaattaagaacaccaaaattttattcagtaattccctcaaataactttagttctatcttgtggtcaacttatagtttttcttcttcttgactttcttattcctgattatcattattactaccaccactgtcaatgccatttattgagtgcttattatgtgcttgaccctgcactagatacattacatacattatctgatttaatccttattttatcagtgagaaaactgaggctcagggaggataagttatctgcccaacatgaagtagctaaaatgttggcagagctgagatttagtccttcgtccttcctggctccacagaactacatcatgccattgcattatgccaaaatataaagacacagaatcttgaatcatgaagaagaaatggagacagagaagtagaaagaaagcaatatgctagggcacatggcctctttgctgtgttctaatttctttcagcattccctcatatactctatcttggctggtatgccctggccttgttatgtagccataaatttctatttgcattcttcttcaatcaacacactaggcaagagtttagagatacagataaaagtatgcaaagaagccaagcagcattcctgagggtcattgttttagctggaaaagggtaatttctaaagcgttttcaaagaagaaaaaaaattacactttgttcagtggtgctaacatattctaaatcatgttgtacagatcttcacattggaagtgtgtgtgttctgtgacaggtctcagttaatttagaatgtttgtttttccaaggttgaggatgtgtgcccatgacatagcctcaggaggtcctgacgaaatgtgcccaacgtggtccgggcacagctaggttttatgcattttagggagacatgagacatagatcaatatgtgtaagatgtacattggttcagtccagaaaggtgggacaactcaaagtggggaggtggcttccaggtcacaggtagataagagacaaatgattgcattcttttgagttctgattagcctttccaaaggaggcaatgagatatgcatttatctcagtgagcagagggtgactttgaatagaatgggaggcaggtttgccctaagcagttcccagcttgacttttccctttagcttagtgattttggggccccaagatttattttccttttacagttctgtagtaggaggattaaagcactagacttggtttgttattcaaaactagactcaaagctgcataaggacaggttatatctgttataagaaacaatgcatctgcggcctctagcatattgtctgatacactgctgttttcctcagaccgtactaaggaatttgatgtgtaatgaatgaatatgaaactaaataaagctttttttcccactagtatactatattacttctatgatggagaagtgaaaggcttgctttggtaggagtgagataaacgttagtctgcaggaaaagagaaataaacttatggtgactttcttcttataaagctaaaaaggtctatttaattataggtatagaaactgaggccccaagtccaacaggttgaccagtggggtccaagttaggattcattcttctgactgctatgttctgtccactggataaaccagtttctccatttatagctaggtagtaggaagtttactcatattcataggtgagattaattaatttgccctaagttactaattagctttgctgttcttaaccactgttgtcttattgtagatgtagccaggtttctttgaaggtctaagatattcttttccatagaatcaaatagaaaaccccatttccaggctctagtgagggtttaccatattgcaaacctgagggagaattcagagactagttttagtctgacagagggactgacagagaaagacaaatagcaaaggaaatgaaacctgtaatcagagaggtagaaggccactccttccagggaaggaattggacttgctgaggagtttggaaactgagtcatttgaacctaatataatatagaagaaattactgtgttgtgaacatttaaaagagggctgacttcaaagggaagctgttgaagctgggaaggctattgcgtatttccaaaagtgttgaaattcatacctgactggatggcacaatgctgttgatgtacagtgttaatatattctgatgctgttgtttgcttaaatatatttttatcaaaaaatttcaagtaatcttgtttgtgattaaaaaaaaaactctcctggaaaatccactaggtttaaaatttaaggaacccatggcattcattaatatgtcagtttttgctgctgcatatgtatagagttcttaacatatggaatgggagctttcataagtcattcttagaggcctgaaattgcatttccttaaatgggtgaaacttgttacaatgtagaacaagaactggtcttgttctcaggctagccctctagatcttatttaatgcatatactatcgtacagatgttaagtgctcaagaagccatatactagaggagaaagagtggtttcctcctctcattcccaaatagatttaaatttcaaactacctaactccttttctttgtccattccttagaatcaccctcttctacccaggggcccagtgcatgtgtgtgtcctcccgaggcactctcttttccagagtgttcatgtttcatcttggactcccagagcagctggtttcagctagggtcatgaagaaagactgatgggaacctcattcactgtagtctgtgaatgatagagcacattagccatcccgctgggaaataaatctccagtggaatgtcaaatagattcaggaagaaaagtcagctgtgcataggaaggtcaacagggtagtaagctagtcatacctggagtctgcctcagtggtaagttattctaagatattcctactttttgcaacacattctttcattgtactttgtgacccagggtaggtggcacagtgtggtggggaaaagcacagactctggactgagctgcttagactcacgtctctcctcaactattttctagtagtatgactttgaacctttctaggccttagttttctcatttgtaaaacagataagaatagtgccctcttatttgggttatattccatgaaataatttacatagaattttgaacacagtgcctgttacacagtgtgtgtgtgtgtgtaaaacagcctgttatatatctttatatctatagacccttaagattgtcaaaaagcttcagatttgtccgcctgtcttctctaacagtggcttgtggtcctgattgcttttttatgtatttgagtcataatattgcctatatattgaaaagggaagaatgcctgcaatatgcaactgtagtggttttataatagtattacagtgatgaatgccagttaaacagtgagctctaaataaggaatgtgttttctgtggtctggccaagaaccactctaacactagtttttcccccttcacatggatatgacagtgtgaggtgagatgctgtgagtgcatggcagagactgtttggattatttgtgagccatcatatcactagttgagtttagccgagattagataatttgcagagcagtagcccagtagagtcatagccacaacatagcatttcaacctcctgcctgagcagattctagcacttaggttttctacaagagcattagcagccttcccgtgttattgttattattttttaaaccaacaaactcaacacttggaatctccaaacaccaatactacttactgaattcttggagaatagtgtaaacatttcttatcttagatttaagtacagttacaccagaaggacacagcatcagtatccatgcatattctaaaagtagaaatgattcctatagagctattgtcctagttaatgggttttaatattatcctttcttttacctcatagtttgttattgttcccaaatgtcttaaacatctaactttaattttatgttaacttaaaaaacttaagaaacacacttaaggacactttgattttactgagcagtatatataatagagcagttttaacatgtcttccaggttgctaaatagaattcaaatttaatttctgattaatactttcttgctgaattttaaaattaattttccagtgttgagaagattaaataaaaacatgttttttggaagggaaacagcagttttcaaatcaggttcccaggaacaccggtgttgtgggataccctgggttgggggagcagcggaggaaggtttcatttgccaaagagattggaaagtagcattttctggttgaagagatttatggtacacattagcatactaaaaagagaaaaattctgtgggagagaaccctgtttaatccaatgtttcctaattcatttggtcttggaatcttttgtcaaagagtatctattaatctccctttgggaaatcctgcagtagagttttaaagtgagtgctttcaagcaaatttaattaatattgtattaatttgagttacagatctggatggggcctagttaatttggtggtcattgcagaaatgttttctcacagcccttcttttttaaattttttttgaaacagagtttggctctttttgcccaggttggagtgcagtggtgtgatcttggctcatcataacctctgcctcccggggttaagcgattctcctgcctcagcctcccgagtagctgggattacaagcatgcaccaacacgcccggctaattttgtatttttagtagagacagggtttcaccatgttgttcaggctggtctcgaaccactgacctcaggtggtctgcctgcctcagcctcccaaagtgctgggattacaggcgtaagccaccacgcccagccctcacagcccttcttataggtcaattattttctaatttatggatgacttacccttttggttctcttgaattataactgagctatttctttaattgtctaaaattctcataccctaacttccacctacttatcttgggccagccccccagaatgatataaaatgtatatggcagctcttgaatacctgaagaaactattttgtcctccttcaccacgtttttcttttaacttgtcaaccagatagttccatttcctttattttattctcatgtgataagattttctatcatacatttctaacatattctctttcagtttttatatttgaaatttttaaggctactgagttgaagacagaaaatgagttgaaggaaagtctgccatgtaatcagagctatacaatgccagagcatgcacagaagttacctatgttatgatctcaactatgtttatattatcttctacctttcacctccctgcctttgtacatgttcagctatttacttacctttatagccgctttttatttctacaatgtaggataattcctgtagtcttaactactttaaagtttttctaaaaagaacatgtactacttttaggctgggcgcggtggctcatgcctgtaatcccagcactttgggaggccaaagtaggtggatcacgaggtcaggagtttgagaccagcctgaccaacatggtgaaaccctgtctctactaaaaatacaaaaattagccaggtgtggtggcatgcacctgtaatcccagctactcaggaggctgaggcaggagaatcacttgaaactgggaggcagaggttgcagtgagccgagattgcaccactgcactccagcctgggtgaaagagtgagacttcgtctcaaaaataaataaataaataaataaataaataaacaaacatgtactacttttattgtcaaaaaagaacaaggtaatgttactttgtaaaaacttagtcattcccactcttaatttgccagggcaaggcaattggataattcatctcctttaaaggagttaagggctgataatgactaatgtgctaattcctcctaagtgtatttgcattctaaccaaggagcctttggacaggggtctacagactatggcctgtgggccaaatccagtcatgacctttttttttttgttaatgtccctgagctaagaatatgttttacatttttaaataattgagaacaaaagaagaagaatattttgtaccatatgaaaattatatgaaatctaaaattcattgttcataaataaaattgtattgaacccagccacacccattcatttatgtgtggttatatactatatggccctcaaagccaaaaatactttctggccctgtattgaaaaagtttgctgacctctgccttagggtgaggttttgtatatatttaagggaaagttttgtgtatattcacttgaatggtgaagacaggatggtcttctgtattttccctaaatcggtttatgaaggtggctttcctttcctgtatgtaaatccagctgtggttctatgaatgtgattttctaccataactgcttttgtgaatgagctttcctctttgatttatttaacaaaatggtatttgaataggccagttcagtatattgctttactacttagacagaattttatttctgtgataattctctgttgccggaagtcagggaccccaaacggagggaccggctgaagccatggcagaagaacatggattgtgaagatttcatggacatttattagttccccaaattaatacttttataatttcctatgcctgtctttactgcaatctctaaacacaaattgtgaagatttcatggacacttatcacttccccagtcaatacccttgtgatttgctaggcctgtctttactttaatctcttaatcctgtcagctgaggaggatgtatgttgcctcaggaccctgtgataattgcgttaactgcacaaattgtagagcatgtgtgtttgaacaatatgaaatctgggcatgttgaaaaaagaacaggatagtgcccccgcctggcagctgccccatctgggaggtggggggcgcacccccgcccggcagccgccccatctgggaggtggggggggccgcccctgcccagcagctgccctgtctgggaggtgggggggcgcccccgcccggcagccgccccgtctgggaggtggggggggcgcccctgcccggcagctgccctgtctgggaggcggagggggctgcccccgcccggcagccgccccgtctggaaggtggcggggggcgcctctgcccggctgccccgtctggggggtggggggcccctctgcctggccgccccatctgggaagtgaggagcccctctgcccggccgccaccctgtctgggaggtgtaccaaacagctcattgagaacgggccatgatgacgatggcggttttgtccaatagaaaagggggaaatgtggggaaaagaaagagagatcacattgttactgtgtctgtgtggaaagtagtagacataggagcctccattttgttctgtactaagaaaaattcttctgccttgggatgctgttgatctgtgaccttacccccaaccccgtgctctctgaaacatgtgctgtgtccactcagggttaaatggattaagggcggtgcaagatgtgctttgttaaacagatgcttgaaggcagcatgctggttaagagtcatcaccactccctaatctcaagtacccagggacacaaacactgcagaaggccgcagggacctctgcctaggaaaaccagagacctttgttcacatgtttatctgctgacgttctctccactattgtcctatgaccctgccaaatccctctctccgagaaacacccaagaatgatcaataaatactaaaaaaaaaaaaaaaaagaacaggataacagcaattgttcagggaataagagagataaccttaaactctgactgctgttgagccaggtggaacagagcctatttctcttctttcaaaagcaaatgggagaaatatcgctgaattctttttctcagcaaggaacatccctgagaaagagaaggcgaccctgagggtgggtctctaaaatggctcccttgggtgtggccgtcttctatggtcgaaactgtagggatgaaataaactccagtctcccatagtgctcccaggcttattaggaagaggaaattcccgcctaataaattttggtcagaccggttgctctcaaaccctgtctcctgataagatgttatcagtgacagtggtgtctgaaacttcattagcaattctaattttgccccagtcctgtggtcctgtgatctcgccctgcctccatttgccttgtgatattctattaccttgtgaagtacgtgatctttgggacccacaccctatcgtacactccttccccttttgaaagtccctaataaaacttgctggttttgtggcttgtggggcatcatggaacctaccgacatgtgatgtctcccccagacgcccagctttaaaatttctctcttttgtactctgtccctttatttctcaaaccggctgacgcttagggaaaatagaaaagaacctacgtgaaatgtcgggggtgaattttgcccaatatctggctgaatttctcctgataattctctttgaggaaagatgtggtcatgagtgatgatctcattgcaaatgtgactttcaaataacagttcagttacgtgtgtgtcaaggttaaagcctatgctaatgtagaactgaggaaatgtttcctttatcactcagattaatctgtttcctaactagaccacttggtaaccttttgcacatgactttccatttgctttttgccctcttaatgtataaccccggctttggtctagattaagggttttatagtggttgacactgacagattttccttatttattagtattatgatcagtcctttaacttatttattgataatcttggagctatttttcaataaatacaaattacacatccctttaagagtatttcagttgtatgtactgacccatattagaatagtctaacattctgtcttacattctgggaaccattattaatttttattgaattttgacagatacagatatttttcatgtgtgaacactgctgtcactccattttttcaaaaggagtgtgactaaaatatttttttaaatctcagctttattgagataatttacatattataaaattcatttaagtgcttaattgaacaatttttagtaaatttatagaattatgcaactattaccatagcctaattttagaatattttcctcaccccaaaaagaaaccttgtacccatttgtcctgtttctcccctgcctccagccgtagaccacccctgataaagtttccgtatcaatggatttgtcttttctggatatttcacataaacagaatcatatatgttgttttctgtctggtttcttttagttagcataatatttttgaggttcatccatgttgtggtatgtatcttccttcagtcccttttattgtcaattagtattccattctatagatagatcacattttatatgtccacctaagagttgatggacatctgggttttttgccactttttgactcttgtgaacaatgctgctataaacataaatgtgcaagactttgtgtagacacatgtttttatttcttttgcacatttccctagaaatggaattgttgggtcatatggtagatcttgtttaacatttcaagaaacctccaaactattttccaaaatggttgcatcatttcacctttccactagcaatgtttaaggattccagtttttctgcattcttgttaacacttgtcattgtctttgattttagcaatcctagaaggtgtgaagtgttagctcattttaattttaattttaattttgctaatgactaataatgttgagcatcttttcatgtgcttattggccatttgtgtacattctttggtgagttgcctgttcagatctttgcctatttttgttttttattttttgagatgaggtcttgctctgtcacctaggatagggtacagtggcatgatcatagctcattgcagcctcaaacttccaccatagcctcccaagtagctggaactaccggtacataccatcacacctatttatttatttatttatttatttaagacaaggtttcactgtgttgcccaggctggtctcaaactcgtctcaaacaattttcccacctaagcctcctgagtgtaaccaactgcccagtggactcttcttgcctgctgcctagatagagccaatttatcaaggcaggggaattgcaatagaagagttttatacatgtagagccagcaaaacaggagactggtgttttattattactcaaatcagtcttctccagaattcagaggcttggggttttcaaggatagcttgggggaagagaggcagttggctagacaatgggtgctttctgcagattggttgagagtgctatcatagggctgttggaaatggtccttatgaacctgtgtcatttctgggtggagccaaaatagtaattggtgggttcaggtggagccagcagttgtcagatatgcaaaaaacctgaaaagacatctcaaaaggccatattagcttctgcaatagtgatgctatctgcaggagtaattggggaagctgcatatcttacgacctctggaataatgatgggtaaccatttatgtctgtaccttagcagaatttagactcctctcatcccttagtctggtggtctctcattagctttacaaaggcagttagttgaatttgggggaatggctattatcatttaaaccaggggtttccaacccctgggccacagaccagtttctgtctgtggcctgttacagcaggaggtgagtggccagtgaacaagcattatcacctgagctccacctcctgtcagatcagcagtgccattagattctcataagagtgtgaaccctattgtgaactgtgcttgccagggatgtaggttgcatgcttatttatttatttatttatttatttatttatttatttatttgagacggagtctcgctctgttgcacaggctggagtgcagtggcacgatctcggctcactgcaagctctgcctaccgggttcacgccattcttctgcctcagcctcctgagtagctgggactacaggcgcctgctaccacgcccagctaattttttgtatttttttagtagagatggggtttcaccgtgttagccaggatggtctggatctcctgacctcgtgatccgcccgccttggcctcccaaggtgctgggattacaggcgtgagccaccgcacccggtcggttgcatgcttgttataagaatcgaacacctgatgatctgaggtgaaagtttcatcctgaaaccatccccaccaccctgaccctggtctgtggaaaaattgtctcccatgaaaccagtccctggtgccaaaaatgtagtgggccactgatttaaattataaactaaatgtctcccaataattaagggcagtttgaaggctggactgcccagtttggtggggttggttagatctgatctctttcactaccataattttcttactcaagtaattttcacaaaggcagtttcatgagtagctgggattacagttgtgagccatccccccggttctctttgcctatttttagattgggtttaaatgctcgtattgttaagtttttaaaaaataatgtatgcttttggtatcatacataagaaatctttgcctgacccaaggtcataaagatttactgccatgattttatctaacaattgtgtagctttagctgttacatctaagtctatgattcattttgtggaaaaggttcaagcaaatgattttgcgtaaggatattcagtttcccagcatcatttgttgaaaaggctatcctttctccactgaattgcctttgttcttttgtcaaacaccagttgtccataaatgtacaggtctatttctggactctctgttctgttccattgatctatatatctatttttattgaaagtgttttgttttacgattcattattcagtcttgaaatttgatttatctagacactttccagccagtcatttaccagactaatttagatggataagagttttaggggtggagggcaagcttcctttttgccctctttgaagatttgctgaaatgctgacaacagacagattcataggagaaaaaggcatacagatttatttacgaatgcgtagacttggaagtccttcaaatatgagactcaaagaagggccagatggttagggcttatgtaccctcttcacaggggagagggaaggggggcgtataggaaattttagaggggcaataaatgattttcaggggaaatgaatgagcttaaagaacaatggcctgggtacaaagttcctctgagctctggggaagctgctgggaaggtgaggggcagaacttcatttgtcttattattcagataaagtcttttaggtaatctctctgagctgccctgagaagaatagatgaaaagtctgtctgggcatggtgatgacttttaatctcttctcttttctgtggttaatctttcctggctatttgatgtaactgctagagagaggtcttaaggcaattgcatttcttttggacagaaatttccctagtcagctaaggaaattctagagatcctccctctttgcgcttggtgaggagtgggagagaaacaagagaaggttagaaagttaggcaacttctaaagacttccaatttcttctcttcaaagtgctcagcatgccaaagcaccatactttggaggtgtcattctgtgctccttaataggggaaatacttaggaggcttggcatgcagaagtggacatttctcttcaatgtgttagtcattcagaagcaatttacttaactccaactgtgtggcagaacatgatgccaggcactaactccgatagatgccatgatgggccttggggcaaacacaaatcccctgctaggaagtcatttgatgggatttgtgaatccatttcctgagtttctgtttttttccctgtgatccggcaggcattcaagagcccacagctgagtgcatggctaaggtcaaatgcaaagtgtaggtgactaatcttttgtttattcaacaaaagttctttgaatatctactatatgaaaggcactgtgtcagacattaagcatttgcagtgaggaccaaagacagggccctttcttcttaaggaaattattaatacatttatgtatattgtctacataaaactataagtaaaatgatgattggtgtactggtataatccaaagaatatgggagtgcagaagaaggaaaccatcactgcctggatgacgttagaatttgacctagtaggaaaagtaagatttcagtaactagaggaggagttatcaatagagaaatatcacagcagaggttttagaatgtgacctcaaatattcaggagacattttgtttcaaaatctctcttagccatcaggaatggacatgaagctctagttagggcactgggacctgagcatcttccagtaaacccatagctgttatgtggttcactttcagaagtgtggcccctgatttgctaggtgttacctggctctagcctgctcttggtgaaacttgtcactttaaaagggagtgtgctcagacaggggctggagagaaaataacttccacttagatttcagctttagtaagagacatcagtgcagtacctcttctgtgacactgggcttttacaactgggaaaactagtttttaagcatctgtggtccggagatctctgttgagtagactagaatctgaaagtttggcagacttatgatgtcatttaggaagtgatcactttgaaacttttaatcctcctacagaaagtatatttctgttgcagagattaatttaacaggagtgtatatagcatctgtcaaatttttaattaagtaattaaaagaataaacctgtatttataattccattccaaacatatcagttccccagatatgattttgggtggttttattttagaaaaatatgaatcgtggtactggggacatggagtgtcatctggatttaaggaaacattctttgacagggaagaggtgttaagcatcagaacggattgtagcagtggcagtggtatctcatcatctgggggtgtctttaaaaatagttttagtgttcctctccttttgtcagttgtcttgatcataatcctgggttatttcaaaggtttaatgaagaggatgcaaccagttgctctcagttgtttattttcaaggacccaaggaaatgagcttatgtttaaagaggagtgaattagtttgcatataaagtatctgaaagtatcagagtatcgtcaaagccttaaaactataaaatatgctatgaagagacccctagattttccagtccttgagacttgaaaaaaagagatgaagcaaccacttgtgtcatgcctatcctaatctctcaccttaggaaataatgctctgaaagggacaccgggaagtgcccatgatggcatgaccagaaggtgtctgcactcctggctggctgcacctttcctggagctgtatctaccagtggattctgttacttgcccagcactaaccccgctctatgaggaccttgcttcctctcgagtctgcagcctgactcatattgtaaccattccagcaagtggctcactgttcggttaaggatagagccatgtaagacattatccaggaagtagatgaagttaatttttgaggttcaggtagttctttgattgtgtgtgtgtgtgtgttgagattataggtcaggcattgacaacctatagctcatttgacaaaagccccaaaagagatgattcagctcagaagtattcagggtagttgccacaaccagcactttaatcagaattgcaaagtagttgaaatttttatttgtcacatccttatattccttttctgatgcttctcttcccactcaccagctgcccagggtcttcagactgccttttacctggaatcataccatgccctgcactgcagtgctactcccctacatgttattccatcttatcaccaaccatgattaagatttctttaaaaccaatgataggtaggtataaagagaaagtcagtctggtaaagtgaccttgtgttagaagcacatgacttgagaggttgctgtatctgtcccaggagctctctttttttgttgttgtttcaaagacagaatgcttttacttgaatacatctctaaatttataatgatcaatttgaatctgatttatgaatttggtataacgttacaagagagtcattagctgggaggatttgatgaggaaatacacattttttgaactagtgtgaattttgatcatgatataaatttaaataaaactaatttaaaattatttaaaataacctttgcatgatttttattttaaagtatttacaattctgttttaaaagcttttcagtaaaagctggaatttaaaaatatagtggaatctctttaaaacagtggtggtaaagaataagactgtaatggtgtcattatagactacctgtgtcaagcagactttgttacacctagttatattttttaagtcatggcacacagatgaactatgtctaattagctattagtattataatagcattctacttcgttgtcattatttgtctttatattacaaccacacattttcacttatttccatcaaaattttgtttccttgattaggttttctccttagacacgttaagtgataatgacccttgctttcccagctttttctttcttttgcccaaattatgagaaagtaggaggagtaggaaaaaggtgagcatagtaaggatatggattggtttctcctcttttccttatgctggtgttaaaaattgctcttgacatagtagtacttaccatgatttttttaaggtgaaaaagagtttaaagaaagatttatataagtaatgagctaggaggatatttgaaaaacctgtaaaaggtaatgcccatattctcctgccaaacagacagaatactggaaagaagcatccttagtcttatctaaaatacctcctcctattttttttttttttttgagacggagtctcgctctgtcgcccaggctggagtgcagtggcgggatctcggctcactgcaagctccgcctcccgggttcacgccattctcctgcctcagcctcccgagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccacctcctcctatttttaaaagattgcacaataatatttattagctgttcttctctctctcatatgtggaatgggtaatgctgatgcctttacaagccgacgctcgtttgttagacattgtagtgtggagtttgtcaagaatacatctttaataatctgtccaaggaactggacagataccaaaaaagatatactatgcagagtatattgatttctgaatttatttctccctttcagttacattacattataattaccccacaccaagatctgtacagctatgcaagagatgaaaaatctacaggttcaggggaaaatgtgagcaaaaatagattttttatctgttttcttgataataaaagggaagataggaaagatagagacctaaactcaaaccaaaccagaaccaaccaaccctaacctcagactgttacagaaaagttacctatttaaaaatatttaaaaattgaaatagccttttaaaaaggttactgcaaccatggcgaaactgtatagaagagaataaaaaatacctaggtgaaacagtgactaaaataccccaaatcttaaagtgtttatctgtaatatattaataaatgtttttattttatttaactacctagttccaccttgtggtgaaagactaggaaaggccattcagtttttgcattttaattgattatagattgtctacccaaaagctaaaaagagaagccttctttgtgaaggagtgaatcaggtccaaagaagtagacacattatttgtaccacctagtaccaatgtggattaaaaaaaaaactctctattattttatccattaataccttaagatgtgtaactaatacctttatttcatagtttaaaaataacctaaaggagatgaattctatgtggccttaatgttgacttaacgtagtaccttaaaaaaccataaccgcctttttatcatgccaaataaggatatttccctgtttgacttaactgcaccaatttcgaatttataataatttaggtagaatatgaattgtagttttattctttcacaactcctgaagaagtagtactgaaataaatttgtaatgaaaaaacaactttagataaggcagctacctaagataatacaatgtttttgagcattttttgtgtgtattttaaaagcattaattttcttatcaataattaatatgttaatatattgatatttatgttacctctattttttcaagtaggctgtctaaggaactctcccaggagaacctgacagctaattttttatgaacgtacttgtttgatgtaaaaaaattgcattgaaaaatattttaatttataattttcactaaagcaaactatccttcttctcgtcacccagttagtataagccagtgaggcgatctcatttgggacaagccttcttttattatttatgtttctttctaaagatagctgattgttttccagaatactgtatcctttagatatagaacttctttaagagcggactgtgaaccctttatgtggctgatgttttgctccctactgcagagctcactaggatgcctgcattttacccaaggttcattaatggaatgactcttccagtttcctttttttcctgagggacctttcctctattattgtgtacagattgggctcttgattttacctgtgattgatttgtttttgcttaagataatagtttacagggaagcttttatattggtcagagatattatggcctcattctgtttaaaattcgtagttttctttgtgtaggaaaagttcaagcttcttaacctgggatataaagcctctatgtccaccggcgcatcgttccagcctcatcttccacctcatgcttcattgacttcaccactgctttccttccttgcaactcatatgtagttttgtgtgtccttgcctttttcctttgttcttgctcctccctccacctgcaacattcccatcttctttgctgggaagacctcagactgggttaagctcctcatagcttcctgagtgttctctgaatgcatttattttatactgcaatttcttgcctaaatttctttcatttcagattacaggcttcaagaggtggcactcttattattcatctttgtacccatagaacttaaaggataccctggcatatgacggatgaatgctcaataaatagtttgtgacctgaattgaattgcagctaaacaatagtaataagtttaaataatgggaagtcaaatttttgtgaaatttgtctagattaacatcaaccactataatgtcagacttttaaaaaaggaagtttaaacattcagcaagcagttatataatgattctcttttcttcaaagttgaatttgatttagcctatataaaaccaaacagttataggttaacaaaaggaaattttcagtgtagtatttttgataagttaagccatttaggtaatacagacctggcatgagctaatgtgttctcactccaaaataaatttgaaatattgtccatgtcatcgccagcatcttgtttagaatttttgttgcccatagagtgttttctagtctattttactttcttgggatattcttttaagtaaaagattagtgccccctagaggtaaactctaggtgcaatgctatatacatatttttttgaagtactgcaaaattctacgagaattgtgtgaaatacagaaaatgctgtatcagccttgttatgtaattcaagttatgtaagttaatcccagagtatttcatagtgcttttactttgctcgtcacttcctctagcactattgatccagacagttttttgtcccatagggagaacatatccaaaaagagaaaaaggaatgctttattaaaaactgaaaatggaatgttagggatattggcggttagtatagtcatctgtgaaggaaagttaccaggcccaatgcctatgactcactcctagggtaaaataaaagcttttctatgtaggcttagctgtctactttcccttcttttctttcccttaaatttcttgctcgatcagattggaaccccaattctttcccctcagttcattcccgaccaccctttacccataatgttgatttttaatttttaatagcatcctcttttattccactcatttgtgctgaggaaactgactcagtattataaagtacttagcacaaggttaggcatctagtagtaactcatggtgtgtgtgtttttgtttattattgttagtgacatttgcttttcggaaaatgatatcttatattttgtaggatgttttccatatacagtatttctgtggaccctcagaatagtcagctgagacaggaaaagcaggcagtattggggatagccagtgtctttggatttttttcaagcattatagaagttaaattagtttatttctgcattttcttctaaaattcttaaaaaattaagccataagtcttaagagtagcttttattttatacattttctaagttgacaggtcattgattttttaaaatgataataatttgatttaaagattacagactttttgttctctaggttgaactaggagttttctgttttccaacctttattttaaagataaaaaaaaccctgaagcctagagagtttaggctgttggtacaaattcataaggccaagggcagaagcaggactaaaatgtcttttcccttatcacaggttttctcttttcctaatttagagggagtctcactcttttgcccaggctggagtgcagtggcatgatcacagctcactgccaccatgcccagctaactttttgtatttttagtagagatggggttttaccatcttagccaggttggtcttaaactcctgacctcatgatccacccacctcggcctcccaaagtgctaggattacaggcgtgagccaccacacccggccatcttttcctagtttagatttgcatggcttaatattattattttccttctctaaacatgtctgttttaattttcctttgttgtcacataaatacgatagtagcaaatgacacctggttttggaaagtttcccttatgtagagggttttgttcagtctggcaagtcaagttgtgaaattgccttactatgagataagtgttcagaatcataccccatctttaactgtcctggagtgagaaagacacaagaagtggaatatagagtgaaatgtaagtctggtagggtgtaggcatagtggaccagagagcacagaattctcagcactattacaatcctggaagtccccaaagtaatcatgtgcttggattctactgtccttctgtgtactgaggatatcagacctgcacaataaagccatttattttgagagacaaagcagctggctgaggatcaggagctgtataatattgtttatataaatataatcttttagtgttcccattcaggctcttttagagtttggctgctttctggttatattgaagatacgcagagaagtacatagatttagaatgtacatgacattcacaagcttagcttttctgccttgtttttaagtaggccttagccttataaattcaagcttgtgccttagaacgggactgggtgaattcttacagtgctctaatacaagagtccccaacccccaggccacagacaggtactggtccggtccatggcctgttaggaagtggcctgcacagtaggaggcgagcattgggccagccagccttaccacctgagctctgcctcctgtcagatcagtgatggcgttagattctcataggagcatgaaacctattgttttgtttgtttgttttttgagacagaatctcactctgttgcccaggctagagtgcagtggcatgatctcggctcactgcaacctccgcctcttgggttcgagtgattctcctgcctcagcgtcccaagtagctgggattacaggcatacgccacattgcccggctaatttttttttgttatttttagtagagatgggttttgccatgttggccaggctggtctcgaactcctgacctcaagtgatccgcccaccttggcctccaaagtgctggggattacaggtatgagccaccacatggctgtgaaccctattgtgaactgtgcatgtgagggatctaggttgtgctctctttatgagaatccaatgcctgatgatctgaggtggaacagtttcatcccaaaaccaccctcccctgcatctgtggaaaaactgtctcccatgaaaccagtccatgagtaggaaattgcagtattagtactcatttccctaagtgcttatctgttcgcgtacatatcatgcatgtaatagatatgttcctgaagaggcccttgaaaattgattcatctctgaaatacagttgagaagttgagagagttgtcatttcatggtatctcaaggtaaatattctaattgaatggataactcctttgtaacttatttggttatttacaggtttttctttctttctttctttcttttttttttttgagacggagtctcgctctgtcacccaggctggagtgcaatggcttgatctcggcccactgcaacctccgcctcctgagttcaagtgattctcctgtctcagcctcccaagtagctgggattacaggcacctgccaccatgcacggctaatttttgtatttttagttgagatggggtttcaccacgttggccaggctggtctcgaactcctgacctcaggtgattgatccacttgccttggcctcccaaagtgctggaagtacaggtgtgagccactgagcatggcgtatttacaggtttttctaaacaaggattgctcaaaatgtgttataacattttttggggctaaataaagtatttttaaactttgtcttactttggtattatgacatcagagattcaactgatattccttgggaattaggaaatcaaaataaaatgtcaatttgtaaagatggagacttggttaaaagtaatttgattcaccttcagttttgctgtatttcaaaggtactattgacatgaacagttactttgtggtagagctattgagcctaagcttagtatttatattatttgtagttaattatgcctagatgggtaattgaatattaaaaggttctgtgacttatgtaaacagtgccagaacactggatgtaaaagctggtaaatttgataagaaattcctaagggaacttcttcttcatcaatcaaaaacattttctgacactaacaaaagatattgtaaaacatatatatagagagagtcaactaagataataaagttttatgggatttaaactatttttggggactgagagacttaccataaaagtttgcttccagtttacattaggcctcttctttgtgtttgtgtagttatatagttttgattataagtttagatcttttcattattttgtgctatatactcacttgacattttggaagtgcaaaggagttggattcatttgtatacagggcttgtgccatgggtgaagtaggtgggattctggttcctgcctctttcctgcccacttctttggctcctttcatgggagtagcccagaatcactgaaaggcgagaaaatggaaatgtgccagtccactgtggaacagccatcttaatacctgctttgacatttgtctgtccaacacaaaccttgcagtgggccatgtggttactagagctatccctacttggcaggctaaacaaagcttttgggaaatctttgatggtttgggttctaaaatcacagacttctaaatcaggcctgtggaacggggaaagctattgtaggttgagtgttgattttgtgctagtgttatttagttttgaaaatcttccgttataagaagacttacattgtgcagaggaagggtttggacagaggacttctaacctgacacatacggatttcaaaaaatttttttgaaataattataggctcataagatattgataaaataatatgtagagtctcatactcttcacccagctcacgtctatggatttctaaaaatgttcctcggcatccttgaacctgttttaggctagaagtagaagatcaactgcgggggtgaaaactccaccctcttgttaaggtggcactggtcactgtatcgggaatcatgaataaagtcagggcattgtccgtatttgaagaattgtaaccccatgtagtagtccaggcttatgtttgttctggtgtcttaaaaatgtaataatttgaattgtcttcttgaattattaatctgaaattcacttttttaagtttttaaattaaatttagtttttaagtaataagcattttaaaaatttaaaaataggtgcatgaatgaataccatgtgaggaatgttttctacttgtctcctttttatgtttaagaatgttaaggataattctgagttctaggaccccaaattttgcttttctctttataggttcgaaaacatgtgaatgatctctatgaagacttaagggatggacacaatttgatttctcttttagaggttctttcaggagataccttggtaagttttaactttcttattttattttgaagaacgtgtaatcttttctgcataggaccagtatgttttcagtacagactattcagatttttgcaacattcatcttttgagctatgaattctgcctgaaaaagaagttttggttagattcctaagcattttcaaacttcaaatgatgtgaatttgagagattgaagcactttgattacttcacttatataatcagttctataattaaaatactatttttgttcttgcttcttttttacctttgggtttttttgcttagcagaagttggatgcataatataaccacatattaaaagacttacaaatagcaagaaaataaacattgctttctgaaaaatgatctaacccattccgcaggtgtcattttttttttttttttggtgaacattacttccccttcttgttacctgttctccttcattatgttctgttcatgctcttcttttcatttctggtctgtcttgtgtctttgctgtcctatcttctgtctgttatattcattagccaagggagcgagattttttgaagaccttacgattggtgagtgcaacagaagcatgcgaatatgaacagcatgaggatgtggaggatgaggataagggggtaggtgtcgcccccataacttgactaacctagccgttcccatgcggtgagcgctaacctgatagagaagtaactcctgggttcaggctcctttttagaaaagcatagaaagggccaaaacccacattgaggtagatgtgtgtgtaccaaaaaattggataaaggaaatattttctctttaaattatcttcagagagctaaaatgattgaattatttatacattactgtgcactgcatggtaattaaacagacttaaagtacatgatggcattttagttaaacaattttatatacattgtatataaacatggaaattttacaagtctgctaatttttgtgcaaattcattcagtttctggaagtgatatttcaaacatagcaactatttattgctttttatgaaagaacttagggaaattttttttagtatttaagtttctgctttaaaccacacctcttggcaataggtatttgatggacatgttttacctctctaatatatcacatgtatttaaaagggagatttaaaaatccagtattccaacagaactcacagagctgtttaatctccgtgactcttagttgactgcagcctacctttgcaagacagacgtgcttcttcttttgtcttctacatacctagtgccccttgattttactggaaattgtgcttttgttggatccagtgggtaaatttatcaacatcgtttctacttgttatgcagagcttacttttccttctgtggtgtgctgtctgttttcttatggcacctttggcttcagcaacctatacatattgaagaagccaagctgtcaattgtcttttttcttttttacctttggaagattttatgtgataaatttcagctccattttttgtatttttgctaagcatttctcagctctgtttcctctgtttccttcatgctaacttgtaacatttcttaagggaaatggcattaaggaaaataattctcatctgtcacttttcctgagactgagaaaataattgtttccatccccaagtagtataaaacgagtatagagtcctttctaattatcgtagtgtccacttttgtgaaaaagctaaaataaagaggaaatatatggttttaattggttttctctctttctctatcatggctaagtaaaccttctctgtctttctccttcttggtgatttttatactaactgcatgctactttatctcattttcattaatatgccatatgtatatatatatgtgtgtgtgtgtgtgtgtgtgtatatacagttataaaaaccctcttgctaatagtgttcaataagaaggtaaaatgatgaatgatatttaattatttttgtgcctccatagctaaataattgtaggctagcgttgttttattaccaaatattaagtgtctgtatattctgtaacatcttctcttttccttttgtttaaacaaaaaatttgtcataaagtatatgtttaaataaaacatacttggaaaaaaatccctagtagtttacattcaatctcagacaatataaagaaattgaaaccttcttagaaaatcttatggccttacctaaacggtaaatactgttttgatatattaagatgaacagaaattatatttaaattagcatggtctgtgataacagaaactctttttcatacctgcatttttctgttcttagcccagagaaaaaggtcggatgcgttttcacagactacagaatgtacaaattgcacttgactatttgaaaagacgccaggtatgatgttttgaaaatactgtaatcatataaatatatgttactaatacatccacgtagaaacatgtcaaggaatgacaaggttaaatttgcctgtgaattgtaaccagtaagcttgtgctttggtgaagcaaatatttaaaaatgtttttaaacatttgctcccaagaaaagaagttaatagtagggataagcccagaggaattataagtgactacatttccatctatgtaagaacttgtgattttctttctgtttgaattggattgcatttgcctaggaagttaatgacattttagtagcaatagaatgttaagaatgcctatgaacagttcttaattgtggggaagcaatacttcattttttacacttagtatataaaaatagttaatttttataaaaatactttatataatacttttaatttagtataagcatttttcatagtagggataaggaaatcttttgtttttataagtagataatattggaaaatttatgagtaaagatataacaacatttctgacaatagcccccaacttgcttgaggtatcaggagaaatcatggaaaagaattaatatattggatatgatcttgacttggtggcattacgtcataggccaaaatattagtaatttttcaattagtacaaaaaaatgcaggagagttcaaaattattgaagacagtgagagtcagagggggcagcaattttttttttaaatagtttgaaaaaaaggaagaggctgggtgtggtggctcatgccagtaatctcagcactttgggaggctgaggcgggagggtcacttgagcccaggaaattgaggatgtgttgagccatgattgcaatattgcactccagccggggtaacagaatgagaccctgtctcaaaaaaaaaaaaaaaaggcaagagaaaaagggggagagggagaggtaaacactagcttttattatttcttcattattattcttaaatattatgaacattaaaatgcttttccctattaaatactagtaaatcctcagtgcttaaatattttaaatgttattgttgtttgcttattattcatcattctagtgaaagtttccagatggatacttctgaaatgttttctggcagcattttgtccaagaagtaaaatgttaaatatcatagtatataattctcagtatttaaattcatgatattaaatgattttgtccaggaagtaaatgttagggatcatcatttgatttatttacctgaatgtacagtttgacagttgataagctttaagtctgagtattatattattttaaaatatttgaacagccttccaaatgcccagtgacttatatatttatggcacattgatagcaaaataatgctagttattttaaaaccttgtaatggaaatttgagaaaattgttagaattgttaggatagtttcatacttaatggtaaaagtaaaataaaatttatttttaaaagacaaaattttttctaattttaagatctcaaatatttaggacttctcacttgaggagttgtatttttgtattgacaagtgaatgcttttagtacttgctctagaacagcagtccccaacctttctggcaacagggactggtttcatggaagactatttttccatgaactggctggtgggaggagtgggggttgtttcagcatgaaactgtttcacctcggatcatcaggcattagatttttataaggagtgcgtgcgcaacctagatccctcaaatgcacagttcacaaatagggttcacacccctataggaatctaatgcagtggctgatctgacaggaggtggagctcaggtggtaatgcttcctgggccgctgctaacctgctgccatgcagcccagtccctatggtataggtttgggggttaggttggggatccctgctgtggaagacaagaatgcaataatacttgctctttctttgttgttaccatatgatttgtaatataaaatgattgagaataagggtaaaacaatatttagttgactactggtgtttaaattattccattttttctttgtataattttagaattgcttttatgtaggtaaagataactggttcaggtttgataaacagttggttttatctcttcttcacattcaaaacaggtgaaattagtgaatattagaaatgatgacataacagatggaaatcccaaattgactttgggattaatctggacaataattttgcactttcaggtaagcccaaattttcttaatttcagcatctaattgctagttttcaggtggttcctatgaagggtgaatgatgcattcatgttctatggaagaaaaataaatttcaagcttctttctttaagtaatatatttgaattgttcttttaagcaacatgctgcttgtgaatctggcaactagtttcctgttcttgataaacttaaatgtagttttaaagacaatgtctgttatctcagagttggaagacatatttctttttattgactggagacacactttttttgctcattagaaagtattacctgttttagatacttaaatgttttatgattagtccttatttagaatgttttttagtaatacaggttcttagcactgtcaactatttcctcctttgatagacactagatggcagcataattataaagagatgtgaagaagaaaagtattcatgttttatgcagagctgtgctttctctctttagatttgaggaaaatgcaaatttattgactgaattattatctaataaacctgagccaattgaggaccgattttgatttagttttggggaagtgatacattaaaaagaatcttcatttgatttaaggagattcctaactttagaacttgctttagtttactaactgctggtctgcttaagaaatgttctgctactagaggtgggaaggagggggaaaagggcatgggctgaaaaactacctattgggtactgtgctcactatctgggtgatgggatcatctgtaccccaaacctcaacatcacgcaatatacccatgtaacaaatccgcacttgtaccccctgaatctaaaataaaagtttaaattataaaaaagacccagaaatgttctgtgtgcagcacagagcctgacccacagtaggcactcagtacatcttaccaatagattactgtacagttggatcttgaaggaggaagtgatcctttgccagcttcaaaaaggacctggggttttgaaacaaatctggtgaggaataagacttttttaaaggctgggcgcggtggctcacgcctgtaatcccaacactttgggaggctgaggcgagtggatcatgaggtcaggagatcaagaccatcctagctaacgggtgaaaccccgtctctactaagaaatacaaaaaattagccaggtgtggtggcatgcacctgtagtcccagctactcgggaggctgaggtgggagaatcgcttgaacctgggaggcagaggttgcagtgagctgagattgcgccactgcactccagcctgggcaacagagcgagactctgtctcaaaaaaaaaaaaaattttttttttttaagttggctgaaatacaggttacgtagacaaatggtggagaataatgtacctggggggcttgttgggaacaggatagatttgacaggtatggagagctacaggaatcagagtctaggtaggtctaggacctgaacagaggcagctgaatagtttcagcagaaggacattcatggagatccaggtaatcaaaggaaaaggtgttagtcagccagactacagggcagctaatacaggtgaatatccacttagctgagctgttaatgtcagggagagccagtaaccagaactggaagccaggaccccaaaggactgagggcattactggaatcaaagatattgaacctaagtgaaggcaataatttggcatgaagcgcagaaccagaccttgttatcagaattgggtaaagtctaggtagaactggccaaaaagttgatttcatatggagttcctcagtggctttgtcagggatcatttaagtagtcctaagtggatcagatcctagagcttttagcagagttgaaactgcaagaaccccagacgggaaagtcagaggtctattggagagaatcaatcacttcatcaccagctggtgaggtaggctgtgtctgaattttgaatgttagacgaaggatcactggggcaatggaaagcattcaggcttcggagggaggtagaattaagtttcgttcttggctcttttacttactgttgtgatgccagtcatgttactactttgagcttaaaaaaaaatgtgtttctgttcatcactttcctttttccgtccatcactttccattttctgtccataaatctttttcggtgacaggacctgtgctggagtctctctgaatccattctggtttgggggctgcctgattctcaaatcgttttttgctcaattaaattttgctaaattttaaaaaatgtgttttaggaaacaacatccattaaaatagatagaaatgagcagagtccatagtgagagagataagctgtgaagctgaggtagtgataaaggtcaggactcagttggggatgcaaaattgaatagaagaggtcacactttccaggaagaaagaaagggacttggacacagggcatagagggtgtaggaaagggatttgttaaagataacaaaactttttagcctgagagattacgaaacagtagactactgagagacacaggggtgatgctagggggaaaagcacttactttctgggtgggcttgatgggatggtgggatatcctgtgcctctgtctgctgagcagttggagacatgagtggagctgagaagccagaggtacagatataaacttggagaagttatcactacacaagtgatcactgattttatcggaaagaagggatcttcaggggacccaagagaagagcacagatggagaagagatggagcactaaggataaaaatttggagaaggcctgcgggaaaagattctgctgaggaaagagaaaaaaggagcatttggagagatggatgaagtaataggaaaatgtactgatgaaaccaagggaagagaatttcaagtagaaataatggtgagcagtatgaaatgccactagagaccacaagaaaattaagatggagtagaggtcaatagtttgttctagaaagaagacattggagacccaagctcctgggagcagagactagaaaataacaagccaaaagggttgggaggtagaagcagtgtatttagaggctgagtttgagaaaatttaaagcaaaagtcttcaaaaaggagttatatactaagagagccctttggggttcagctgcctttggaggagagaggaagactagtcacagaagtatcaaaagaagttttgcgggccgtgcacggtggctcacacctgtaatcccagcactttgggaggccgaggcaggtggatcacctgaggttgggagttcaagaccagcctgaccaacatggagaaacctggtctctactgaaaatacaaaattcgccgggcgttgtggcacatgcctgtaattccaaccacttgggaggctgaggcaggagaatcacttgaacccaggaggcagaggttgtggtgagctgagatcacgccattgcactccagtctgggcaacaggagtgaaactctgtctcaaaaaaataaaaaaagttttgcttctaatatactgtggcatagtgttctagaatccattgtattttagggctttaattataagatgatgtaacaaattatcaccaatattcataaattagaccaaaatctatttggaatggaacacatctatgttttggttaaatggaaatgttctctcttatttaaatgaaataactttttttagtatgacaataacttgagataagaattgttttttggttatgccaagatataaagatttatagcagtggtaatcatcctcactcagagtgactcagcctttttctctatactttacataaataatggaagcaatttcaaaagaccaattgttttattttaacaatatttgttatagcatcataaatggaatctgtttttcagtcaggctttctgaaggtaagcattatcattacagtaatcctatatcattagccaccacatgctagatccagagatactaaggtaatgaagtatattgttctgtttattgggagagtgtccatgaaattaactataacatagggtgatgaatattattggtgatataaatgaaaatagaaatgtatgggaaaggagcattgtagtgggatctgaatggctttagagaatgtaggaaattttcacagatactagagataggctttgaaagatgaatgccagtaaccaggcagactaagttgggccatttctgggagaggtagcagtgtatatggcctagaaatggacagctgcttagtttggcaggtgtattagttcattttgtgttgctgtaaaggcatacctgaggctgagtagtttataaagaacagaaaagaggtttatttggatcatcatggttctgcaggctgtataagagacatagtcctggcatctgcttctggtaaggtctcagaaaatttttcagtcatggtggaaggcaaaggggaagcaggattgtcacatggtaagagagagagagaaggaggaggaggggtaggaggtaccaggctgtttcaaacaactaactctttttttttttttttttttttgagagggagtctcgctctgtcgcccagactggagtgcagcggtgcaatcttggctcactgcaacctccacctcctgggttcaagtgactctcctgtctcagcctcccaagtagctgggattatgggcacgcatcaccacatctggctaatttttctatttttattagaggcagggttttaccatgttggccaggctggtcttgaacttctgacctcaggtgatccacctgcctcggcctcccaaagtgctgggattacaggcatgaactgccgttgctggcctcaaacaactaactcttaagtgggtaagaactcattactgtggggatggccgaaagccgttcatgagggagccgcccctgtgacccagacaccccccactaggcccatctccaacattgggagtcacattttcaacatggaatttggaggggacaaatatctaaacttcatcagcagagatggagggaaggattgggggagtgcagatcactggttgcccctccatcatgttagtacaaatatcagccattatacatttatagtctcttgaataatgtaccactcattacctttgaatacactgaaaatcaagttaaaaacaaaaaaaaatctgggaccttatttttaccagcttctcttctgggatgttcagtttttgctaccggagaatgtttttaaatgattaaggaaaattttacaatgcaggatctgttattgacaaacatctacagtatcattgctaacttgactaactgagtattcttacttagtaaaatataatgagttccatcttttgatcagtctaaagactacctagtgaaaggcaattattaatttttttagtagtgaaatgatttgtacttatgtgtaaatccatttcatgctattctaatttttttttttttttaccatatctatgactcagtgttagaaatatgcacaccttagataatcaagtctcatactgattcattatttttccagcaaggccctcataaaaactgtataatatttaactagggtatgattataaaagttacatataaagtttaactacatatatatatatgtatatatatatatatgaatgcacatatatttccttttgctaaatctttcatgctttaaattatataatttatctatttggtatcacattaaagtcctaataattagataaggtcatggcttggaaatttatattatttgaaaagtattataaactattttaaaagattgattttttttagaaacaattttattagagaattataagcatttagcacttatctctcctgctagctattgaatcagcttattattttttatgacttgttttgaataagagtcttaataaaatttacagagatctttgagcttttgatgtgtttgtgtgcaagtaccaaaattagttggtatttcttaagaaaaaaaaatatatggtagagggtagagagtctctgaaattcaatttgaaaggcactttgaatccaaatttgaagggcactttcctaaatctctcctgactggtgtttgctttctttttgctctcattcgttgaaccaccaaatagtttcaaaggttaagtgcaaacttcattagtgtatctgcatttcagaaaaccgaaggttaaaaacagtcataatcttctcatacagtgaagctaagggtttgccttgagagctcatcagtgttgtaatttgacagtgagcagtaatgtttgtctaagaggattggtggccagaaataagccacagtgtctaatgagacacggaccggctgggcaggatgccacggcatttcttgtgtgtgcctttctcataagcaaaatggcctcagactgaagaggatggtcataaagtctgtgtggaacagatgtcagagtggaattttcagacttaatggagaggatctaagtaagctctggattttgaaatgagtgaatctatggagctgtgatctcctacaaatcaaatggggaatgtctgtggatgtgtaagagctgagaaagaagaacaatatgtagatcctgccaaaactcctttgaaccctgaaaaatactctcctggaagaaaatatttcagaagaaaaccgatcaaaaaaactggaggtgacaaagagtcagttggggcaaacaatgaaaatgaaggcaagaagaagagcagcagtcagccttcaaaagaacagccagctcctttatccaggggactggtacagcaggaatctgttaccctaaactctgcactgggagatggtattcagcaaaagaagacagaagttgtagctgacagcgttaaacagaaacttctgccgagtgctgtaagcagttggtctgactgtgtgaacacttctcctgctaaagacagtgaaacagaagtaaaagttagtgaactggatgaaaggatttcagaaaaagacagcactccatattgcgcaaagaggaagaaacatttagatgatgtcaacacaagcgaaataacattccaggaaaaaactgatgttttttctttccgaaaggcagccagcttaagctctattccctcgggtatagaaagatcactcgaaaaaagtgggtttcctgaagacccaccaaaaagttatagcagtattcaagaaaagcaaaacactgagagattttgccctcatgcaacacagcattttcagtttaaaaaaaagagatgccattccctttatactagtatgtcctctgtttctaaggacacagatggaaatgaggtaagtgaaatgtggagtctgagttcaagtaaataagtgttccaggtgctcacatcagactgacatctaatttgtcttttataaagttattttcatattagtgtatgtaaaagccatagagtttctgttgcgttttgttagtagcctcaggtttgattgttatgattttatttttgtgctgtgcacattctttgaccacactttaatctaaaaatcctgtacattttcattattggtggaagactttaaaaagcactacagtaagagagtgcatatcttttgaatttttctggttcatgattcttgactttgcctgtggaatagcctgtggaagcttagttggactgtaggtaaaagttcaattagaaatagtcatgagaagacaatagctttgtaacaaataataggatactgtaaaattatcagtcaataccgacttgctgattcatgagtttgaaaagccagattctggttctctgttgattttcatgtgcagaaacattcacataattgctgtcaattctgtgcatatgttttgagggctagggtacatcttttcctttatgttattccccagccccagtctaaaatcagaaattgttagggtagcatgccataggaatttgaaaatgacacagactactaggaagttgagatctttattcctaacactgatatttagctttagacaagttacttatctggggtttttacttgtctttaaaatataattagataggtatttatttaattgctcaaaaaatgtattatccacataacctctacatgttactactcaggagttgatggctttttctttaagctattcctaactttatcttttaataaaaaatctgaacataaagaatatttgtgatgttaaacattcttggcaaggtcattgtatcaatgagcagagatcatttgcataatgatagaatgaggttttatgagggttagtgtgcgccatcatcactgaccttggtttctgagttctcctgaaggtgtcctgtttatatacaccgctacaccttgccaatattatgccatcagttctgtttatattttacagtggttatattttaaaaagaaagcattcagtctgtgtcattatctatgtagctctgtcataaagcctagtgcaaaagaaaactacttgactactatatgtttatgaatataagcacttggtttaatttcacatatgttttccagcataatttggcttcaagtaagctgtacatttttgcattaatggaaatttttataatctgtttccttagtggtacattagcctttccttcaatggaaaatatatgtggaaataagtcataaactgaccagtcagatttgcgaaataactgtaatgcaatgtatataaagcctgacgtcttctaggttaaagctgaatgggtagtcattatattatctgaagggtttgacatctcatgtccctgtagttcagataaagactatttatttattctgtggcacacaaagagtccaaatcaagagtttagctattcctcttaggacattcttcctgttaccttggaggtgtttgactctgtttcttaattatctttggttggaaacttccacagaactctttatcttgcattggattctacatttttcattggagaattagttgcaaatgagagcttccagccgcttcattggcatttcatcccggaaatgactgattaaccaacattccttttgtttgttctttttcatagcttccctatgtgatcagtttttgctctgagttgcatgtagggttggacttaacttttgagttaacttctaagtagaatagtgtacaattttttgagcttatcttaacctgacttgatctcccctagtcctgtgacattcatcattctcagcctacttcccttttgagtcgttgcaatgacatgctgacctagagtggtcttcctggttcagggggctctgtggaggccattcatccagcccttcctgctgcatataaatgttatcaacatgttatatttttattaggataagtaggtaaaaaaggagtatattagatttgtatactgctttggaattggaataatggtttcagacacatcgcgtcatttgatcatccaaacaactctatgaaataggcaaaatagactatgcctcatatacagaatgaaaaaatggaaactcaggttaaataaatccttaaggcaacatggtaaataagattacctgagttaaattatggcacgacatcccacttgttttacttgtcaatgaaatttaagggagattgctaaaaagttagagcaggaattgatgttaatagtgtcatctgtgaaggatatgttataaacaggtggcagaaggtagatccttttgggagacaaggagtaatgaacttagtgtttgtacctttttcaaggatcttctgtttgtcgaagactcaccttgtaccttgtgacaaggtttcctacctttgtccttgagctctttccagaaaacattcttttttctttagtttcacaaatcccacctcttcccagttttgttaagttgatattggcaaagatagttgttttcatcatctgtagactgtgggttctctaacctggccatatacatgtaagagtcatctgaagatatttcaaaacagatagatgcctggatgtcacctacagttattctaatgtaatagataagggtgggtgctctgtaggtgattctaagggtcaggacgttggatagggagctttttactattcttattctgcagcagtacttctcaaagcctggccccagggtccctgcaggagaatcctctagattgcttattgaaaaacaccttgcttgagatttaatttaatcagaatatcttctgtcatgagacagtattgtatatgttttaggcacctgctcgtgtgtttttaaaaacacaccagatttagagaatcagcatcaccttagcttagtatttgccatttcattttcttcttaatgtaggttttctgataagcaatgtggactacgggcctggcaggcagaagatcgaagttcttctagtcaggctttgccaccagacagctgcatgacttaggcagtcttctttatttctctaggtctcagtttcattttctataaaaggaggatactgtactagatcatgattctactgctaataataatgctatttgttgagtcctgctatattccaagcactccccaactacatttatcttcagagcaagtctctgaagtgttctgttatgagctccatctttatagatgaggaaactgagtctcaggaaagttaagtagcttactcaactcacttaacaatgagtggtacagctttgatctaacccaaaattgtctgccaggctgaactgttacctgaggcaatttaccctccttttcctacatacctcttttccagttttaaatttctgtgaattcatgtgcataagtgtatgcctttttgtttgtccagtgttattactcctctctctttccctctcttcctttatttctttatgaaacatttattatgtattgaacccaaactaggcactcagagataagtaaaacgtagctcttttccttgtgcattatatctcattgtttgttcataacaaatgacagggaccatggctgtaaagttagtcacctgagaattagtcacctggggtgatgatcaggaataagtttaacttctcagcaaaccatgtggtgactctattaagtaatgaaaattgaactgcatttctgttcctttccatcctttggtgaattgctaatgaatagtgcagtggcctaaagtaaagaagccgaagagagaaggttaagaaatgagtgtggctgttgtacacaatatattgtcagtctctgaataatgaagaattgaatatttttattaccttggcttttgtatttaaaaaactttgaaaaaaaattaagagctatctcagaatgtgagaggaattacattcaacctacctgaaatatatttattcattatttttttctctcaccaactcttttatgaagcttagactataaaatttatgattggaattcaaggaccaggataaaatctgaatgtgtttagccttgctccacagatcttgaagacgaaggtcattcattctataattgactaactcatttcttgctgaaccattttatctctttctttaaaaatgaacattcatattgatttctcttgactatttctagtcatttagatttcataaccagtttgtgaaaatatagttttagaataattgtatagaatttgggtccctatcatcatgatgcctttctctgccttttaagttaaatgaaggacatgcacagtttaaatccttggctttacaaaaaaaggtagcctttcccctctgtttgtataagtaaatgataatttgttcaaagtagttatcaatttagagcattagcacttggactttatcagctttttaattacttttgttctccatttcacccttcccttatataggcagtttgtaccagttaaaattttaaaaatgtttgtgctgtctttacagttaaaaatattttgtgaagcattttcacacttttttttttttttaacttggaagcagagctaaaaatgtgttgattacatttgtttctgccaaaatagtttaaacatttttaaagaaattgtccttggaaacaaacatcttggcttggaaatatttgcctgtgttgacaaattcaatatggaatttgcttttgcttgactgtagtgtcaagtgatgtgaataaaagagttttagaaatataataccctcttacacgcctccattcactgtggggcaggcaccgttctcagccatgtgtgtgtacctcttagtctctcacactaagaaggttctattattatactcattttacaaaagaagaaactgaggcccagagaagtcacagggctagaaaatagtgggaacaggaactgaattccagttgctgccatccacagctttgcaccaatcttcctaccgatgttaaggttttactcttgcaataatgaaactcatcaggtaggagaagaatcctgagcatgacctttttgacttgctgctttcattcttactaatacctacactgtctcgaatagaatataatccttatttttatcttaatagaaacatataaagggattgaattttcatttgttaacgtttttgtatgtaaacctctgaatcaatagggatttgtgttctgcacagaagaacatttgactatcatttctacatccactgtgtgtcccacaagtcagtttctgcttctgtagaaggaggtggtccatggataggtatagctccctcagcagtgttacggggagtcacttagcttggcagagtaggggaggagaacttacaagatgttgagtcagaaggcttacattcaatgcaggtcttattattcccatccttaaaattggggtggtttcttgttttgaggattaaacgaggtcacgtatgtgaaaaagacttaggagactgtaaagtgctttataacttatatccttttgtcttctgtttctggagaaaagaggaaatactttgtgatcatcctttaagtagaaagaattctgtaagttttcaaaacttttaacgggacacttctttctctcctttagacacagagcattctgtataaccagagcaggctgccaccttccctcccgctgtgatcccaccttcattcatcctctcatttctttagcaaatatttactaagtatctattatgtgtcatacagtgtgctgactgtattcttcaaattccatagttagcttaaaactttgttagccttcttagataaggtagcatgaaactaaaacaaaaataaaaaacaaaacaacaacaatgaaaaccctgtcaatttgttggaatagaaataccttggaaggaaccatttaaaaaaatatttaagattcagtgggtacatgtgcaggtttgctacatgggtatattgcatgatcctgaggttagagcttccaatgatcctgtcatgtaatacttgataggtagtttttcaacccttctcccactcttatgatccccacttttggaatacccagtgtttattgttccgtctctgtatctgtgtgtactcaatgtttagctgtcactgataagtcagaaaatgtggtttttggtattctgttcctgtgttaattcacttagtgtaatggcttccagctgcatccgtgtttttgcaaaggacatgattttgctttttcattttatggctgtgtagtattctaaggtatggctgtatgtagcacattttctttatccagtccattgttgacagacacctaggttgattcccatgtctttgctattgtgactagtgctgtgataaacatacgagtgcagatgtctttttagaagaatgatttattttcatttggttatatacccagtaatgggactactgggttgaatgatagttctgcttttagtcctttgagaaatctccaaactgcattccacaggggctgaactatttgcatttccactaacagtgtataagcatccctttttctctgcaaccgcaccaacctgtgttacttttttgaattttttttaattttgatttttattttttttgagacagagtctcactctgttgcccaggctagaattcagtggcgtgatctctgctcttcaagtgattctcctgcctcagcctcacgagtagctgggattacagacatccaccaccacgcctggctaatttttgtgtttttagtagagacgaggtttcaccgtgttggccaggctgttctccagcccctgacctcaggtgatccacctgccttgccctccctaagtgctgggattacaggcataagccacccagccttgactttttaataatgaccattctgactggtgtgagatggtatctcattgtggttctgatttacatctctttaatgatcggtgatattgagcattttttcatatgtttgttggccgcttgtatgacttcttttgcgaagtatcaacatcattaaaaagcaggcaatggacatgaacagaagtgtcatgtgttttttccttgttgatttgtttaaggtccttatagattctgggtattagttctttttcagatgcatagtctgcaaatatttattccaggttaaaagtaggttgtctgtttactctgttgatagtttctttggctgtgcagaagctctttagtttacttaggtctggaaccaatttttgaagctcattttggttatttacacttcactagtacagatacatttcaaaagcgttattgagagtaactctgatatgagagaggaagagaacataatgccagaggcaaatctgctcttctgtgtggggtgggggggtgggtgggggctgttggttaaggaggtacaactggtctcgtgaggaaaatttttatggaccctgacatccagttcatgtgagagatccaggacggtatcttcctctgaaaatgtgtagtgttctgtgcatcagctcctttgccagtatagaagccgagaagctccagtgaaaagggtctgcctttaggagtgaggcaaagccaagggattccctttcatgacctatctatgtgcagccattttcctggcagtaggtgcactgagaggaagctggattactgtggctgctgaaacagaagaaaaattagtctgacttgtaaggatagatttcttttctaaacatgaaggagaaatgccattctcttgtaaattctgtaccagaatgtaggagacctgggcccataccctaggtctcctgctagcatgctgtgagaccctacgcaaatgacgtcacctcttttagtctaagcttgttcagtagtgagaggagggcatccgccaaatatctctgctttccttcagtttgaatccccatgatttcttaatcttcattatataactttctttaagttaaatatctctgttttcttaacttcagagatgttgctttttctactattgacataaattatttagattatttgataacactttaaattatacagttatttaaaaatgtttaaaaataaaaattgcattattttctttgtatggaataataaaatacatactttttaaaaaagtgaataagctttcagggaatatctaagtcaactttggagttggcagttcctgtgtactcagtgcatgccataaccatgacagcatctgtaaaaatagggtgcttctgttgcccagttgtctggtggcattgactttgctcataggactttcatgtttacagattcagctgactaacatgggtgaggctgttgcaattcatttagcagtaagtgggtcatttagtaataagctgtgaatgaaatcagtgtgctataagatgagataggttggcttgttttcttttattgaaaagacattttgaagctatatacgatgtaaagttcatgaaatttttttagataagtgattcagatgaagcttagctttcttgcttgacactaggttctcattgagtggtctcgaggcttgtgttccccattggacacttttgtgcattggtaagggcgttctgttattatcggaaagtgaggttaattggaaaccttttgattttctgaaatgacaaagtttacatggcagggttaaaactcattcatacaaaatgaaagcaggagacgtgtgtttctgatctttcatactttttctgtctttaatacttcctttgttgctgctctcttgagtctcctgctctccatttattcagtagagagttattgagcacctgatacgtgccatgtcacgttgagcatggggagaatgttccaagggtagaagtagcttgaacaaactaccgtaggagagaggaaacatatggttcatataacttgatattaatgtgatttgatcataggagagaagaggagaattgcttgaatctggattaccgcactggcacagtaaagaacacaccattttgggaatgagagtacaataatatttggtacagcaagactagttaggaggctgttactaatccagacacggaggcttagttccagaagaaggtagaagcccaatattattcgaggtgtatcacgaatgtgtttcaaaacatgttgttggtattgacattccagactagtggtaacaatctagactagagataatagttgccttgactcaagttgatagtgggaagagagaaaatggggatataagacccccttcttcctacagaaatcaatcttagaacagttaatatatccatattattaggtgtgtgaataaattgccattaaaagtaatggcaagaactgcaaatacttttgtactaacttaatatcttccttaggggcatgagaaactaacagttgagtgttttgtagaatgagccaacaaacataaggcagattcagaagagttgggttaactcatccttttatcatttgagagttccagcactggttgctttggttcccagactgcagagcaacatattctgcttggtctctcatatttattatgtccttttcagctgttttttgagactgtggctcacattgcctgaccatgctccatgaggcacttggtcagacttgcacagtgaaacaaaacttacgttgttttacatctctgactgaccatgagcaggcatatgtctggtgacagcactgttggaactatgtgaaatggggtcaagccttcttctttggtttgaactttgcctgtccaaattccctccttgcagattctcaaccgcaatcctctgcaccttcttttagttccagttattggtgtttcagtcattgactgttgtctcagctctctccagagggagaagggaaaacatggggtaaagtatcagtgttgtgtgtaagagtagaggtaatgacggaaaaagaaaagcagatgtaagaaagagtgtgagggttttttggttgttggtagtgatgttttttaggctgagcttagttttcaatatttttatgtcagtttttgagcttacttatgtgaagtgaaaaggtaaaataagccaggtacggtgcctcatgcctgtaatcccagcattctgggaggccgaggtgggaggattgcttgagcctgggggatcaacactgcagtgagccatgatggtgccattgcactccagtctgggtggcacagcaagactctgtctcaaaaacaaacatacgaagaagtaaaataaaagtgacgactttctgattgccaaggtccagaatgagttcacttggatttatgacataagatgttttatgtaggcatgttgacctccccgttacactctctttgaacttgtaggacaaacactaggttttggttatttttacatagtgccaaaataggttttttgaaaaatgttgtcagacatgtgttttgtattttgtaaataataagcaaacaaaacccatttggcttagtgacattttcataggtggattggttgggggctgcatgtccactgtaggtaataaagcctcttctccccagtgggaccttgaaatatatgataaagcagaagtgaccaagagaatcctggtctccttaatgaattaatgcagattttcaaggtgtccaactcaatcataaagtcatttgtccattggatatttactgagtatctgtaatgtgccaagcactgccctagctaggcattataacactaaggcaaataagacattatctttcaggatatactgctcacatattagagggctagaagatctaacaagagacaataatgacacacaagaggtactgctattataccagtatgagtggagtactttcaaaagcacagaagatggtcaggtcccttacacagacccctgaggcagaatcagctggggcttcctcaaggagaaggatgagtggaggagtagcacgggatgggaattggtgagggctttctctgggtagagagtggtacatataaatgcatagtatcttgtggaaatgcattcttattgaggaagtagaagtagttcactgtggctggagcacaaggagtgtttggggtgggtgtcagagggcagggaggagagatgaggctgcagaggactgtgttaccaattggatgtgggcacagaggttgaaaacgcatcaaggatgactccagcagcttcttttatttgggggcaactgggtaaatggtggggccattctctgagctaggaatgcaggaggaaatacaggaaggaaaatgagaaattaagttctcaatacattgagtttgaaggggctgtgagatatagcgcagtggttaagagtatcagctttgtagccagacagattcaagttcaaatttgacttctacctattagtaatttgggtgaacttgagcaggtcatattattactttatgtctctttgtcatttgtaaaatgatattgtatattgtaaagattataaggtaatttttatgaagagcttaagcacagtgtctggctcatttaagtggtcaatacatggttagttttactattgcaatagaagtgtatgatagggagatgggtttagggataaggtttgggatgggatatagggatgtgggagtcaaccctgtcaaggtggcagttaaagccattgtggtagagatgatccagggagagtgaggagagtggaggaaagaggcctgaggcctatgccctggggaataatgttaaaggttgggtaacagaggagcctctaatgaagactgagaaggaatggctagagaggccggaggaaagcctggaaggggtgacgttgtggaagccaaagaagaaagattgccagtgacagatgcctcagtgagatcaggattagaaaatggaaggatgggaaaacaacccttgagctcttctccatggtgtttctgtcattagactgtaagctccatgaggatggttgtataaccaatgcctgttaatggtacaagtggacatttatgagtgtttgctgaatgagtgagactgtgaaggaagaggtgatagatgatctctcacaatatctttcaactcatcagcatccccctacccatcacttctattatgttaacaatctaattttcttctttattggaaaaatagagttatgaacaagaattccctcactttgtctggtcacctttacttagttttagtggaatggtaagaaagaggccaaatcaaaacaggtagaggtgtgaagataatagagacaagaaaatacagaatacttttttaggtagctttcctaagaagagaatgggagagagatggtgttaagtaaagagggaattgagttcatgaagattatttttatttattttaggatggaagagatttggatattttaaatactgagagacccacgtgagagggaattattggtagaatgagatcgctaggaagttggaggtgaaaggatttaaactccaagagaaaaggaggtcatatgggagcaaagtttgtgggtagcaggacagaagggggttcttacttatgtagctattttctcaataaaggaggagaggaaatttgtttgctaaacataaaaacataaaagtagatgtggtagggtaggtagttttagacaagtagtgaagaatttttatttttggagatggagttttactttcaccaggctggagtgtagtggcatagtcatggctcactgcaaccttgacctcctgggcccaggtgatcctcccacctcaggggcccgaggaagcttggaccgcaggcacgtggcactgtacccagctaattttttttttttttttttttttaatgagacatagtcttcctatgttgcccaggctggtcttgaactcctgggctcaagtgatcctcttgccttggcctcccaaagtgttgggattacaggtgtgagccaccacacccagccaaatagtaaataactaaaagcaatattgtgaggggtgaaagagctggccagttaggacaccaagaagaattgccacatttctttgagtacctagctgaggttgcagacctggaatttgtggtggcaggagtccacatggtggtatgcttttctctggtagacatttatagcttagggtgaaagcagagaagacgtgcagctggattgatcaggattaaggtttggtggtggagtggttgcagagtaaggacaaagatgtgaaggacttacggatattagcaaggaagtggtggaaatgataaataatatagtacaagacaaacagagaaggatgtaaagatagaaggggcatctgtagaggaagaaaaataattttcttcaaccctcgtaagttagctggaatggatgcctacaacaaaagacagattgataagagaaagacagtttattaacatgtatgtttcatacatacatgggagagcccagggaatgagcagttctcagaggcagctttgaattccattttatatagtgtcttcaacaaagggcagtacatttttagagaaatgacaagagaaaagaaaaaaactttgagtctctggcggcagcaatttgtgggaagggaaagaaatggcagacaaaggcccgttagtaaagcttgttcatgtagataattttggtcccatctccaggcccataacagtctaaagttatctttattggttaatgtttttctctctggtagagggggacaggataccttttgtctttgtaaatctgtgtcctgcttttaggcaaatggagagtagagagctttcctgcatctgctgctacttaattgcctttagctcaacaagcttttattttgacatggcatcttctggtctcccacagcccaccctgtcccccaagtatatatgaaatatacatattataataataaactactcttcgtttttctctagttaatctatcttttgttacagggatctgttccaattaagaatttatgagagttgaagaaaaaattatgtttcttcctctaccgttcatagataggaagaaaattgggcatgtcaaggaatgtgagatgttgatgaagccagataattggtttagctagaattagcaaaggaaagtgctggaagaataggaaactacttttagaagttaaatacctgaggtagactagttctggttcaagatgatgagatccaggatgtaggtgtatgactggctgaaatgaagaaacaaagcactgatggtgggtgctacgtggagatggcatttgggtgtccaggcacacggccaggtgccacatctttgagggatgcgagcatcgtgtttaaggagaggaaggaggagagccagagagcaagactggcctacaatgtaaaaatgattttttttgtacttacaggtaatgatttgaaaaccactggttttgcatcactggaggagttagaattcacctgccccgcctgtgggcctagtggagtctgggacttggctgaattttagttattgccatgggggatacttggggttcagtaaaaagataaaagcagtttaaggtattgaagacatgagactttgtttaccatggggtagatatttttggaagtttgggaatggtagcaagctgggtcaggagagataaagcccagatcaaatatgggcaggagaggctcagtgacaggaagaacttgaatttgggcagtagccagcaatgaccaggatgtgaggcatgaaggcttcaagtttctgaaaggaactctggtataaagtattttgtttgttttggtgctacctgacagattggtgaaaagctttaggaagcaatactactgcagataataaaattatggtggggctaggtgctgtggttcatgcctataatcccagcactttgggaggccaatgtgggaggatcacttgaagccagcagttcgtggacaacaaaaagagacccctgtctcacagaaaatttaaaagaattagccagacatagtggcacatggtggtggtcctagctgtttgggaggctgaggtgggaggatcagttgagcccaggagtttgaggctgcagtgagctatgatcttgccactgcacttcagcctagcaacagagtgagaccccatctcagatagatggatagatagatggatggatggtacataagtagtggtgggagaaaatggatagatagataagtagtggtgggagaagctaacatttgtagaattttctatgtggcggcgctgtgataagcacttgatatgactgtttttatttaatctttagaaccaccaaaggaggatgttattatatttaagtttttttaaattgacaaataaaaattacatatatttatcatgtacaacatcttatgaaattcaagtaattaacatatacattacttcagtacttacatttttcaggtgaaaacacttaaaatctactcttttagaaattttaaagaatgcagtacatcgttactaactatagtcactatgttgtgtaagagaaatttattcctcttaactgaaattttgcatcctttgaccgatatcgccccaatcacttccaccccaaccaccccgcagcctctggtaaccaccgttctactctccccacttctatgagttcaacttttttagattctacatataagtgagatcattcaatatttgtctttatgtgcctgatttattttgcttaacattccctccagtttcatccatgttgttgttaataactacatttcctccttttttttttttttaaggctgatcagtactgtattgtttgtatatatcacatttttaaaattcattcttcagttgatggacacctagattgattccttaccttggccattgtgaataatgctgcattatacatgggagtgtatatctttgacatacagatttcccttggatatatatccaagtaataatcccagtaatgggattgctggattatatggtagttctatttttaattttttgggcacctctatactgttttccataatggttttactaacttacattcccaccaacagtgcaaaagttccctattctccacattcttaacaaaacttgctatcagctgggtgcagtggctcacgcctgtaatcccagcactttgggcagctgaggcaggtagatcacctgaggtcaggagttcaagaccagcctggccaatatggcaaaaccccgtctttactaaaaatacaaaaaattacccaggtgtggtggtgggcacctgtagtgccagttactcgggaggctaaggcaggagaattgcttgaacccaggaggtggagattgcagtgagctgagattgccccactgcactccagcctgggcgacagagcgagactccatctcaaacaaacaaacaaaaaccacttgttatctttccttttttttgagactagccattctaacaggtgtgaggtgatacctcattgtggttttaatttgcatttcttcgctgcttagtgatattgatcattttttcatatacctgttggccatttgtatgccttgttttgagaaatgtctattatgatatcctttctttattttaaattgaattatttgtttatttatttatttattgagatggagcattgctctctcaccaggctggagtgcagtggtgcaatctcagctcactgcaacctccgcctcctgggttcaagtggttcccctacctcagcctcccgagtagctgggattacaggcacgtgccaccatgcccagctaatgttttgtattttagtagagatggggtttcaccatgttggccagaatggtctcgatctcctgacctcatgatctgcctgccttggcctaccaaagtgctaggattacaggcgtgagccaccacatccggccaagttttttgttttcttattaccgagttgttttagttccttatatattttggatattaactcgttataagatgaatggtttgcacatattttctcccattctgtaatgtgtttctttgtttattgtttctttggctgtgcagaagctttttcatttgctgtaatctcatttttctgtctttgcttttcttacttgtgcttttggagtcatatccaaaaaatcattgcccagtccaaagtcaagaaacttttccttacattttctttagtagctttataatattaggtcttacgtgtaagtctttaatccagtttgagttgatttttgtatatggtgtgagataagggtctaatatcattcttctttatgtggatatccagtttttcagacatcatttattgaagagactgttctttctccattgtgtgttattggcatctttgtcaaatatcaattgaccataaatgcatggtttatttctgggctctctgttgttccactggtctgtctgttttcgtgtcagtaccatgctgtttttattactatagatttgtagtatattttgaagtcaggtggagtgtgacgcttccaggtttgttcattttgctcaagattgctttgactatttggggtcttttgtggttccattcaaattgaaggattgtttcttctatttctgtgcgaagtgtcatgagaattttgatagggattgcattgaatctgtagattgctttggctagtatggacattttaacagtgttaattcttcaaattcatgaatgaacatgggatatctatccatttattcatgactaatttctttcatcagtgttttcagtataaaggtcttttatctccttggttaaatttattactaagtcttttttttaagctattgttaatgggattgctttcttgatttctgttttggataggttgttgttattatgtaagttttaaagatgaagaaagtgaggccaggtgcggtggctcacgcctgtaatcccagcagtttgggaggccgaagcgggtgaatcacccgaggtcaggagttcaagaccagcctggccaacatggtgaaaccctgtctccactaaaaatacagaaattgccagatatgttagcacatgcctgtagtcccagctacttgggaggctgaggcaggagaatcacttgaacccgggaggtggaggttgcagtgagccgagatggtgccactgcactccatgctgagcgacagagtgagactccgtcttaaaaaaaaaaaaagaaagaaaatggattttaggagattatgtgagtagtctgggtcattcatttcattaactgttggaattaagatttaaactgaggcagcatgaattgaaaccctctctgattatcactacattgcctccgggttttgaagggaggtagcttgattactttctagaatctgacctgaatgtgaaaccattaacctgtcattggtggaagattcaggctgttctgctgaacacacagatttcagatcagggattatgaatgacaactgaagacttaaacaatttttagcatttaacttattttttattttaattttggttgcatagtatcatgaaaagtctgatatactagtggctaatggtaacagtattttaaaaaataccttaaattgctataagaggatgatgttcagtttattggaagtagcaggaaaagctgaaaatggaggagttagaattcacctgccctgcttgtgggcctagtggagtctggaacttggcttaatctttgatattttaaagcttggttcataacatttgcatatgcattgtaaaattatatgaatataccttggaatatgcattttaaaattatcgctttttaatagtgtgtgtatgtataacagtctgaaattgtatttgtaacaatctgaaattcatctattggaaacttatttaacaagaatacattattttctcttgacatttaggctattttcagacctctaaactcctttaacatccttcctctggtaaaactgtgtagcacttgaacctgttaagctggtatcttgtagttgaactttactgacttccctagttaacaggtaatgcttttgtaactgactggcatggaattagcagaaaacagtcccacacaaccccagctatctaccatttctatctgtcattatacatactatctaggtggctcttgaattgtaagggttccccaaaacagttgattttataatttttaaagggttatagagaccaagaggctcaactttttcttttcttttatttctttttttgttttgttttgttttgttttgtttttgattttaagggcctcactctgttgtccaggctggagcgcagtggcgtgatcatggctcactacagcctcaacctcctagactcaggcgatctgcctcggctagtagctgggactatatgggcacatgctattatgccaggctaattttttttttaatagagacagggtctcactatgttgcccagcctggtcttgaacacctaggctcaagtgatcctctcattttggcctcccaatgtgctgggattacaagcgtgagccaccgtgcctggcctcaactttttcattcacagtttcctagattagcttctctgaaccgttgcgatcgtagattttcattagtttaaggcagcaaatttaaaaaacttattcttttattcctctctatggggaagagagttaagaaaataataaagtcaaggttttacttctccctttttcagaaagaataacaataactacaacaataacatagctcatctgtattatgcatttgcggactatgggccaggcattacactgtgctaatgttgttgaattctcacaacatggtataattatcatcatcattttacaagtaagggaatgggcttaaagcagttaagtaacttgagcatgtaaatggtggacatgggacttaaactcttgggatgtgccagaaaggtactgtagcataattttggaccagaatatcattggaacttgggccaaagaatattggtaaattttatgctgttttttgtcacataaaaaaaaaagaaatttcttctatgtgtactatatgatgtgttcatgtgcagagttcttttccatgctctggagtttggcacagattcctggcaaagattattaaaattgagacagtttgttccgcttttaaatcctgaccatttgtcaagcagagtgtctcagactatggctgagagtgaagctccatggggcatggcagcctctgctgaacactggagaaggagtgtgtgaggccccccatcatttccaacaagtgaagtcaggggctgcgaggcctggcaagggctttcactgccacagccttcctgccccgggtccctggattggctgtgcctctggctctgtggcagctgggaggaataaagggcttcctgtctgagcctggcactaccacatgtaacaggttttctttggagtttttttttaattctctactttcagttgcttgactctgcctattgtgaccttctgtgttgtgtttatagtctgttagtaaaactttagactgaaaagggtcctaaacgttatctgcttctgcctcctcctcattttatagataaggaagttgacttacaaacatgaaatgaattattcaaacctatgagactaggaaccaggtctagaagcctgtctcatgactctggtcaagtgatattttccctgtgacagaatgatttgttcttcatatgccttgcttcccatctctgacttgctcattctgattctggcgtgcagcctgtcttgttgatcccttggctttgcgtcttgcactgattgagggaacagttgttggtggtgttaatctcagctttggaattactgtgtgacccctggtaaagtcactttgtgccttaatataattatcagcagattaagtaggacccttatcaaagagatgcttttgggagaatgtaaatcatggaaacttgtgacttgttttatcattattcagtggaagagacttttagaaaacttcatgaaaacaaaatacaggagaaaaaaatcagttgataaaggtttcaggttgagcaagccaagcaaggactcatgagaaaattagaacttctggccaaattgttatataggagagaatactatttctttcattgttctttacacagaatacctgttggatcaaattctgctctgcaggtggtagtatagagtaatttataggttttacctctgatctacttgaacttggaaaacacctccttaagttgtattaacaaatctgattaggaaagaagaacgtagaattttcaatactgtagagttttggtttagtaaaaagagaataaatgcttttaaattggacacaaatgagttaaatctgactttttcaatctgttgttaacctctttgaaactcagatttcctatatgtaaaatggataaaatttatttatttcctatatgtaaaatggggaaaatttataagggagaggtatgagggctaaataaaaataattatatagaatagctaatggtttgataactttctacatgtggcacattctcttaagtgctgtacacatgttatctcattcaaatctcttaacaatctcatgaagcgggaattgttattatcctaatcttagattttggaaagtgcttggcacatagtaggttcttaatctgagttagcttccttccttcctaaaggtttaacactttctgttatatctagatatctgatatccatgttactggagagtcagaggatatgtctgcaaaagagagattgctactctggacgcagcaggcaacagagggttatgctggaattcggtgtgaaaatttcactacctgctggagagatggaaaattatttaatgccatcattcataaatacaggtatggaatttgtgtattttttccttatacaactgtaagacacatttctttcatctctgaattttaaaattatcttttattattatagaagcaaaagcatggcaaaaaattagaaaatacagaaaaattaaaataaaaaattggccaggtgcagtggcccatgcctgtaatcccaggacttagggaagccaaagtgggtagattgcttgagcctgggagttcgagaacagccttggcaaaagggtaaaaccctctctctacaaaaaaatacaaaaaattagcttggcatggtggcaagcacctgtatttccagctactccggaggccaaggctgcggtgagctgtgatcatgtgactgcactgcagcctgagtcacagggtgagactctggcttaagaaaataaaaaaaaaaatttaaaaatcacatttccactacttagaggccatgattctgaattgtagcttatacacacacacacacacacacacacacacacacacacacacgcacgggcgctcgcacacacagctgtaatatgtcttcggatgttgtcagtaacttcgcagatagcagactttgattttgcctctaaagaactgctgagtttgaaggttagagtttagtttggacttgtagcccacaagtttccagttcatatctcctagtctaattactctagtgagtgggcttaacaattgccagttttggggtggtaaatagtttcctggtgagcattattaacagctaaatccacgctaatacttacatagcacttactaagtgccagacactgttctaagcagtttacatatattaattcattttctcctcacaacatccctattgtcatcccagtaaacagacagaaactgagacccagtaaatacttggcttgcagtcatacagccagcgagtggcagacttggaactcaaacctaggcaatctggctcttgagttcatgttcttattgccttataagaagctaaatccccggaaagtatttattgaaaattatatactactttttctttttttttttttttgagatgaagtcttgcactatcacccaggctagagtgcagtggcatgatctcagctcactgcagcctccacctcccaggttcaagcgattctcctgcctcagcctcctgagaagctgggactacaggcatatgccaccacacccggctaatttttgtatttttagtagagatggggtttcaccattttggccaggctggtcttgaactcctgacctcaggtgatcccctcaccttggcctcccaaagtgctaggattacaggctgaaaactatatatttctttacctcagtttttttttttttttttttggttttacaaatattatgtcaggttgttgaataacttgctatatttctaaagctatgacatcattaaattataaactatatataaactataaagtcattaaactaaccaatttatttgattacaataaaaataattatataggatagttaatggtttgattactttctcgttctcttaaatgctatactcgtgttctctcattcaaatctcctgacaatctcataaagcaggaattgttattatccagcttttacagataaggaaccttaggtttaccaagtttatactgctaataagttagagaattaagactcaaaaccagctctgtttgatttgacatcccgttctcttcctctctttcctctttcttccttcctttcacttctcttttctctccccttttctttctccctttttattttggaaatttcaatgtctaaaaactgtaatgaatcctccacatacacacactcaggagcccctatttttattttatttaattaattaattaattttttgagacggaattttgttcttgttgccccggctagagtgcaatggcatgatctcagctcactgcaacctctgcctcccaggttcaagtgattctcctgcctcagcctctcaagtagctgggattacaggtgcctgccaccactcccggctaatttttttaaattttttaaaatttttttttatttatttttagtagagacaggatttcaccatgtcagccaggctggtcttgaactccttacctcaggtgatccgcctacctcagcctcccagtgtgctaggattacaggcatgagccaccgtgcttggctgcgtgagccaccatgcctggcccctattttaaaatactataattgtatccttcctttgtggaacaacatttaaatagaggtgggtgtaggttgctgaatcgaaaagaaaaaccaggatcaacttgcctacacttgtttaaagcaccagatcttcttgagtgaaggtttagtggctgtagacacagccatcatcatattacactttccaggtgacttagaatgagaggccatgagaaggctgtgcagctggacacattctatacttggaatgatagaatctttgtggcctttaattaaaatatttcaattgtgatacctaaagtatttgtaacagtgcatctttgagggtgtgttctgctctctcctttgaagttttttaggcagaagcaaaatatgggatccagctattcttctaaaataacctacttttggcagggaggatgaggccggaggattgcttgaggccaggaatttgagaccaacctagacaatatagcaagaccccatctctaaaaaaataaaatagattagaaaaacccctacttttaaaaacaatggcctctggacattgtctctgtggtactcatgaataattataagtacaaattggtgtatgtgtgtgtgtgtgtgtatatatatatatatataatgcatttttctcctaagtacttaaatatttcattttgtgtgtcagagatcctaaaatttcctacaaaagcttgatgtcatagagctcttactgctttaggtgagaatttgagtctttgaattatttgttttgaacttttattttggcagaaatacctttttagaacaatgtttagctttaacttaggactttggttttcctagtttgctttattttcctttgttaaggttcgtggttaaaataccatatatcaggtttaaatgcttacaagatttctttgttgctgaaattctgtcgttgtcctgtggcttataaaatattattgtggtttctttcactagaagaaacttttcatctgtagaacttcgtttttagttgaagtcattgagcctttctttacttgaaaagaaaattaagtacttttcttccagcatatgaaaaaattaaatgaagagagttgaattgtgtgtatttctcactgttgaatgccttgatttattctaaaagaaaaaagagacaaaattataaacaatcaaaatatcaccatgagcaaattttttggtattggacaataataatcacatttagagagtaatgtcttggctgggtgccctggctcacgcctataatcccagcactttgggaagctgaggcaggaggattgctggagctcaggagttggagaccagcctgggcagcacaccaagaccccatctctacaaaaaatttaaaaattagccaggcatggtggcatacacctgtagagattttagaattagaatttagaattttctttggagtttttttttttaattctctactttcagttgcttgactctgcctattgtgacctctgacttctgtgttgtatttgtagtctgttagtacagctttagactaaaaagggtcctaaacgttacctgcttctgcctccacctcattttcttcttgggagtctgaggtgggtggatagcttgagtccaggaggtcgaggctgcagtgagttgtgactgtgtcactgcaccccagggtaggtgacagagcaagaccctgtctcaaaaaaaaaaaaaaaagagtagttttttacttaataattgtttttacttgataattattcccataagttttgtgctgtatttggatttgttgtggaaaatgtccattttattgggctttattttttgtatctagatcaaacatttatatggattttacttggctttgtcaataaaaattatctgaggtggcacagtgggtttggtttctgttggttgctgtagtggatgaaaagagggatgtggttatccctatgtagcaaatttgcatactcaagatagaataggaaatttttctccagagattagaaggaaaatatattttttacttaaaagcaaaccagtattatatgtgataggtgacttagtaagatttttggtgcatatcttctaaagatttagaaatattgatctgaaataggaacagagcaatagcatccttcacattttttattaatataaattatactgttataagttattaatcaaatatattaatttggattgtccagcacatttttattagtgtttccatatagaatatgactcttgaaaataaaaagaatgtttgttagccccataaagagtatttgttttactaacaattcagtatcctaaaattttccgtagaaaatataattttctaattgtcatgtttcttgagagaattaatatgtgaaataacagtgaagagaaatttttataataagtgtaatttatagatgttacagaataaaaatgatccatgaagttaaaaagtaagtaacagtcacaaagtagttacctaagaaatacatgtatcatgttggccatgtggcagtttctgtcctagctgttttttaatgtgttagcttttaaaattaccacaatcctgtgaaatagattgtgactccatttttaaaacaatttcaacttttattttagattctaggggtatatgtgcaggtttgttacttgggtatattgcatgatgctgaggtttagggtacaactggtcctgtcacccacgtagtgagcatcacacctaataagtagttttcagcccttgcccccaccccatagtagtccccagtgtctggttgttgccgtctttatggcatgacttcatttttatcaataaagaaactgaggctcaaagagtaactcatatttttgacatcacataccttttacataacggaggtggttgctctgaattctcatcttcatatacttccatgtaactacttacataatttcctttaggcaaactagatttaaagaaatggaactgttgatcagaacaactgtgatagcgcattcttgaagctcaatgatattttcagcaaagatatatgaaaattatcgatgaacttaagaaatgactaaatgaatagtgccatatacaactgacaactaaagtctttgccccttgtaagaaattaatgagggtttaatttagttgtttaactaattagttaccaaaattatttaaccttaattaatgagggtttaatgaagttgtttaacttagagttagccttagagtttaacttggaattagctacctatgaaaatagcatcagcaacaactcataacaacttaaggaaaattatggataatgaaagaacttaagatttttagaacgagtaagagcaaaatcacagcgaaattaagcagttttagtatgtcacattatcctaaagaggatgaagagcctggattatgtaatggggtagtaagaatgacaaagttatatgatttagtggaagagattgcaagggatagttctatagcttctatttaaataggtcactgataaatacattatgtctttctgttaaatctgtattaggaaattctgttcataattccttctaggaatttctgtgtgttatgttcagttttcagtggaaaagtttcaaataataaaaatactacatacctatactagtttctgcttgttctgtttgtatactttaactttttttagaatataatacaaccttattgctaaaaaccacaactggtaagatatcttgggtaaataagccttactattgcccctaaccttaccttaattttcaatcaaaagactaacaaagaatactggatttgatgaacttagatcaaaaggttgtcacaaaaacatctggtgtgtaaggagattaaaagcaagagaggataaagtagaattaaccaagagccaataggcaagggatcctaggagtatcctttaaacactagtggattaataagtcaccaagagttagggttgatatagaggaatgaaatcccagacagtagtgcttgttcctcagaggtaggtgttacaaacagagggttcagctctcctcttatttaagggtttgccgaggcatcacagtaaaattgacttctttttgagagaggtaaagctctgacttccagcttgaaatttagcctctgacttgtctggcttctctcattctctccaagtagatatctgccttagaacattaatgaaagccaaattccaaaacagcagtgcctaacattgctctgtgtgcaaacaagtctgcctgagcaggcatgaacatgaatatgtacctgaaggccagagagaacagtgcagaatgtgcaggagggctttgcaaatctgaggtggctctatggaaagacactaagtatgtcaagactaaaactagaggtgtgtgtgtttgaagagattatttctgcttactagtttctgcctgtcttatgcttgtttttaatttatctcattcatttatttaaattgcctttaaaaaataaaaataaaaaagctaaacataaataaataaataattttccttttaatgtccctggcagtcttttcataggtttgttttaaatatgttagccaattaagactcaaaattttgggaataggttgtatgcaggagcaaagcagtcaaatgttttctaattaagcagccaggaacttttcacttgtctgagtatgtagttggatagcaattattttgtccattgtttgcattttgaatgagaatataatagggccatcatatttcattatattaaagtttaaagatgctgtaattgtgaaggttagattgtaaagctgtggtcagagtcatcttgtttaatagcatgacctggaggccggtgattcagtcacatgcgtgaattcagtcacaccttagaagctaaactggattggactggtttaataccgggaggaggccctttagggtttgaaatgttcccataggaagttggcttagtgttgacttagccttcaggctgcagaatccagaggtatgagggtgtatgtatgtgtgtgcatacacatggccatgggctgtagtttggccacaagccagacacacacagagcctgaaagttatcaattaaaaagtagttaacagtatttcagcttgtgtagaaaaaatcaaattgcttatttaccttgccaagtgaactcaaaatgattgaactttgagaacagaaatggatgacttctaaccattatcacattttaaaattcttagagttaatgtacactgcttataatgtagtgcgtctgcatccaagtgaggtgtaagagttagtgtctacatctggtgaccatttttattgtatctatatggttttacctacagtttgggagatgtaatttggcatgtaatatttggaggaaatatctgaatatattactttctttttatgttcctggccttcttgcctagattaatttacagaaattctctgtaatatgaagcctcccattactgtgtgttttgttttgtttctttgttttgttttgttctgttttgttttgttttgagatggagtcttgctctgtcacccaggctggagtgcagtggtgcgatcttggctcactgcaacctccacctcccgggttcaagcaattctcctgcctcagcctcctgagtagttgggactacaggcatgacccccccgcccccatgcccaactaattttgttgtatttttagtagagacagggtttcaccattttggttgggctgttctcaaactcctgacctcaaatgatccacctgccttggcctcccaaagtgctgggattacaggcatcagccacctcgcccggccaaaaaagatctttatagatgtgatgtaaggtatagcccacattctcctacttccatttttgaagcagaaaactgaaaaagtgacacagccacggtaggaagatagctcatctggttgtcctcttcatgggagactggcaaacctagttgcaatttctacagcaggcacttgttaccacagtcctactttttcttgtatctgtgatttttaaaaaataccatatggtattctattgtatgtgtataacattttgtttagagtgccttattgatggatattatgttgttttttgcttttaaaactgttgtactgaactttgtatgtgtctttgtgaggcatgtgaatatatccataggataaggtcctggaagtggaattgctgggacaaagggtattacatttaaaattttgagacgtacttctgaattgtctgccaaaagagttgtactgatgcatacctcttctgcactgtttcccctccatgatgcctttgagaaagaaacacttcttaacttgttaattaccttttagcaggtctaagccccactcttttttttctattctttcttttactttgccctttcattcataaaattatttcttttcagcttttaaagatgtgcccgtgatgaaattgaaggcctatgtttcactcagtttgatgtgcaagctgttagtctaagcatgcatgtattacgagtttagggggaaaagtgacgaagtaagttgacaaatttcagtgatgtgatcatttaaaaagttagagggtcggccgggcgcggtgactcacacctgtaatcccagcactttgggaggccaaggcgggcggatcacccgaggtcaggagttcaagaccatcctggccaacatggagaaacggcggctctactaaaaatacaaaaagttagccaggcctggtggcaggtgcctgtaatcccagctactcaggaggctgaggcaggggaatcgcttgaacctgggaggcggaggttgcagtgagctgagatggcaccattgcactccagcctgggcaacaagagtgaaactcagcctcaaaaaaaaaaaaactgttagagtggggctgtcttgagttagcttatgagagtgcctatcactctcctagagatttaggaagtatgtaatcaacatgagtttcccctccccccgcatgctgccactgatccactaacaatagggctgtaaagcttgagggaagatgggttttgatcaaaactctccttacttagaaacttgacaagtcctgcctttgtcatgtttccctttagcattctcttacctttctctcacatgaagatttcttttacattacaggagcagccggtatatgtaactctatctgtttttctttgataggttcatctatttgttttaacacttcttgtattttgacttgattattcacattatcatcttagcctgtgatatgaagtagtttgagatttagttttctaccataataaaaataaattgattcccactaccccctttttggggagggtgtatttatccttattagtcactaaagtttacttaaattttccttttattcactaaaatataggtactggaggagttacttctctatcaacatcaataccattctctgtattcattaaaatttaggctgttaatgggattgattgttctttgtgaagtgagaaagtcataattcattagatatgttttaattattgaatttgttagactctaaccttgaagtactaactaagcttgctataaatatactgtttctcatctttgctgtctaccttgttgttaatggagagtcactttgtagaaaaaaatatactgtttctcatctttgctgtctaccttgttgttaatggagagtcactttgtagaaaaaaaaaaaagaatgtttgaaaaaactcaggcacctagttttgagaacaagggaaaattaccttcatagcttgttgctaatctgtgcccaaatatgagcatgaagggatgtctacactgagttacgcaggcctttttttttttttctttttttttttttggtgattgcaaggtgaggtgctttttgcaccaataagaacagtaaggacatgctaagtctgagcatgatttaatcgaaacagtcatcttcaggaatttgttacggtaacttctctgctatcataggataagtgaggcatatgatcttttgaaaagcagatgttaagtggcatatgtgtcttcagtcacctctgtgtgggttgttctgtagtatagagggtgttctaaaaatgatctttaggaatggagtgaggcttgtttttgtttttgttttgttttacacttccacacaatcccttttcaattccttgcaaactgctgagtatgtactattttgccagcaaaggctgagcctgtatgaacccagccatgtgctttgtctgtgcatgtccccacacaggaagcacaccagagaaagcgatacttcagggtagattgatttcattagaacttcattatcaccagcctcaaatggttctggccagcagtctttttctatctgtatgattaacccttctcttcctcacagcacctcctcccaccaccttttctcagtgttaacaggtgatctagactcctactctcagagaaaattgaagccaacaagtagaaagtcttttttgctaccaaagacacaaacctatcttcttctgcatccatcctcacccccgctgctgctgttcaacacaggagtcctctctccacctacccaaagcctgtcccctcctgctgtgccctggatcttatctctgtcattgccttagaaacctttcttgtatatattcatctttttccttcaatagatctttcttattggattttaagcatgttgcagcctcttctgttaataaaacaacaatcaacaaaaacactctcccttaactgcatgctttattccagctactaccttatatcattcctttccttcaaggccaaagtcctcagaagaggtggcaatatcctccatcatttcttcacttcatactcattcttcaacacatactaatctagtctcttaccccataattcattaaaacacttattcttgggtcatgggtgacttctgtatagctaaatccagtggatatttttcaggcctcctcttccttacattttagtatttcaccctattggccattcttttcttcttgaaatactctctcctttagcttttatgacactgtactcctggtttttctcccacttcttgtctgctcctgcttagttccctctgtaaacttggcctctttcacaaggccagtaaacactcgagtttttcaagattgcctgttggactttttcttttctctctgtgttgtctctcatccatgcttacagccctaattactataaccattgtcatataactgggttctgtagatttgactttctcaatatctcctgacttggccactttttatccactgctgccacattcttctgcaagccaccatagccacttaactggattctgtgggagttctttgaccatttaaatttttttctctgtccacccccagatctgatcatttaatctcttctaatcctccttaatgcattttgatggcttttcatagctattggggaaaaagtttacaatcctttaagacgttcatgagagtctgcattgtcttggccctttgccacacatccagagccatgtcttaccatgttcccctggctgctggctccccactcatgcactggtctccttgtagtcctgtgcccttcaaccacagacctatgcatgccttttttcatcacctgagtgctcttccaccaggttttctcctggtttactcctgagctccctttggagctctgagctctccatatgcacagtggctgttctcagtgccttacttcctggaacatggtaaatgcatattaaatattgagtgaatgaataaatgaatgaacttgctagttttttgactgggaagaattatttctatgtagcataccaaagcatcaggttgtcttctccgattacccttttatggtgttgtttttatgctgatagatacgttttggtaacctgcgcacattgccctttatactaagtttcacaactactttcacgtaaatctcttgagatcttgggtaaatcagttgagttctttgaaccttatgctataaccagcccataatgtcccccctcccatactcatacacatttccagatgctctgtacgtgatttttgttctaacttctgtaattcttgatactcattttctgcagaaagaactgagacacaggttgcaggatgtgtgtccaaagtcagagagcaaattaggactaaatcacaggacacctgactcacagctctgtgctttgtgtgtgtgttccacctcaatttaggcttttctctcaaatatgtaaaaactgttttttaaaaatttaaagaattcctagctactcgggaggctgggctgaggcaggaggatcgcttgaacccaggaggcgggggttgcagtgagccgagattgcgccactgcactccagcctggcgacagagtgagactccatgtcaaaaaaaaagaattacggccaggcgcagtgtctcatgcctataataccagcagttgggggggccgaggcgagtggatcacttgaggtcaggggttcgagaccagcctggccaacatggcgaaaccccgtctttactaaaaatacaaaaattagctgggcatggtggtaggtgcctgtaatcccaactacttgggaggctgaggcaggagaattgctagaacctgggaggctgaggttgcagtgagctgagattgcaccactgcactccagggtggatgacagagtgagactcttgtctcaaaaaaaataaataataaaaaaattagattgtgataaggtgcataaaatttaccatcttaatcagttttaagttgatagttaagtggcattaagtacatttactttgttgtacaaccatcaccgccatccatctccagagctcttttcatccagtgtaactgaagctgtgtacccgtgaaactctaattccccatttctctctccccccacccgttgacaaccaccattcttctttctgtcttgtctttcctttttaaattgaggaaggaaactgtggtccagtgttttttcaagtgatcagatatctcaagtcacaaagtttaggtgggttttttattctgattaaaaaaaatatatgtgaccaaatgctatcttttccaggcttcattattttacagtgtactccagagttgggcaaacataaaatgacatgcccaccctccctccttgctaacatttaaatgtgttcttttcttgtatatttaataaaaataaacactgaaaaagagttaaaaggttcactgtctcctgctgagggcataaggcagtagcatgtttctgcttgtgggtgcttttgtttgtgtcgttatataattgcctgatgacattgtggatgttttttccccaatacaaaatgcttataatcttgaaaagaaattaaataattattagaaagaagggtttttaacatggtttagttatcaaacttgcctgatacgaatcacctgagggaggggggagaaacttgttaaaatgcagataaccaggcctttctttctattcttaatctgtattaggacccaagtgtgggaaacattggtataggacacattgatgagttctgttttggtaataatctggaacttcagcatgtttcttatgatttattttttctgagtatgtcaatacacacacatacatatacatatacattattgtgtttctttatgggggttaccaatatcattatcattttgcccagtagtagaagtataatttgttctgtattttctttattatgtattctcagcttcatatggggtgttactgtttagttagttctcagtttatgataccaggatattgcagagaagaaatcaggctctgtagtcagacagacctgggttgaaaccctgactgccacttaccagatttgtgttcttggtcaagttatataacttccttatgctttggtgtttttccatctgtaaattcaggataataacacaacctactgcttagggtcaattgagatgattaagtgagataatgctttaagtcctttaatgcattgcctgccacatagtaggtatcagtatttattagtccctgttgttgttttgtgattgttattactttataaggtatcccaattggcaacattatcagaagctgaagctgagggcacatgagagcataagaagggaggagaacctagaagcagcaacatgtgctttttgaaacttttatacttcaccgctgtttgttgtcctcacttcgtgcctgctttccaaattgttttttaggagagacaaagcctttaggaaacctcgaaagggtgtgtgcttgtttaggattatggggaagctatgacattgtaccctggtccatgtggatttcgataaggattctaaaacttggctggaagccatagatggtggttttgtcagtagaaattagtgaaaagaaaaggaacaagcctaggatggaacatatctccaggaatttgaaacactgatatgtcccagtccccatagctcatgtttttctttattatttatttaatcctcaaaagttaatgttttaagcattatgctagatattgaggatataaacatggacaaaacacaggctctgccttcaggaagcccatggttcaatatgagagataggcagatatatagttatgaaaaatgtggtaaatacagaaatgaagataacagacggcatttgggaacagaggaaagtacttcctggaggaaatggtggtggaaccgagtctgctgaaagaattcgagttggccaggtaatgtcatgtacgggggtgaggtatgcagtggacatttcttgagcaaataaaagagtcaggaaaaacctgacatatttctgtttttgtactgggaaatgggctttgctcttctccttacccccaagacttatgaaagggaaatttctcaaatataggaaagcagatgcagggtagccagaaccttactgtttgtatccacataaataattattgagtgccagctgaaagccagcacaaccagcagactctgaatttaagtcactttattttttcatccttaaaaaaatcccgatttggactgtggccattgatatttcccatatgtgtcttttcagctattgtcacatttttggttcaggatttggtaatgttgtgtctgcactaaagcactcttctcttagctggcatttttctttctcttagttaactttaattagtgtcctctctgccatgtttctaagtacttcctttccaagtactttgatgttgtttcatgctccttgcagttgagtgtattggtgtttgccatgatatattgtggaagccttcagtggtctgttgtgctaatctttttttttttttttttttttttgaggcaaagtctcgctctgtcacccaggctgggatgcaatggcgcgatctcggctcactgcaacctccgcctcctgggttccagtgattctcctgcctcaccctcccgagtagctggggttacaggcacccgacaccatgcctggctaagttttgtatttttagtggagacagggtttcaccatattggccaggctggtctggaattcctgacctcaggtgatcctcccatctcggcctccaaaagtgctgggattacaggcatgagccactgcgcccagcctgatctttagccatttatatcactgtagaagtcatatgttcctgcagaatcctatctaattctcatgtgagctaatgtattaataaagttttggagtactgaaatgttaccttggaggtatctatgccaaaaaaatctctcatgcaatttttatgttcagctagctttggctacctgttaatgtaggtggtgatatccttatactatatccatatatctatctatctatacataaatgccaacatacctgtatatgtatatatacgtgtggagatatatatatatatatatagcctaggggagattgctcttttaagatgggtgttgtatgaaagataaacattacttttatccaaaattattttgtattatgacaatagcatttttctatacctctctgccctatatttttaaacaaattcagggcaccaagcttgcatataagtgatttgcaatttttagtctcacttccaatttcattttaaggccttttcttggttttatacttctaatttaaagtttatgctatcttgtattttctttgtaagctacttttaattgcttatgaaagaaaagctgggataaagctgggatataaacatgtttaaagattataatgtatgataattgggtcattttgaaacattaacattatcatagaataataaaaaaaataagagaatggcctttttttccataaaaagactagcatttattactttaagtggcaaaggatcacattatatgattttgaaaggtttccataaaacaggcaagttacaatagttaatgttcaactatctaaaatataacatgagaacatggtcactataatatagtctaatgctctttggttagtcaaacctaagatggaaatgacatttcctgttaacattccacaaaaagatgttacgaagaaatgaaacctttagaatgaaagtaagtatcttctatgtgtgaaaaataaatgaagtttttaaaggttgtgttatcccagtgagactatgaagaaagaaggtggtggacaggacacacacagcacaggcgtcttctggatgcttcaggcaggtagaggaaagacagatttgaaagacaaagggaccaccactctgttaggatatgagctaagggaggaatagcattttaaattttataggctattactttttcatagtggttttttgtgtttttttgagatggagtttcgctcttgttgtccaggctggagtgcagtggcatgatctcggctcactgcaacctctgcctcctgggttcaagtgatcctcctgcctcagcctcccgagtagctgggattacaggcgcctgccatcacgcctggctaatttttgcatttttagtagagacagggtttcgccatgttggtcaggctggtgtcaaactccagacctcaggtgatctgccctcttcagcctcccaaatgctgggattataggtatgagccaccgcacccagctttgtagtggtttttaaagttttcccttttcccattttttgtttaactaattttctttatctgctgtcttttagtggaggaaaaccatttcagtttttgttccattaaagtgttaaacatcatgataaaagagatgacttactcagactcattgtattctacagctgcttttgtgttgaaatgactatgtcattctgaaggaagttttatgttttattctcttagctgaaaaacttgattcttcaatgactttattcattccctctaggattactcagtgtttactttctttgctaatggcagggttctcataataacatgccatgtcttgttctgagatttggcagacttacaaagtctgttttttatttccctaaaaggtgcaaattttacggaaacaaaacgattttttattgaaagaacttcagatatttgtttttgtctagactgctatacatacctgtttactaatcttgaggttggcagattcttcagatgtttctatgtgaataaaaaatgttacttttggaggtctgttatttacttccatagttgtcaatggatttattgttcctataataattgtagggtcacttttaaaagagtggtcatattggtggcaggttgaaaacattaaaggatttcctaataatttcctggaatatgagcatgtaggtgatggtaaccacattcccaggttatgaacagtgcaaagtgatataaaagtataagattttcttgaaaggtctgttttctcaccataaaagagtacaaattgccacttagctttctaatattaatgatatattttcaaacagcttttcatataagcagcctgccaagtagtatacaaaataatctgcatttcatttctcccacactacctttgagccctcccactctttctgtggtttcccaaatgattattttgagcaaacaggaatgcttgtggagcttgtagagagcctttctttgtaagctatcaacaggttcttactcagtgatttttttgggtggtgagtaccactctttgaaggctttcctgtttccacattgttccggtagtctttcaatgctttgtttttgagatccaagtttcctgactggcttctagccttgagtgaagtctccaatgtccatattttgccactttctctacaagaagcatttgaagaatcttttcctctctcatgtagatagagctagcttcaaagtttctgcatggtttagggtgttacgtaaatctcacaaattataaagatatgaagtctgggatgtgtgactgtgtgtgtgtgtaggggggcacatgcacacatgtgtgctcatgaaaacataaactattgcttattatagacattcatttatgattcagattactaaggaaccaacctacttaccaacttatcagtagatatttgttgagggtgtactatatatcattctttattacagcagaaggataaaatacaaaattttcttaatacatagtacttgctatcttggagttgacggtttgggagaaacaacatatacatgtacacgaaccagtgaattaatagggcaaggagtctaagattatcctaagtgccatatcgtggggtgcaggctggaagtatgagttcaggaaacagagacagaaataagggctaggaagatcagccaggctccatagaggaggtggagcttgatctctccttggaagaatgactaggattatagaagacaaagatgatgtgaaagggtatggtgcaatggggaggccatggacacagcactgaattaagctacaagctttttgtcttagaggaaaaacattgacaggatgctggttggattggaaagatgctgttggagtagcgtagcttaaatcagttgaataggacaaatactcatatatattctgactatgatatatttgtagactttgttgaaatttatatatgttcaaattgttatattttcattgttatatttgctttcgatacagaagtttctgagataagtgagcaatgttaaatgtttgatgaaagtctctgcattttaacgcaggcttggtgttaatattagcagatgttgttatgtaaatggaaacctatataattatataatgttgaattggcacatgagaaaacctaattaacacagtgaattttttcctaggccggacctgatagatatgaatactgttgctgttcaaagcaaccttgcaaatttagagcatgctttttacgtagcagaaaaaattggtgttataagacttctggaccctgaaggtgagttattttcttgattatatgtggactggcatgaaagtctgatcaaaagtaatttatcaacattgtgaaataattaatttatgttgctgtttttagatgtcgatgtctcctcacctgatgaaaaatcagtaataacttacgtgtcatctctctatgatgcatttcctaaagtccctgaaggtggggaaggcattggtgcaaatgtgagtattgatttttccacaccggaagctgttgattcagtaatgaccaattgactgcatttattgataatgatttttgcagtttttgaatgttgaatatattttaaagaatttgagttaatatgctgtttgatgaattgatattctatgtatttcatgacattattctaccattaaatttaaagtataactcattaaaacttttgtgtcataaataaaagaggctatttatagttaccgatcatcttataaataaaaggtttaactttctgaaatttagagttttccatttttagctggctgccgttttacattgctgtatttgctattcttttgtatgtatagaatatctcagttttgaaaacaatttcaaatttgttacttcatacgattctatgaaataagttggcttgataacatttttgtgatttaaaggaggactccagaggaaaattattggatttggccaaattagcagagccacttagtaagcagggaaaggtctctgacacatagctttgggctgtttattagtctactatttcttaaaggtttgtgtaactcacttcagtgatgctttttttttttttttttttttttgggtggttatgctaacaagtgcttatgcatttctgaagagaacaggaagcccagtatgtgtcacatatttggggatgatccccttcacttggatttctgccttcctctttgcagacaccttttttcccctacattactttgaagatttaggagctcatctttgattagctcccctggattaggagctcccttttctgattgcttctgtcagttctctgtgctgtttctagacctgtttccatattcttcctcaggttcttcttttcaaaggcttcatgctctttgatccctgagtagcctgttcccatgctcacccctgatgattcaatgttgagcgttgcttcagaatgtttctttggccatctcttgctgctgcttctcccaaccttcatgctgatcctgctgcctattactgcagaactaggccgatagctttcctacagctttctgtctccattttgttcttcttcccactgcctcggcacactgttgccaaattaatctgtctaaaacctgatgtctttggcttgaaaattttcagtgtctacatattccttgcaaagttaaatgcaatctagatattctgacatttaaaactgcaaatatttattctgtttacctacatgttttagctatgatttcccaatatgaactgtttactggtagccaggacatttccatgtcaatgtcctgactcacttgggactccccttttatccactctttcagcacccccactcacctccccccatcaataattacttactggtcattgcagaacatctcagatactgcctttcccaagaagcctttagaaactattttaaggcacagatatgcttgcctgattcttatctcaactagcatgtactacccgttttagttatttcaacatttcaacacttaattaaatactgctcttcattttgcctgtttatattatgtatctctcttgcctctgcatttagacagtaactccttgacaataggtattatatcttaaagtatttttttattataacactcaacacaacctttgaacataataataagcactcatcaaatacttaaacagagcagttggcagccttccaagtttcctccatttttaaagagtttgcctactgagtacttggataatcccaccatatacatttcctgtagtttgtgtacatatctggtttcctatatattgggtaagtcttttgagtttgagatacatagtagatttagatctaaaatagttggcaaagatggcaactaacttggcttatgcaagttgttactgcccaatcttgagccctggtaaacaccccaaattgactttggatttttttctgctgtgcttagattgagccccaaaagccttctaaatacaataccccaggcagccactttctttggatcagaattggcactcataaggctagtgttagtggccaaatgttgatagcaaattttacaggtgtttatgtgacagggattggggctgggtgaaagtaagaaaacatttagctggttctgtctgtcaggcttcaaatacatacatttacagaatgacttctgactaaattgtcttagatatgaatgttattatctacagatgtgaaccttttctatcatttgattgttctaggatgttgaagtcaaatggattgaataccagaatatggtgaactacctcatccaatggattagacaccatgtgaccacaatgtctgagagaacatttcctaataatcctgtagaactgaaggttagtgtcactgtagaaattacataggattgattcaattgtaaacccttaagtaatgctataataattctgtaattttagaagttcaacaaaagttgcccttggaaagccattaataagtaggcaaaatttgtattactcatttctcttattatacagagaaaatggaggtaaaacattaacaattaaaacagattagctgtagtcactcagctttggttgagaggttaaaggtttaatttgagagagtctctgaaactgacattgtcagattgattttagtacatgggaaatgcttgcagcccccgagatggcttgaggtagaagggaccctgggaagtacatacaagtgtggcactggattgggggtgtgcctgtggttgagccctgttaaaaactgcttcttttgtgcaggaagcatcttttgtgcaggaagaggtacacagtatttcaccatgaatttgaaaatacatgtctgacttccagtataagtgaattcatggtttagtaaaacatttgctaatactgaaaaacttagggcaagcttttgaggcaaagacattgcagatataaaagccattataggccgggtgcggtgggtcacacccgtaatcccagcactttgggaggccaagatgggtggatcacctgaggtcaggagtttgagaccagcctggctaacatggtgaaaccccatctctattaaaaatacaaaaatcagcctggcgtggtggcacacacttgtaatcccagttactcaggaggctgaggcaggagaatcgcttgaacctgggaggtggaggttgcagtaagccgagatcgcatcactgcactccatcctgggcgagagagcaagactccgtctcaaaaaaaaaaaaaaacattacaaaaagccattacaaatatgtaaacttattaaagagtaagttgtctcatttgtatatttggttttataatagcaaagtggtctactttatttctagaagctgataatgcgaatattgccgacaaagccttaattctttggtttgtaagctttattttcatgatcaaactgggatagaaaaaactgtaataacctagggtgagctccattagagttattcattgtgctcctgcatccgtacagaatatctgtagaacagctttcattctcattgccacggggagtttgtccttggcacgaaattacttggcatctgatgatatgatactttttaagtgttctcaagctgtttgtgtgatgtttccctacatggacatgtaattttccagggcaggaaaacttttccctacaacgaccatgtggtgccatgaacagtgtttagcacacaggagtattcggtgcttaatgaccaacagacgtcctgaaacattgcattctgatttcaaaaccattttcagatttcatgttcaaatacacttatttccaaatggatttccattgtccagacccttggatgaattgtactggcttctggttagtgtagattcttagttatagaagaagtgatcagagtacttgctgatgactagaacaagacatagattaggaaagaaaatacatcatggggaaatgccagataattgcattagcagaactttgaatggaatccttcagaaatgtgtcatcctaaagatttacagggtcttgttttgtagctgcatgaattacaatgaagtaattagtacatacctattaaatatggagatacattatctacataatttttatgaaggtcccttttaataaatacactgtatttaagaggttcccaaattaatgtatacaaactagatagtaacttaattacacggttgaaacttctgtaataatagccccatcaactaatagcatctaccttcatttgttcaaaaaatctgtttaaatttgccagtgggacattgaaactaaattttagccctttctgctaagaagttttttttttttgaaggatagaaccatgcaatagaagagagtttttttattgctttctttatgggaattgcttcaaattatttttccaaagactgaaagctaaagtgcagcatttgggaagtgcatcttttaaagggtatgttttcttgtttggaggatgagagatttttagtagagcactagtaaacactgaatggtttattattatccagatccccctgtggcactaaatcatggctcacatcaataattacaccctcatcaaattttagataacccacgtcaccagctggctggaaattggtattgtctttgagtgtcggtttaacaaaggaattccactgactgcatatgatacagtacataacacttgaagtggtggcttagtgagatcatgaaaacagatcttttaagtttggtccttaatttcttgtcctttttattttaggcactttataatcagtatttacagtttaaagaaacagaaattccaccaaaggagacagaaaaatcaaaaattaaacgtctatataaattattagaggtaagctcaaatttgctttgtattgtcaagcatagtctttgttttgttttgttttcatttttgcttcacattaaagttttttgttttctcaagatttggatagaatttggacgcatcaagctccttcaaggttatcatccaaatgacatagaaaaagagtgggggaaactcattattgccatgctagagagagagaaggcccttcgtccagaagtagaaaggtaggccagaggtgttttctgccatgaatatcaagtggggagggggcctttgtgttcttgtgaaagaacttaagttaaacctctgtttacttggccttggataagtctcttaatccttttgatcctccattttcttacctagaaactcttctaagagattttaaggaggcaatcagtgaagtaatgtatataaatgaccggctaggctggattggtatgtgaagtctcatctaataaggctttacagttttaaaaccagtcaaaattacttgtaatttctcatattgaccttaagtcaccagggcctggatctaaaagcttataggacaacagctgattttatttcttattacatttttttgctatagttctctttccaaggggcattggaaaccaaaatctagcttgccttcatttaaagggtgttggatggcgtctagaacacactcagtaaatgttagttcaggttccctttctgccacgcttctacaagtggatttactccatgaaatcatcactagttctctgtcattttgtctctcactacatccagttgcccaggaaggtaccatttagtcttcaggaaatgcttgttggatgaatttgtctcccttacagtcttaacctggtacctgggaattgtgatctgtgttcctcattagccatgaagtctataggacctagaccttgcagggtgtattagtccattctcacgctgctaataaagacatatctgagactgggtaatttataaaggaaagaggtttaattgactcacagttacatatgactggagaggcctcacaatcatggtggaaggcgaatgaggagcaaagtcacatcttacatgtcagcaggcaagagcttgtgcaggggaactcccatttacaaaaccgtcagatctcttgagacttattcattaccatgagaacagtatgggggaaatcgcccccgtgattcagttatctccacctggccccacacttgacacatgaggattattacaattcaagatgagatttgggtggggacacaggcaaaccatattacagggtaaggcctgtgtggccagacacacctctccagcccccttgctctctgcacagtagccacactggctgccttacacctaaacattctcagatctcagctccaacattattttctcgagaaactttccatggttccctaggctagttcagatatcttgcttagaactctcatgtttccatgtattgttccttcatagtgcttatcttggttgtatttttatatttatttcggtgattgcttaagtcttgcctattccacagatatgagctccaagaatgtggagagaaacccttgttttttttctgtcccttgcgttgccagtgctttacacagcgcctgacacaacattagaggtgctcagtattgtcatgttctctgtgccttacacattgacttcaggattcaacgttgtgaaataatgcataaaataaatatatgagagcatgtctaacctgtcagtcctttattaaattactgattacatttatgttaaagtataataatatgtgtacataactggattattaaaaccaaaacaagccataaatatacaggatgcagcttttacggaaaaggtaatttgagtgattgaaatgagatactatgttaatcatttgaaataatggaaaagtattccagaggatacagagtagatttttagtcatcagaacagtagctgaattttaagatatgttcataaaagaaagcagagagtggttgagagttcagggcctagaagccactcaattttaaattagattattagctcagcctgcaaagttgtatgatgttagacaagttctttaaccgtctaagcctcagtttcttcatttgtaaacaggatgtaatagtgcctactacattgggtggttatgagtatgagatgagttatgtatctaaaatgattaatttcttgcacataataattacttaataaatgccaggtgccactgttattgttttgagctattctgttcactcactatatttgatgtggcactctcacacttgatcttagccaaaaggccaagaagcaattggtgtggcactctcaaatttcccctttcttgacccctgaaaagaaaaatatctattcttagagtggagaagtaacagtattattggaggtaggaaaatatttaggaggctggttggataaatgccttcatgtttcttcatgcgaattttttggcattgtctatgtattgcgagtaatagctatgtggcatggaagtgtatgaaaaacaaatgggaaagagccagtgttcttatgccatgtaatatcctatagaatggaaaaacaagcacagacaaattaaatttgtaagcattgcatcagtattctacttggcactttatagtaggtttagaagtaacattactgggagcgtgtcatataaagaaaggtaaatggatactttttccattaatttaacctaataaacaaatgacatggtggttaaaatggaagcgtactttgcttctcatcaaattcatttgtttataggtacttcataatttctagctgtttgccttccttacattattcagcacagacctggtcttttgcagaagtcagactatgattggatatttgtgttcttttagctaatgattggtattgccagaataatctttactagttgtcctggacatctgtgaggcatctgagttgttttttaggtggttgcaattggatgactcttagtgcaaatatttggcatatcctttccagtgacgcccaatctgcctgctttgttcatacttgtagggttttaatacaagctacaaaaggcaaacctcagctagcaaacgaatggctttaggctagattcttttgaatagttatcagcatattatttgctgtgtgttgcatatgcatgttgaagcatatttaaggagccactaaaagctgtaatattcagctgccacttttcaccgttagaagtagagctttttccagacctcctaccttttagtctactttgaaaggtgaaagaaagaacatcgtttcaggaataaaaatgcacagtagtagttatagttaccgtagcagtgattctgtgtttagtaacactaccagcactcgaaccagtcttgattcaaatgaaaatcttctcttggttcattgtggtccaacactgatcaactcttgcattagcttcggcagtgaatcctttgatggacacaggtattgaatcattggtgtgggattgtgttttactttttgatgggcagcacttttcaggaatggtgagctctttgacttcaaagggagaagctttattttattttgtctcatcttttaggttagaaatgttgcaacagattgccaacagagttcagagggacagtgtcatctgtgaagacaaactgattcttgctggaaatgctcttcagtctgtaagttaattttaggagccattggggttgtggtagaggagtcactgtgcgtttggatgaactaaaacttttacataatgtttggttgattcttcgtaatactctccactgaaacttaaagtttgttaaagattatgattggtgtttgctctcttgagagacaagaagagggaaaacatatttttgaaccaacaaggaaaactaaagaaagcccaagtaggcttctgttccaatatttgatgttttatatttcaggttgttttgaaacttgtttcacagaattaatactgagttcttttaaaatacaggattctaaaagattagaatcaggagtgcagtttcagaatgaagcagaaattgctgggtatatacttgaatgtgagaaccttttacgccagcatgtaattgatgtacagattcttattgatggaaaatactaccaggcagatcaattggtacagaggtaagagtgctacttattctttctctgtcctttttttgtgtaactgtttcatgggcatttgaaataggaatgtagagtatgaaaattttatgaaatatatttctttgctgttttttagttgaaaatgtgtgtcacatttttatatattttggtgtttaagtaggtacttgtcttttaaagattagcaatagaaaaaatattttatggtgcgtataatactgctgcagtaactaactcgttaaaatgaataccctagatatagatgtaagttacatgcatacatttacatacatttaaagtattcatgggatgtttgaaagagaaaaaaatctaagaaaagtgtctgttttttgttctttgagatgcagttttgctctctcacccaggctggagtgcagtggtgtgatctcggctcactgcagcctctgcctcctgggttcaggcgattctcatgtctcagcctccctagtagctgggattacaggcacccgccaccacacctggctaattttttgtatttttagtggaggcagggttttgccatgtttgccaggctggtcttgtactcctgaccttaagtgatccacctgcctcagcctcccaaaatgctgtgattataggcatgagccaccatgcctggccaaaaagtgtcatttttaattcagctttttagttttctgtttatcctattatgaaaatgttcataacaaaatcttgaaagaaaatacgtgtataaaaacctttatcactgagaagtgtgtgtatgggggtaagtatggaatatttcaggctataacctctctctctctctctctctctctctctctctctgtgcataaatatgtaaatgcaaaaattttaaatgatcctttgactcagtaatttcacctttaggaatctatagtaattctaaatatgaaaaatatatacataaatgtaaaaatgatcatattatgctatagtaattgtattcattataaatcatagttataaagacaaataagattgaaagtcctcatagtacaatgctcattgaaaaaaatcatgatgcaaaattttagcaatgtgatttcaattgcctcctcattttgcttgtttgtatttttgagccgtttaggcatactgaaaaattgagtgaaaaatacagagttcccatatgctcccttatacctccctcttcccctgttatttacatcttgcattagtgtggcacatttgctaaaactgataagccaacattgatacatcattattaactaaaacctataattaacattagagttcactctttgttacaagtgcctttatatttcaccttatccctttggattttcttttcagggttgcaaaactgcgtgacgaaattatggccttaaggaacgaatgttcttctgtgtacagcaaaggacgcatactgacaacagaacagacaaagctcatgatatcaggaatcactcaaagtttaaactcaggatttgcacagaccttacaccctagtctgacctcagggctgacccagagtttaacaccttccctaacctcttctagtatgacttctggcctgtcatcagggatgacttcccgcctgactccatctgtcactccagcttatacacctggtttcccatcaggattagttccaaatttcagttcaggagtagagccaaattcattgcaaactttgaagttgatgcagatccgaaaaccccttctaaagtcttctttgctggatcaaaatttaacagaagaagaaatcaatatgaaatttgttcaggatcttttgaattgggttgatgagatgcaggtaaaaaaatgtttactttacctgagtgtttcagtctttattgttatcaatttcttttttaaacttagtattttactgtctgaaggtacaactggaccgcactgagtggggctcagatttgccaagtgttgaaagccatttagaaaatcataaaaatgttcatagagctattgaagaatttgaatctagtctcaaagaagctaaaatcagtgaggtatgtgaatttaaaatttgtatatatttcattttagtttactcttgttttgctttttacatgaagaccctgtaaatcaataatagatacattaagtgtgagtcagaattccttcagattcctgactggagtgtctttttaatctcatgttatagattcaaatgacagcacctcttaaactgacttatgcagaaaagttgcacagattagagagtcagtatgcaaaactcttggtaagtttttttttttaaaccttctgtttcccttatctatatttggcaaaaacatgattcttatgatgattttccttactaaagaatacatccaggaatcaagaacggcaccttgatacactccataattttgtaagtcgtgcgactaatgaacttatttggttgaatgaaaaagaagaggaggaagttgcttatgactggagtgagagaaacaccaacatagctaggaaaaaagattatcatgctgtaagtacaccctttgtacttgcatactagggttgcattttaggtttatatatttttctaacacacttcttaattatttcttgaaggaattaatgagagaacttgatcaaaaggaagaaaatattaaatcagttcaggagatagcagagcagctacttctagaaaatcatccagcccggttaactattgaggtaaagctggaaagtgtaatggtgttggttgaatattgatatgattatttcccttcagattcttttattgctgagaagttgaaaattacaagccatctaacttttattaaaacctggctcagaaatgtttctgacaaattgtactgattgccttcagttctctggctctaagtatgtcacccatcacttagaataaaagtacccttgtcagcctctgtggctgagaagatgtattgctgtaaatatgaagtaccttctctgtgtaagcattgccatattatttatttctgattgtgtaacattgcacaagtgacatagtattgccaagcctcattttcctaccaagaatgggagagattacctctaatccatagagttgtgatgagaataagaaggaaataatttactcttactgcttagtatagtttttggtacattatttgttctcaaaaaaataccagctgttatgattcaatttaatacttttatttatgctctggttttgtgaggtgtattgggacagcatcctgacaaggctttataatgtgcagtgaacatttcaaattcagaagtggaaaattgagatgggatttatcaggttgcctatgcagttgggacaatgttttaaattgtatattagacagagttagtgactttctgaatggagaatagggggattatgtaagaaagtagggattgtcacacatgggcagtcagatgtgatattttgccagaggaaaaaaaatgatgctggtcctgaaagttgtcatgcttcaaactcacaattgaggaaaggaatctgatagattcactgaaatcataataactcaaaagattagtacaattctaggctcatcaggaagttttagggatgttatgtatgatcttttatataaaatacggttttgtgtctacatgaaatgtcacatatgaatgttaaaaacgtagaagagtagggaatctttagggaaaggagagtaatggagggcctgggatgtggttttgtacactaatacactaaaaagagtatttcttagggtggagagatgaaaactgttaggaaatactattatgggccaagaattttgatgggaatggaacatgtgaatgtcactctgatcacttttatgtaaaaattataatttaattaataaaaaatttcttaagaagtaaaatgaaaccttagtcatctttatgatcccatcggcctgtcctgtgtcttgtttgggtacatggataatatttagttaattatcaatactgtttcatattttatatgaaaaaaatatgatacatcttttatagccaatttactgaaagtagcttaatttgaggtagaatatgatcatgatatgttgccagatattcaatgctgcatcatacattccattcggaagtcctgcctaagtatagctcagcaggaatgaacttttccaaaaggagggaaaatgacaggcttacttaaaatagtcattaaagcatctcgagtgccctcttctggaaatcaatgaattgcaccttaaatagaaaagagtatttcatgtttccttgaggaaggaggtatcctttgtacaatattgtttaccctcatgaaagatacactctctattaaattagaagttcaagaaacacatttttaaaataaaaattcctagtattatcatcattataattccagaattacaccaatttgggagtacacacattttcttttccaccctccccaaacctcatcccagcaaaaacaaagagaaaccgacataaccatatatttctgtgttagaaggtatattttatgatctagcaccgtaaaaattcagagaaaggagagatgaatgtgccacgaaagaaaacatatcggaggattccacaaagcagatgtaagagttggtggcaaaggagtcaagtgttggttttgtaaacaggagggatagcttgcatttattttagtttttaaatattttttcccgtagccagagataatttttttcttatattttaataagaaatttcaagaagtttaaaattgaaaagaaatcaactggagtggtttaagaatttatatttaaactttaggactgactttgtacaagtgagaagtcttagataagaggaaaattttactgccctgattttcttgttttttttttgtttgtttgtttgtttttgttttttgaggtggagtttcactcttgttccccaggctggagtgcgatggcgcaattttggctcactgtaacctccgcctcctgggttcaagcaattctcctgccttggcctcctgagtagctgggatcacaggcgcgtgccaccatacctggctaatttttgtattttttagtggagatggggtttcaccatgttggccaggctggtcttgaactcctgacctcaggtgatctgcctgccttggcctcccaaagtgttgggactacaggcgtgagccaccatgcccagccactgccctaatttccaagtcttattctgccaaaacaattggtcatctatttagatagtagagttagcatttagaagcatcgatatcaaaaggtatgtgtgccttatttctccccagtcagttatgatggctctgttttatctttaaggcctacagagcggcaatgcagacgcagtggagctggatcttacagctctgccagtgtgtggagcagcacataaaggagaacacagcgtatttcgaggtatgtgagtagaatcataacttcaatagatggtattgtgattttggctaacttgcaggaatctttttcataatttattgttaggataacaatgtgtttctgtgtatatatatacacacatatatatatacacatatatgtgtgtatatatatacacacatacgtatacacatatatgtgtgtatatatatacacacacatatatatacacatacatatacatatatacacatatatacacacactgttatatatgtatatatgtatatgtgtgtgtgtgtgtgtgtttgtgtgtgtgtgtatatatatatatatatatatgtgaattgttttctttgtaggccgaaagagttggttttatgtcctatgagatagattgaagtattctgttaatgcaggaatcctttaaaaattcttaagatatcataaaatctttattctattctacaaatgtgtctcttatttaggaactgttttcatatagagaatcaaccatctataaccatttaacttctaaaaccatagaagtttttaagtattcttggaatttcactcctacttaaaaattgtttaaatcctaatttaaaatggaccttcagccaaaataatagagagccaaaacatcatataagctttggacacttagtatgttcattcataactattcaacttcaagggttattctttggtccaaggaaagatgtgactattaagctatcttgtgcttttattctcttctcacttatgaggggtacacataggaccttggtattggagtgtgacaactgtgtgctttgctggtatttaacatactttaacttccaggtttcatctttccttagtttttcaatgatgccaaagaagctactgattacttaaggaatctaaaagatgccattcagcggaagtacagctgtgatagatcaagcagcattcacaagctagaagaccttgttcaggaatcaatggtactaatacaaaacctatgcattttataagtatgcataagtgattagattagtgttttatatgagcagaactttgtattttattggcactcttgatatttcccactaattcaattacacatttgcacattcagttttagtattcttttggcaacaaatacaacagaagtgtttttttaatgtgatagctttgatattttaagatggtttttagtgtcgtgtgtgtgtgtgtgcacgtgtgtgtttagttattcattttgcaaatactttttaagttcttaatatatcctgggcactgttttaggttctagagctacagcagtgaacaaagcagacaagaatctctacctttgtggtgcttacatgctagagagggagttagacaataaacagaataaataagtaaaatttgtatagtatgttaggtagtgtaaatgccaaagaggaaaaagaaaaccaaacaaaccaaagaaaggaagagggatacaagatggggtggaggaggaaagattgaaaatttagactaggtagtcagagagaagacttttctgatgaagtttaatttgtgtaaagtgctgaaggcatggagagtacaagtcttttacttcttaaaattcactgtatttattacttaggaagagaaagaagaacttctgcagtacaaaagcactatagcaaacctaatgggaaaagcaaaaacaataattcaactgaagccaaggaattctgactgtccactcaaaacttctattccgatcaaagctatctgtgactacagacaaattgaggtacttgtaactcctagaaacagaccagtttctgtcattattcatatattttgtaaatgagatcatattgctaactagtgatcaagatttcccgcctcataaaacaaaaaaaatcccaggattgagtatggaaaacagttaacagtgacctcattgagttattctgctctttattttaaaccagataaccatttacaaagacgatgaatgtgttttggcgaataactctcatcgtgctaaatggaaggtcattagtcctactgggaatgaggctatggtcccatctgtgtgcttcaccgttcctccaccaaacaaagaagcggtggaccttgccaacaggtttgtatatattagctaaaaatgttgagctagttttgggggccctctgaaggttgaaggaacaatcaatactttgtcaaggccccacaggatcaaaagtctctagaactcatccgtggaatatttcacacaaaaagaaaaattgcagtgtgttttcagagggagtaaaaacattaatctgagttctctttcatgtatttcagaattgagcaacagtatcagaatgtcctgactctttggcatgagtctcacataaacatgaagagtgtagtatcctggcattatctcatcaatgaaattgatagaattcgagctagcaatgtggcttcagtaagtatgaatctgtatgtcaactcgatatgtccaaaaatgtgcatgccttttcatatgtgtcgtagagtttgtatttgctttagaataggatggagtccggcaaatccatgctaatattcatttattcaatgaatatttgttatatgcccatagcatataaggcactttttaagaactgaggaaatctggagatcacaaatttcattcagaacttactgtgagatagggaggcagaatgtagttgttggatatacgatgatgggtacagttgatttcatttgagtttcgtagacttgtttttctttgtcgttaaaacctaaaattgttggctgggcgcggtggctcacgcctgtaatcccaggactttgggaggccgaggcaggtggatcacctaagaggtctggagttcgagaccagcctgaccaacgtggagaaaccctgtctctactaaaaatacaaaactagccaggtgtggtggtgcatgcctgtaatcttagctactcgggaggctgaggcaggagaattgcttggacctggggggcagaggttgcagtgagctgagatcgcgctccagcctgggcaataagagtgaaactccgtctcggccgggcgcggtggctcacacctgtaatcccagcactttgggaggccgaggcgggcggatcacgaggtcaggagatcgagaccatcccggctaaaacggtgaaaccccgtctctactaaaaatacaaaaaattagccgggcgtagtggcaggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaagagtgaaactccgtctcaaaacaaaaaacaaaaaaaaaccacctaaaattgttaatgaaaaagacagttaatttcaaatgttcctatttatgattattcgtttagattggcatataccacacgaccagtttgaagtgtctcccattcaaatctatgagtaatagaatgaattacatgggtctttggtcttctttagataaagacaatgctacctggtgaacatcagcaagttctaagtaatctacaatctcgttttgaagattttctggaagatagccaggaatcccaagtcttttcaggctcagatataacacaactggaaaaggaggttaatgtatgtaagcagtattatcaagaacttcttaaatctgcagaaagaggtaaagcatggggatccctgtctttttttccccataggtgtttagttctggctattttttgctctcaatgggaatctcaatcttaggtatattgtatcacccagcctatgatatgtagacacaattggtggaacggtaaaagcatgtttgaggtaggaagactcaagaagggattaatttgtttccaaatgataaattaatgaaaggtgccaaccaactggttggacaaacaacgaattcttacttttcaacgttttcactattttgcaatccttcagtttcagaaaagattcaattattttcccatttaccaaacttggattttatacaaggattaaagcaaaaggtttttgcctagttaacttttgttaaatacagattttattctgaactttaaaaattttaattagagacaattttattagtaatattctattttttaaaaatcttaaacattaaatattatttacctaatatttacttttaaggatttttatttgatttttgtaattaatttttgcagctaatataattcacatttttgtgaacataaaatagcaacgtattactttggacagcatttaatcggaaattggtacttcaaatggcatttgggaaattttattaattcttcttaaattttaagatttatgttttaagatttatatccttagaatgggtttgtgatgaaaacaggaatcatttgcttgactagctgtgtcccagtaatataaaattctcatattaaaacataaacagaagcttctaagagatagaaaacaaggtattttctaaacatatttattttcacagaggagcaagaggaatcagtttataatctctacatctctgaagttcgaaacattagacttcggttagagaactgtgaagatcggctgattagacagattcgaactcccctggaaagagatgatttgcatgaaagtgtgttcagaatcacagaacaggaggtgagagctataaatatgttgggaaaaaaactaactctcttaatgaccttatgtatcaactcttgtgacttcttaatgttcagttttgcacactcacactagccagtctagtgtgaggtgaggtctgattgtgtaattattgctgattataaactaggattcagtctacctctgactcaggtaaacatgagaatatgtacacgctcaccttcattgtgatgaaggatataaggacttgtaataaaagtcattatacacctgctgtgtgcaaaagtactaagttagatgttgaggctaaggagatgaacagtaagggaattattgattgtaaaacttgaatgctatgatgtagtttctttgataacaaacaaagaatatgtagatttctaagtcattggttcttaatgtgaaatgtgtgtttttcaactagtttaagaaaaacacctcatcacaggtgatggcctgatacctttgtttgttctctgttttatagaaactaaagaaagagctggaacgacttaaagatgatttgggaacaatcacaaataagtgtgaggagtttttcagtcaagcagcagcctcttcatcagtccctaccctacgatcagagcttaatgtggtccttcagaacatgaaccaagtctattctatgtcttccacttacatagataagtatgtaactgctatctcaatatataaattgcttcatacaactctcatttttatttactattaatttaaaattttatttttattaatataaatattaacttttattttgtcttaagaaatacattattggctgggcgtggtggctcatgccggtaatcccagcactttgggaggccaaggcaggtgaatcacctgaggtcaggagttcggtaccagcttggccaacatggtggaaccccatctctataaaaaataccaaagttagccaggcatggtggtaagcgtctgtagtcccagctactcgggaagctgaggcaggagaatcacttgaacccgggaggtggaggttgcagtgagccgatatcgcgccactgcactccagcctgggtgacagaggaagactccatttcaaaaaaaaaaaaaaagaaatacattatttttatggattgatgacacttctctatgttgatagtggatgtgcttcagagatgagtgtgtaatgtatggtcctcccacattttgcatgtaatttgggtagctcagcagttgtagccaatgaattttcatctcatacttaaacaaagttagaaagaaaccatcttatgttgcagtctcttgctgaataccacttgtggggcaggggatgggttggagcacatactctctattaagaagaaagccagaaaaatgtcagtttcatagtaaatgtatcagtgttccaaggtgaagaacatgttatgtcatgtgtcataatggtgcttcaggactacattatgcaaaaataaacatttaaccataggtggctattgtttaatttcctttttaaggttgaaaactgttaacttggtgttaaaaaacactcaagctgcagaagccctcgtaaaactctatgaaactaaactgtgtgaagaagaagcagttatagctgacaagaataatattgagaatctaataagtactttaaaggtatgagactcacttttggatatttttaaatatcgtattctacaagtatttctctagcacttagatcttcaaacatcaagtgttaaatatcttggatttttgaatggatttattccatttgtgtctctgtgatctcacagtttactctaagtatgttcagtcattttagtttgaggagagttctcatttgaagtttgaacccttttgacagtagcttttgatagtcaattcatgttggcagcaggaggagtcgaagctaaaaattaaattatttgtaatagattaacttgctgaaaaagaagttaatttaagatatcaaggaggtaaatagagaagttaatctgagaaaggaaaaagacttgtagttcaactcatctatgtgtatttctttagcaagtggtgaaactattgcaaagcaatttttaaaagttatctcagtgatttttaatgcatgtatttctttttaacagtgggattagtaggcacttaaaagcagacaatgaaaaagacatattttattaatggaggtagcaaacttgcttatggaatatattttattttgttgatatgcaaattttattaggctgaacgttataaaattgtcattaaaaaatcagagtacaaatattgaaaatttcataaggtttgaactaatataatattgtgcatatgaaagatattctttcctttatcttattttctacctgtcatttgtaaataaattgtaaaattaggtaaataatatatttacccagtgagtggttaacatttttataacttttaccaattaatgtattttagcaatggagatctgaagtagatgaaaagagacaggtattccatgccttagaggatgagttgcagaaagctaaagccatcagtgatgaaatgtttaaaacgtataaagaacgggaccttgattttgactggcacaaagaaaaagcagatcaattagttgaaaggtggcaaaatgttcatgtgcagattgacaacaggttagtatccttttttgttcagttttagcacagatttaatgtctatctatggtaaatgagtaaaatctacacatatgaggctatttttttacttccatagttaatttgttaattacaatacctctacttagccatatttctttcttacttggaggactttagtaagacatttaacttaaaataagcattttttcaactctgttactattcatgtattctagcatttatatagttaatctgcttgccttttctgaaggaaaaaacaatgtagttctctaattattaccaacttataatattcaaataaccatgacttagtaagagcatgaagcatgcatgtgatagggctgtgtgtagcttctatactggacttaagaaatgtaaataaatggaaatgccctgatgttcattttaattgaagatacaagaaagtcaaaattctcagttactgaattaaaaaaggttttagggttcatcttaaaataaatgaattcgtgtcctttctcattcactttcgtgcttatattaatgcaaataaaatgcttttatgatacagtgccattctccaaaagtaaaattatgttcaaatatgtgttatctctgtaacaaatatgatacataggtttaatgtggtggttttttaaatcatagagacaggtatgtaatcacagctcctggaaaatactctctgagaccatgttgaaccattcattggactaccttatcgttatttcaaaactgaactgccatttgatgcaagccttactattcaagacactgtaattgataataattaaggttaagcttccacttttcttgctttttaagtttagcttcttgggcttgtccctagaataatcactgtcactaaattgcacaactcagggagcagaatgtttatattcaacccaataaggaatgcccttgggggtgtgcctcagggtgctgcagccttgagttctttatacatacccgtcttgtgcttagttcattgcagtccaattattttgtctctcccatctctacatcttccaccctcctgatggatatcgctggacaccgtgactattcggttactattctcttaggttacgggacttagagggcattggcaaatcactgaagtactacagagacacttaccatcctttagatgattggatccagcaggttgaaactactcagagaaagattcaggaaaatcagcctgaaaatagtaaaaccctagccacacagttgaatcaacagaaggtatgtaaaaataattccctctactgaggttatgtctgcatttggtcagtcatgctcctcatcttcctttcctatgttaaatgaaaaagtcaccaactctttagaggaaggtggagagtatataaaaaatattaaaatcttgcaacccaaacctacatacatgacttatttttatttcttggaagtaatttttgaaagcatgggtaatcagaaagtggagagtgttgggatacttttcaaattcctaatgataatttatttaatcataggtatagaaatctctttgacactttgctggcctcaatagttttctaggttcctaaataagtaaaaatggttagcaatggaaaattaaataccacatttgacagaaagttgaatgctttgagatttttgttctatcttaggggccaatcatctctagctctattttcttcagaaataggtggtggccaagggcatcaagtctgcttttggataattcctaaggagtttagtaatttctgctttgaaaaccacatggggtgggtcacttctgtggcttaatctgaaagtttgtaattttcccataaggcaagttgtgtattaagtgcaaagggctaaggagctgtactgtgaagtgatgtagatatgtcttagttactgagcatcttatgtagtagaatagctgaattccttgtcatttttgttctaaactgtgtatatttatagatgctggtgtccgaaatagaaatgaaacagagcaaaatggacgagtgtcaaaaatatgcagaacagtactcagctacagtgaaggtaggaagattcattaactttagtaaaatttaatattcaggtttgtgattctacatgtactgttaaagccatgcaagtcatttcactcagtgtttaaaagaatcttcatttgaacttttttgacacttatctaataattctttgtgaaattagtcacatgacagccccccagttcattcgtcttcttctctctcacatatgtacacccctgccactcccagccaccagaatacatagctctgtagttggtttcttatcacttttctttcttttttctttaacattgttagggtatttcatgggagagcttctaactttctcacttagggggacacttttcatgcttttcaagttgtcattgacaacttttcagttttagccctccagatccatagttccattgcttagctggaggaaaggggggctgcatagggctacactattgttacatatattttcatgagcttctaaacagacttggaaattacccgaccaccctacatgtttctgattttgtccccatcttggaagcatctccaggattggatagattcctaaaaatgtaattttgctctacagtcatgtgttgtttagcaaaggggatatattccgagaaatgcgttgttaggtgattttttcattgtgcgaacattgtagagtgtactcacataaacctacatgttacagctttctacacacttaggcatatggtacagcctcttgctcctagactataaacctgtacagcatgttactgtactgaatagtgtaggcaactgtaacataatggtatctatttgtgtatctaaacatattaaaggtataataaaaatagggaataaaatacaaaacatggtacacttgtatagagcacctaccatgaatggagcttgcaggactagaagttgctttggtgagttagtgagtgagctctgagtgaaggtagaggcctaggacattactgtacacctctgtagaatttataaacactgtacacttagactacactagcttataaaaaaatttcttcaataataaattgacattaacttactgtaacttttttacattataaacttgtaatttttttaaccttttgactcttttctcatagcacttagcttaaaacaacgaacacattgtacagccatacaaaagcatcttctttctttatactttattctgtaagcttttttctatttttaatttttggttttttttttttttttttactttttaaacttctttgttaaagcctaagagacaaacatacacattaacttaggcctatatagagtcaagatcatcaatatcattgtcttacacctccaaatcccatgggaaggtcttcaggggcaatcacatgtatggagctgtcttctcctatgataacaatgcctttttctggaatactttctgaaggacctatctgagtctgttttacagttaactttttttttttttttaaataagtaggagtacactctaaaacaacaactaaaagtatagtgtggtaaatatatagaccagtaacatagtcatttattaccaagtattacatactgaacataattgtgtgtgctatacttttgtgtgacgggcagcacagtaagtttgtttacaccagcatcaccacaaacgtgagtaatgcattgtgccacgacatcactaggcgataggtatttttcagctccattataattttatggggctaccatcatgtatacggtctgtctttgactgaaatgtttcatgtgaaacacgactatattttctttatttaaacttaatttaatgaatctaggttctaatgatctgtgtcaaatcactaaagttattttagtgaatctaggttctaattatctgtgttaaattattgtagaatgaaactctagtactttgcttcaattcattttatcttattgactcctttatacaggactatgaattacaaacaatgacctaccgggccatggtagattcacaacaaaaatctccagtgaaacgccgaagaatgcagagttcagcagatctcattattcaagaggtaataaaagtatgagagaaagaggggaaggggcataaaagaaagaacacttactttttaaattttattttttgttgtggtaaaatatacatagtataaaacttactattttaacaattttaaatgtacagtttaatgacattgcagtatatcacaatattgtgcaactggtaccactgtttatttccagaaccttttcgtcatcccaaagagaaagtctacacccagaacaatacattctattaagggtttttaaaaaccctttaaaaatgtttattcaagattaattattaactatggagataaataaatgtacttatgtacttcatggtgaaatttagaagagaattatcatttgccatgatttgcataatagtaataataagctcattcttatcatttattatggggggagttgtgtgctttgctgtctgaaggcctagttaatgtaattattattcaaaattcattcaacttagtaagagtaactggaggtaatgcttttattatttttttccttacttgcagttcatggacctaaggactcgatatactgccctggtcactctcatgacacaatatattaaatttgctggtgattcattgaagaggctggaagaggaggaggtaatcattaacagtgagcaccctgtaaatataaaggagctagagatgagcagtaactacagtgtagtttgggaaagcaaaacatgtttcatgataaatttatgtggccggtagcagatgtacaaataaatattgaattataaaattacaatgaaaatgactgaaggcctaagatttttgtttgtctttaagattcattcaaatagaaagtcatttcacttcatgactttacattttcacttcaggactctaatatggtggggttaatgtcttaaataaattacgaaattttggcagtttggcagaatatttttcggctttctcacagctgagaggtatacttctttgaagtatagttactgctggtatgatgtctacaggaataccacacgaacacatttgtcttatgcattttaaattaatttgtatctcaagaagttaaaattattatacataatgtaaagatgctaacttagaagtagtagacgtttttacaaaatgatactttttaagaattttggagttttttgttgttttttttttgcaaaaagatatagcacatggcatttaaaaaggctatttaaatgccactctgatttggagaacttctgcagctttgattctgcatttaaaaatcatatttctgcatttataaatcatatatttaaaaatcatataggaagagtaaggacttatttataaagatcagtggtcaccaaaggctcttgtatgtaatctaaaagggagtatgctatgctttgttatcttgatgtactttctattccccagaacagacaaaaatagtagaatgaatgttgaaataaataaattgtgggccattagctattttaaattggactgttgttgaaattctaaaggtgattatgcttaatgtaactccatatgagagctgaaacagcagtaaacatctattggatgttactttctcagtttcctaaaaatgtgaccacttttataaactgttttagtctgttcagagttaacagttttctgcagctaaatcactaacatagctaattgcaagactttataaccctcttcctttgtgcttaggagaaccaggatatttgtgaccatcttaaatgcatgcatctctcatctatgaaagaacatccataattttcttatatttttagtttttgagagatcttattccattttaaatggtatacagatcttttaaattgaatatgcagtagttaaatataaaataaaataacttaagttcttttctcatagtatgtatctgattatacatatatgggccacttactcgatttatctgatgaggcagaatgctaacaattgatagaaacaaaaaatattttagaaggccttaattgaatgcaagttattattgtccttaaaaatgtcaaagatttgtagttaattgaaaccagcaaatacagttatggaagaacaagcgaaggctataatttaaaataggttaaaaaaaactaccacttaacattacgttaatggaatgtcgtgtaaaagatacatagcttaatttttagactcaaaagattggtgtttctgcaactgaggtttgaagacccacatgaaaaaccttggtctaaagcagaattttccataataaacataaaatcaaagatggatgcaagttaatttcagaagtaatactgatttagttaaaagaaatgttactaaaatatctgtaatagatattagatattagagagagatgctttagtctgtgctgagaacaaaatatgctaagtattaatcaccgtgattaaagggcaagattgaggaagatttagagaaaagttaaggaagttatttttatgcaaataagtttgagatccacaagaaagcaagtcagcaattggactaaattatttctagtaatttttctcacatttgctaaaaaagtcaagagacaacatgatttttttttttttttttttttttttttgagacggatctctgttgcccaggctggagtgcagtggcgtgatctcggctcactgcaacctctgcctcctgggttcaagtaattcactgcctcagccttccgagtagctgggattacaggcgcctgccgcctgccaccacgccgggctaatttttctatttttagtagagacggggtttcaccatgttggccaagctggtcttgaactcctgacctcatgatccacccgccttgggttcccaaagtgctgggattacaggcatgagccaccgtgcccagccgagattcttaacaaatcactgcattgcctaaggcattgagggttcaacaacagatatttttttctgagggaatttttagtttttctaaatctgagcatgagaaatagctcagaatttcttagcaatagctaagttttaaaggaggtttgataagcaactgagactgtcttagaaataacctcctcaagaaatactgaaaacttagtatttaaatagataaaatgctcatgtgtcacaggattgaccctgatactaaaataaagaaaatagagtgctgaagataacagattatgagatttgtttctgtatgaattattattagaaaccttatttaggttagcaaagaaaacaactgaaattctcatcaaaattattggagatcaagaaattagaggaagcaaaataagatgtatggtctgtaatagaaattaaattcttgaaattcaccaaagcttctcaatgaaaacaaatctgtctaaaataatttctgtattcctgtttaaattattttatggtgatcttgagttgatgatacaaaactaacacactagaatattaataaagagaaattaaattgtaattataaactaatcctgatcatgtagttctataatcaatgtaaagcatactcctcccagctgacattgattctgtccctagtagagtaaaaattttttcttataattttttctatacattggagctgaatccctaagtatatatttaaaagctattatacttaacaaatatctttatatttatggagtatttaaaggtgcttgtcaaagtgattcatatgaggcatgttattaacaacagcaacaaaatctgtgagtatatgaagcgcatcttttccagagccatcaggactgtagctgcctttgcattagcaattctgattattataattgtcataatatggcaagtataaacaaataagggatctgactttagaaatttcaagtttttgtataattttccttcttccccatgttatttcctaatttggctctctgttctaaagttctgtgctttgtttttttaaccataagacatgggaatataagtatcatttttaatttctattaggttagaaaactaaattctttagcatcatttggttcctatgtgttgggtgttcttcctacctcttaggattatgttgcatgcaagagaagaaagggcaccgtcgtgagagttttatttcccactttgtcactcacccaatgtgagtttgcaaaaatatctgtcctcctcgtttctccctttcctcatctgttgtaaattcccttcttgctataaaattctaagctagctaatttttaaaataaaattattcctgaggggcaaaaagatattcttcagaaaacctgtcgtgaagggttttttgtcctcttctgctgactttctgaggcttcctctctgaagaaggtgatgctgctggtggtggtgatagcgcttgttctgcatttgagttcacttggttttgtaagtacttttatgaacattgattcatacgttgtaagatattttgaacagaacaggcttgacactttcaaaatgtcttttgtagattaaaaggtgtaaggagacttctgaacatggggcatattcagatctgcttcagcgtcagaaggcaacagtgcttgagaatagcaaacttacaggaaagataagtgagttggaaagaatggtagctgaactaaagaaacaaaagtcccgagtagaggaagaacttccgaaggtcagggaggctgcagaaaatgaattgagaaagcagcagagaaatgtagaagatatctctctgcagaagataagggctgaaagtgaagccaagcagtaccgcagggaacttgaaaccattgtgagagagaaggaagccgctgaaagagaactggagcgggtgaggcagctcaccatagaggccgaggctaaaagagctgccgtggaagagaacctcctgaattttcgcaatcagttggaggaaaacacctttaccagacgaacactggaagatcatcttaaaagaaaagatttaagtctcaatgatttggagcaacaaaaaaataaattaatggaagaattaagaagaaagagagacaatgaggaagaactcttgaagctgataaagcagatggaaaaagaccttgcatttcagaaacaggtagcagagaaacagttgaaagaaaagcagaaaattgaattggaagcaagaagaaaaataactgaaattcagtatacatgtagagaaaatgcattgccagtgtgtccgatcacacaggctacatcatgcagggcagtaacgggtctccagcaagaacatgacaagcagaaagcagaagaactcaaacagcaggtagatgaactaacagctgccaatagaaaggctgaacaagacatgagagagctgacatatgaacttaatgccctccagcttgaaaaaacgtcatctgaggaaaaggctcgtttgctaaaagataaactagatgaaacaaataatacactcagatgccttaagttggagctggaaaggaaggatcaggcggagaaagggtattctcaacaactcagagagcttggtaggcaattgaatcaaaccacaggtaaagctgaagaagccatgcaagaagctagtgatctcaagaaaataaagcgcaattatcagttagaattagaatctcttaatcatgaaaaagggaaactacaaagagaagtagacagaatcacaagggcacatgctgtagctgagaagaatattcagcatttaaattcacaaattcattcttttcgagatgagaaagaattagaaagactacaaatctgccagagaaaatcagatcatctaaaagaacaatttgagaaaagccatgagcagttgcttcaaaatatcaaagctgaaaaagaaaataatgataaaatccaaaggctcaatgaagaattggagaaaagtaatgagtgtgcagagatgctaaaacaaaaagtagaggagcttactaggcagaataatgaaaccaaattaatgatgcagagaattcaggcagaatcagagaatatagttttagagaaacaaactatccagcaaagatgtgaagcactgaaaattcaggcagatggttttaaagatcagctacgcagcacaaatgaacacttgcataaacagacaaaaacagagcaggattttcaaagaaaaattaaatgcctagaagaagacctggcgaaaagtcaaaatttggtaagtgaatttaagcaaaagtgtgaccaacagaacattatcatccagaataccaagaaagaagttagaaatctgaatgcggaactgaatgcttccaaagaagagaagcgacgcggggagcagaaagttcagctacaacaagctcaggtgcaagagttaaataacaggttgaaaaaagtacaagacgaattacacttaaagaccatagaggagcagatgacccacagaaagatggttctgtttcaggaagaatctggtaaattcaaacaatcagcagaggagtttcggaagaagatggaaaaattaatggagtccaaagtcatcactgaaaatgatatttcaggcattaggcttgactttgtgtctcttcaacaagaaaactctagagcccaagaaaatgctaagctttgtgaaacaaacattaaagaacttgaaagacagcttcaacagtatcgtgaacaaatgcagcaagggcagcacatggaagcaaatcattaccaaaaatgtcagaaacttgaggatgagctgatagcccagaagcgtgaggttgaaaacctgaagcaaaaaatggaccaacagatcaaagagcatgaacatcaattagttttgctccagtgtgaaattcaaaaaaagagcacagccaaagactgtaccttcaaaccagattttgagatgacagtgaaggagtgccagcactctggagagctgtcctctagaaacactggacaccttcacccaacacccagatcccctctgttgagatggactcaagaaccacagccattggaagagaagtggcagcatcgggttgttgaacagatacccaaagaagtccaattccagccaccaggggctccactcgagaaagagaaaagccagcagtgttactctgagtacttttctcagacaagcaccgagttacagataacttttgatgagacaaaccccattacaagactgtctgaaattgagaagataagagaccaagccctgaacaattctagaccacctgttaggtatcaagataacgcatgtgaaatggaactggtgaaggttttgacacccttagaggtatactctgtgttctgagaccttatcagctacctaatgtcaagtttcctcatttgtttcctttctctcctagactaaatttttaaaacaattttgaatgtgattggctcattgtagttctgacaggaaaataatgctatactctttctggtaacttacttgaatctttatcataaattaactttaatttttgaatgtttgagattaaacatacagatgtaatagatatactgttatatctgtggagatacattctgaaaaatgtgagtatcaaaaaagctagaagaaccaagcagttagctttaacttctaacatattctgtggctagactttgtcttagtcttttttaaagatataattttaatacctttaattgtcatctaagataaaattcagactctgaaaataatataatacttattcctgaaccctccttggtttgaaatttttcttcttttcactaatcttgtctttgtaattcaaagaattatgtttggattgagaatggataaagtgacataatgttcttgaggtgacttttaacattttataaattcctgttacagatagctaagaacaagcagtatgatatgcatacagaagtcacaacattaaaacaagaaaagaacccagttcccagtgctgaagaatggatgcttgaagggtgcagagcatctggtggactcaagaaaggggatttccttaagaagggcttagaaccagagaccttccagaactttgatggtgatcatgcatgttcagtcagggatgatgaatttaaattccaagggcttaggcacactgtgactgccaggcagttggtggaagctaagcttctggacatgagaacaattgagcagctgcgactcggtcttaagactgttgaagaagttcagaaaactcttaacaagtttctgacgaaagccacctcaattgcagggctttacctagaatctacaaaagaaaagatttcatttgcctcagcggccgagagaatcataatagacaaaatggtggctttggcatttttagaagctcaggctgcaacaggttttataattgatcccatttcaggtcagacatattctgttgaagatgcagttcttaaaggagttgttgaccccgaattcagaattaggcttcttgaggcagagaaggcagctgtgggatattcttattcttctaagacattgtcagtgtttcaagctatggaaaatagaatgcttgacagacaaaaaggtaaacatatcttggaagcccagattgccagtgggggtgtcattgaccctgtgagaggcattcgtgttcctccagaaattgctctgcagcaggggttgttgaataatgccatcttacagtttttacatgagccatccagcaacacaagagttttccctaatcccaataacaagcaagctctgtattactcagaattactgcgaatgtgtgtatttgatgtagagtcccaatgctttctgtttccatttggggagaggaacatttccaatctcaatgtcaagaaaacacatagaatttctgtagtagatactaaaacaggatcagaattgaccgtgtatgaggctttccagagaaacctgattgagaaaagtatatatcttgaactttcagggcagcaatatcagtggaaggaagctatgttttttgaatcctatgggcattcttctcatatgctgactgatactaaaacaggattacacttcaatattaatgaggctatagagcagggaacaattgacaaagccttggtcaaaaagtatcaggaaggcctcatcacacttacagaacttgctgattctttgctgagccggttagtccccaagaaagatttgcacagtcctgttgcagggtattggctgactgctagtggggaaaggatctctgtactaaaagcctcccgtagaaatttggttgatcggattactgccctccgatgccttgaagcccaagtcagtacagggggcataattgatcctcttactggcaaaaagtaccgggtggccgaagctttgcatagaggcctggttgatgaggggtttgcccagcagctgcgacagtgtgaattagtaatcacagggattggccatcccatcactaacaaaatgatgtcagtggtggaagctgtgaatgcaaatattataaataaggaaatgggaatccgatgtttggaatttcagtacttgacaggagggttgatagagccacaggttcactctcggttatcaatagaagaggctctccaagtaggtattatagatgtcctcattgccacaaaactcaaagatcaaaagtcatatgtcagaaatataatatgccctcagacaaaaagaaagttgacatataaagaagccttagaaaaagctgattttgatttccacacaggacttaaactgttagaagtatctgagcccctgatgacaggaatttctagcctctactattcttcctaatgggacatgtttaaataactgtgcaaggggtgatgcaggctggttcatgccactttttcagagtatgatgatatcggctacatatgcagtctgtgaattatgtaacatactctatttcttgagggctgcaaattgctaagtgctcaaaatagagtaagttttaaattgaaaattacataagatttaatgcccttcaaatggtttcatttagccttgagaatggttttttgaaacttggccacactaaaatgtttttttttttacgtagaatgtgggataaacttgatgaactccaagttcacagtgtcatttcttcagaactccccttcattgaatagtgatcatttattaaatgataaattgcactcgctgaaagagcacgtcatgaagcaccatggaatcaaagagaaagatataaattcgttcccacagccttcaagctgcagtgttttagattgcttcaaaaaatgaaaaagttttgcctttttctgtatatagtgaccttctttgcatattaaaatgtttaccacaatgtcccatttctagttaagtcttcgcacttgaaagctaacattatgaatattatgtgttggaggaggggaaggattttcttcattctgtgtattttccttacatgtacagtagacgttctctattctatcagccttctatggtacctttttgtcaggacaattaggattgtaatgctaatgcaaaggcagcaattcaaagatcttctagtgcctcatgaataaagttgagatttaaaatttgtaacattgatggaacagctgggaggttagaccaatcattaaggaatgtatgccatagctttctttgctaccataaacattttggaggtgcatctgctatgtgacatggtaaatatggttaagtgaatgaataaaatgttttagtaacctgtgtgtgatgaaaaaaaatttttacattcttgtttgctatggagaggtcagtttaatagctaagtcatttaatgcagtgtatatttttcttaccgctcacaactgtcagaagtcactggaagaagaaaagaaagaacatgttgaaaaagccaaagaattgcaaaaatgggtatcaaatatcagcaagacattgaaagatgcagagaaggctggaaaacctcccttctctaagcaaaaggtattcacagaagtcctggtttaataataataataatagcagggacgttaactgagttgacacagtttacctagcacaatgtttaatttttaccttaattttcccattgttatagcccaatataatgcaaatcagaaagattaaataacttgcccaaagaatcaaagttagtgtgtggcagaagaagctgtttaattccaaagcctgaacgttatatattgttcttatttttagtaaacgaatacagtatgctgcttttcctaataattaggtctgcttcctgattattacaataagaatagctgaagagcagagtcattctgttttatgtctagagtagatccatgcactccatgtcataaagatatgccgtcttattcttacagatgtaaacataaaaagtttcaagaacaatgaagatacaaaccaggatattaacattcttgattattgactttagttgtgcttttctgggtcttttctatctcataaggaagtgtctacagtcaatcactggaaattctagatactatcccttatcctagtgaattctttagtcttaacgggctatcttctgtatcccaactgcttaggattagttggatggccgcagcttgggagatgtccttggactgcaccacttaaagctcttaggatgttggtagttggggtgtacattttagtattgctgccgctggtgatagcagtgggattgctgctgtattaaaaaaataaatttccgctaagataagaagcgtttttctcaaggaatactttcctacactgccctcctgctcttgtctgacgtttagaaatttcaaggctatcatccaatcttaatgtttagctcccacttctagctctgcatcagtactcacttgtcatctattaaaatagacattgttgacatgactaaataggggagaacaccagtgccttgtcttacttggctgtgatatgaggcaagtgttccttatttgaggttctttcttggagaagtttacagaccagagtatatacttgaaaagttgttcagttgaagtgaagtattcagtcatagtcttacatactatatatgtgggatgtgggagatgtgggaaagcacttgcatttggtgctttataccaaaaagcttcaagtaattttaatatatatatttcatgtaaaatatccttctcccccctcattaaataggaagacaactaaaatggggacataaagcttaacaaagattccttgggagagttagtttcttttgagaaattttgattataaacccttggtatttttatattctgtagtttcatgtgtatatatatatatttttgagacagggtcttgctctgtcacccaggttggagtgcagtggcatgatcacagctcactggagccgcaacctcccaagctcaagtgatcctcctgcctcagcctcctgagtagctggactgcagacacatgccaccacacctggctaattaaaaaaaatttttttgtagacattctttagttttaaattctctaaaacattactaagtcagatttagacctagtaccctagatacattcttaatgcagataatggcgttaattataactgtctaagaacagctgatggtcgttctgttaaaggaaattttagttaatataagtatgtccttcaaaaatcaatgcagcctcatgattatagtcatgaaaaataaactttaaattgactctaaatagacttcatgggggaaaatatatcttttcattggcccattatttcctcttatttctgctaatttaaaagaatggcaattaatttctgaaataagggatttggaaatgatacactgaggaattaggagaaagtgtgtgacctcttgcttttccccaaacagatcaattttatttctctgacagatgacagtcacagatgacttttacaaagtgggtcttagcattagaaattatttgttctttttttcaatagttaaaaagtttcttttagataggatcttactctgtcgcccatgtgggagtgcagtggcacgacctcagctcactgtaacctccctttcccacactcaagcaattctgtctcagcctcccgagtagcttggactacaggcatgagccaccaatacttggatactttttgtatttttcatagagacaatatttcaccatgttgctcaggctggtctcaaacgcctgagctcaaaacaatctgcctgctttggcctcccaaagtgctgggattacaggcatgagccactgctctcagctagaaattctttattctgggtctgcatacctacagattattactttcaccataattttttcaaaaggaacattgtgtctaggagcttggcagaaggaagatgccctttggaagtagtgtcccacagtcatgtgtctttttgaggactgcagtgcgcaaggatgacactgggccagtgctgagtgcccacctgcgggtggaggccacctttatccacggctggactaggacagatgcaggaaacgtataatgtattattttctcttgaaaatgacggcattaaggatagagagaggagctttccttacggattctaaataaaatactcttatctagctctatagactgctaataactgataggttattcacttgggtcacccagaaaatagacttgggtcttgactaaagcttgattaatttcttttttttaaaaaaaatactgtttactccttttggaggaagagtttgaatgtgccttctttaccttacagatttccagtgaggaaatatcaaccaagaaggaacaattatcggaagcacttcaaactatacagctttttttggcaaaacatggagacaagtatgttggttgtagttagctcttttattttaagtggggaagtattcttaaaagctttcagcaaaacagaggtggtaaattttaattgcaatgttaaatatgggactcaaactaatcacaattaatatagtaatgtaaagagtatcaacttagtaatttaattgtcaattttagtctttattacaactttgaaatattcttattatccccatgtattaccgataaggaaacaggctcagagaggtaagaattaatagcaagtgagaggtagagtgcagactccgagtcaagtcttaaatctaagtagtactctgtgagacttattctttggaaaatatgtataaatatggtcttcattttcttagctgagacctatggcagcctcgtttctcatattttgtccctactttttgcagcaaagcactttatatatttcagtcagtgtttcactcagggaaggaatccacctttttcttaaattctttttggatgtcctcctaggattatttcataatgactttatagtataccttagcaaattaggttaatccccttataaatttcctctttgtttgtgctttagtctaaacaagtttcatcttgagaaatggtaccttattgtcccttttccatgttgggattaacaatgagaccttaccctctgtcagatagcagcaattgttattttggaattttgtatgttaaataagggtcaatacattagtttacaccctttccttcagtccttttctcaggcaagggaaagatccttagatattttaaggccattcttaattttcatatacagtcatactgagacctgagcaatatgtatgtgaggctatattttattttaccatcatatgacaaaattattgaacctaatacatctttatctcttgaggacgacttgcattagtctttttatcatttctggttatttagaatgacagatgaagaaagaaatgaattggaaaaacaagtgaaaactcttcaggaaagttataatttattattcagtgaatctctgaaacagctacaagaatcacaaacctcaggagatgtaaaggtagaggagaaggtaatattatttatttaaacatgaggctgtttcaagaagcttagtttgattgcatggctctggaaatctatgtcaataataaagaaatgaccttgaattttgtacgtagttaaaatagggattgagtttatttaaatgtttggagattccagtgttgtttattaaatgcaatcttacacatgctgaccatcagtttctgtgacatcttaatctctgccttgcatggtaaaagaaaagtatcattcattcttctaactcttctctttaaaagccattcttctagtatagtaggtattttattatattataggctataaaagagcctgtgggtcatctctaaaggtggcattgatgtgttagagattgtttgactttcagagatatccatgagacttatttgagtaatacaaggccatacattatagtgaggatgccctagcatcttcttaaagtataaatcatttaaaatttggctggtacttaaacttttaaaacttgacagtgtatatcaacaggcctaacataatattcaatattcaaaaagttatctttatatttaattccttactcctgggaatactttccacataatttgtcacattttgggggtatgtaacaatttttccagtttcttagtttttgactatctttgaagaagtctgtatgctgtaaacatcaatagcatggggtttgatactctctttcctgccactagactctaatctcacctaaatgcagaaagcatggtttgccttctagatatgtgttctgttttctcactatcatcatctactctgttgtgtcctcactaaccttgtcaatatacacgatatcaagttttcaattcacagatgcatgttgttttcaaagcttttatcacatcctgtgctgttgaatagatcactgacatagatcacttgtgcatttgaactgcctaacattcacagcattgctgcgccttggtaagtagaggatttttatgttgaaatgtattatttattttttaaaaaacctaagttgcatgaaactccgcccacccttgtgtaacagagtgacctgagatttttgcattttcctttcagctggataaagtgattgcaggcaccattgatcagacaactggagaagtcctttcagtctttcaagcagttttaagaggcctcattgactatgacacaggaattaggttgcttgagacacagctaatgatttctggtctaatttcaccagaattaagaaagtgctttgaccttaaagatgccaaaagtcatggccttattgatgaacaaattctgtgccaactcaaagaactaagtaaagctaaggagattatttctgctgcgtcacctaccacaattccagtactggatgctctagctcaaagcatgataacagaatccatggccatcaaagttcttgagatactgctttctacaggctctctggttattccagccacaggagaacagttgaccctacagaaggctttccaacagaacttggtttcctcagcattattttctaaagttctggaaaggcaaaatatgtgcaaagatcttattgacccctgcacctctgagaaggtttctttaatagatatggtacaaagaagtactttacaggaaaacacagggatgtggcttctacctgtgagaccacaagaaggaggtagaataacattaaaatgtggaagaaacataagcattttaagagcagctcatgaaggtctcatagaccgtgaaaccatgtttaggttgttaagtgcacagcttctttctggaggtctgatcaattccaactctggccaaagaatgactgttgaagaagctgtcagagaaggggtgattgacagggacactgctagcagtatcctcacatatcaggttcaaactggtggaatcatccagtcaaaccctgccaagcgtttaactgtagacgaagcagtacagtgtgatttaataacttccagcagtgctcttctggtcctggaagctcagcgaggctatgttggactcatttggccccattctggtgaaatatttcccacatcatcttccttgcagcaagaattgattacaaatgaattggcctacaaaatcctgaatggcagacaaaaaatagctgctctttatattccagaaagttctcaagtcattggtttggatgctgctaaacagctaggaattatagacaacaacacagcatcaattttaaaaaatataacactgcctgataaaatgccagatttaggagatttagaagcttgtaaaaatgccagaagatggctctctttttgtaaatttcaaccctccacagttcatgattacagacaagaagaggatgtttttgatggagaagaacctgtcactactcagacctcagaagaaactaaaaaattatttctatcttatttaatgataaatagctatatggatgcaaacacagggcaaaggcttttgctgtacgatggagacttggatgaggctgttggcatgctactggaaggctgtcatgcagaatttgatggaaacacagccataaaagaatgtctcgatgtcttaagctcatctggtgtatttcttaataatgcttcaggtagagaaaaggatgaatgtacagctacaccaagtagtttcaataaatgtcactgtggagaacctgaacatgaagagactcctgaaaatagaaagtgtgctatagatgaagaatttaatgaaatgagaaatactgttatcaatagtgaattttctcagtcaggaaaactggcaagtacaatatcaattgatcctaaagttaacagttcacccagtgtgtgtgttcccagtctcatatcatatttaacacagactgaacttgcagacattagcatgcttagaagtgactctgaaaacatacttacaaactatgaaaatcaaagccgagtggaaacaaatgaacgtgcaaatgaatgtagtcattctaaaaacattcaaaactttccaagtgatttaatagaaaatcctattatgaaatcaaaaatgagtaaattctgtggtgtgaatgaaacagagaatgaagataatacaaacagggattcacctatctttgactattcccccaggctaagtgccttgttaagtcatgataaattgatgcacagtcagggaagttttaatgatacacacaccccagagagcaatggaaataagtgtgaagccccagccttatcattcagtgacaaaaccatgttgtcaggtcaaagaataggagaaaaatttcaagaccagtttctgggaattgcagctattaacatcagtttaccaggagagcagtatggacagaaatctttaaatatgatttctagtaatcctcaagtacaatatcacaatgataaatacatttcaaatacttctggtgaggatgaaaaaacacatccaggttttcagcagatgcctgaagacaaggaagatgagtctgaaatagaagagtattcctgtgctgtgactccagggggtgatactgataatgccattgtgtctcttacttgtgctacaccattgcttgatgaaaccatcagtgctagtgactatgaaacgtcactgctgaatgatcagcagaataacacaggaacagacactgatagtgatgatgatttttatgatactcccttgtttgaagatgatgaccatgattctttgcttcttgatggtgatgatcgtgattgcctgcaccctgaggactacgacacactgcaagaggaaaatgatgagacggcttctcctgctgatgttttttatgatgtctcaaaagagaatgaaaattccatggttccccagggggcaccagttggtagcttaagtgtgaagaacaaagcacattgtcttcaggatttccttatggatgttgagaaagatgaattagattctggtgaaaaaatacatttaaatcctgttggctcagataaggtgaatggacagtcactggaaactggatcagaaagggaatgcacaaatatccttgaaggtgatgaatctgactcattgactgattatgatattgtaggaggaaaagagagcttcactgcatcattaaaatttgatgacagtggcagttggagaggaagaaaggaagagtatgtaactggacaggaatttcactccgatactgatcatttagattctatgcaaagtgaagaaagttatggggattatatatatgacagtaatgatcaggatgacgatgatgatgatggcattgatgaagaaggaggaggtataagagatgagaatggaaagcccaggtgccaaaatgtggctgaagatatggatatccagttgtgtgcctctattttaaatgaaaacagtgatgaaaatgaaaatattaatacaatgattcttctggataaaatgcacagttgtagctctttagaaaaacagcaaagggtaaatgttgtacagctagcatcacctagtgaaaataacttagttactgaaaaaagcaaccttccagaatatacaactgagattgctggaaaaagcaaagaaaatctgttgaaccatgagatggtacttaaggatgtattgccgcctatcattaaagacactgaatctgaaaaaacttttggccctgcaagtatttcacatgataataataatatcagttcaacttctgaattaggtactgatctagcaaacacaaaggttaagttgattcaagggtcagaattgccagaattgactgattctgtgaaaggtaaagatgaatattttaagaatatgacaccaaaagttgactcatctcttgatcacatcatttgtactgagcctgatttaataggaaaacctgctgaggaaagccatttgtcattgatagcctctgtaactgacaaagatcctcaaggaaatggaagcgatctcattaaagggagagatggcaaaagtgatattctaatagaagatgaaacatcaattcagaaaatgtacttgggtgaaggagaagtgcttgtagaaggtctagtagaagaagaaaataggcatctcaaacttttgcctggtaaaaatacaagggatagtttcaagttaattaatagtcagtttccatttccacaaatcacaaacaatgaagaacttaatcagaaaggaagccttaaaaaagcaactgtaactcttaaagatgaaccaaataatctacaaataatagttagtaaaagtcctgttcagtttgagaatcttgaagaaatttttgacacatcagtttccaaagagattagtgatgacattacttcagacattacatcgtgggaagggaatacacattttgaggagtcattcactgatggacctgagaaagagcttgatctgtttacttacttaaaacattgtgctaaaaatataaaagcaaaagatgtagccaaaccaaatgaagatgtcccaagccatgttttaataactgcccctcccatgaaagaacatttacaattaggagttaataatacaaaagagaagtccactagtacccaaaaagactcacctcttaatgacatgatccaaagcaatgatctttgtagtaaagaaagcatctcaggaggaggaacagaaatttctcagttcacaccagaaagtattgaagccacactttcaatattatctcgtaaacatgtagaagatgttgggaaaaatgattttctgcagtcggagcggtgtgcaaatggattaggaaatgataactccagtaacactttaaatactgactattcattcttagaaattaataataagaaagaaagaattgagcaacagctaccaaaagaacaagccttgtctccaagatcccaagaaaaggaggttcagattcctgaattgtctcaggtatttgtggaggatgtaaaggatatcttaaaaagcaggttgaaagaaggtcatatgaaccctcaagaggttgaagaaccttcagcctgtgcagacactaaaattttaattcaaaatttaattaaaaggattaccacatcacagttggtaaatgaggcatctactgtgcccagcgactctcaaatgagtgactcttctggagtttcccccatgactaactcatcagaactaaagccagaaagtagagatgatcctttctgtattggaaatcttaagtctgagcttctccttaatatattgaagcaagatcaacatagccaaaaaattacaggagtatttgaattgatgagagaattaactcatatggagtatgacctagagaaaagaggcattacgtctaaagtacttccactgcagcttgaaaatattttctacaaactgcttgctgatggatattcagagaaaatagaacatgttggagactttaatcaaaaagcatgttctacatctgagatgatggaagaaaagccacatattcttggtgatattaaaagcaaagaaggaaactactattctcctaatttagaaactgtaaaagaaattggactagaaagctctactgtgtgggcatcaacattgccaagagatgagaagctcaaggatctgtgtaatgatttcccaagccatttggaatgtacttcagggtctaaagagatggcttctggagatagctcaaccgaacaagtaagttgacctatacattttatacagaaaaagctgcatgaaccatgtgagaataatcccatacatttgctttaaacatctgcataaaggttattgaattaaaatgtccaactttgtttttagttttccagtgaattacagcagtgtttacagcacactgaaaaaatgcatgagtatttgacattgcttcaagatatgaaaccccccttagacaaccaggaatctctggataacaacttggaagctttgaagaatcaacttagacagttggaggtaagaattgtctactgcctctttatggatggtagtcagctgatgtatgactgggaaaaagaagcagaacacttctatgtttcatgtttatatttgggtttttcactaaatagtaaataggtccgggatatatttctttgcagacatttgaattgggattagctccaattgctgttattttaagaaaagatatgaagttggcagaagagtttttaaagtctcttcccagtgactttcccagaggccatgttgaagaattgagtattagccaccagagtttgaagaccgccttctcttccctcagcaacgtgtcttcagaaagaacgaaacagatcatgcttgcgatcgactctgaaatggtaggcataaaatgtcaaaattttgatttatgaagaaaattttattatttgaggatttagtcataagctggagtattttagttttagagtgctaactcttaaaccacagtcattatttgtaagaatttgacattttggggaaagataactgaatgcacaatttttttttctagtctaaactagcagtttcccatgaagaatttctgcataaacttaagtcattctcagattgggtatcagagaagagcaaatctgtgaaggatattgagattgtgaatgttcaagattctgagtatgtaaagaaacgtttggagtttctcaaggcaagtatcaaaacaaagatgacaaaatatatttcaaaaactatgactttaatatataacaagtgtttagaaaatatgactttgctaaggctacaaaggattatttcctttctttgtctctagagatgtctttattcatagttgacacaactataaaataatcacaactttaagggtatcattctgatgctatcccaaaagccttatcatactcttacaccactgacatgttgagatttttatttatatatttatttatgtgttagtcacataaatatataatagtatgaattagccatataaaaatcatcatgtaaatacataataatatttgtagtacagtcatgcatcacttaatgatggagttacattctgagaaatgcattgttaggtgattttgtgttttgcaaacaacaaggagtgtacttacacagacctagatggcatcctttactgcacacctaggctatatgatatacctgttgctcctaggctacaaacctctacagcatgttactgtactgactactgtaggcaattgtgacacagtggtttttgtgtatctaaacatagaaaacgacaggaaaaataaggcattgtaatcttatgggaccaacattttatatgtgacctgtcgtatgtggctcatgactgtgtttatatgttgtcacttttggcatactttttttttttttttctaagttcttaatttcaacagcattcctcatgaacaatgattaggcttctggcctgagagtcagaaaactgaaattctggcatatttcattcatatttcaaatccctcaaagtattatttatatcttaccacaattacatggatgttgtaaatgttagcaagtcatattttaaggtagatgtttctcttcagtgtgctaaatatacctaagttaggtctttgccttttgtcagagttatattttaagtgcaatgtgacaggtaaagataaaacatttttagagggattatttgtctttttatataatactaactaccatggtatttaaataattaatttatcatttattactagatgataaatagatttttgatgaatagcaaaaaaattcataaaacttccattccctgatgtgagaaatgtatttacaaaacataaatattattgttaatataaattttatcatggcttaactttctactgatagcttgtactacttttttaacagaatgtattaaaagaccttggacataccaaaatgcagctggagactactgcctttgatgtgcagttcttcatttctgaatatgcacaggatctgtctcccaaccaaagcaaacaactgctgaggctcttaaatacaactcagaagtgttttcttgatgtacaggagtcagtaactacccaggtggaacgtttagagactcagttacatctagaacaagatcttgatgatcagaaggtttgcctttcttcgtggagttggcattcattgtttttagtgtgaaaccataatgtagatacccaaggagtatagtgtgacaggaaagattttctggaaaggcattaatggataagatacagtgtacatacaaatcctacagtgtataacaatattgttttcactaatgatgctataatttagttgatttgaatttttgtgactcccaaaaatacttaacttcaagtgagagtcttgattgcctcccaccccaagactaggaaatttgaatgcacttagaaatttaacacattgaggaacatatgactaaagaaggttaagagtttcgttttcctctgggaaccaatacagcacagcaattcagatcatgggctctggagctagattgcctgatttcacatcccagctgcactactcattcattctgtgaactagggcaagttacttaacctcagtttaatcattggtagattggaaataacaatagcgcttacctgctagtgttgtgagcattgataaaaagaatgtatgtaaaacatttagtaccttgcctagcatgtgttaggctcttagtaaacgtgatctatggctataagatgaataattagtgtatacatagtaggaaaatgaaaggtgcaagtaattagtgttgacttcttaatcttttagaagatttaatgaattatatgagtgctatatctaatagcaataacgagcaaagaggtgagaatgcacttagacatagtgattaagtaaaaatattgcatgcaatgttccttttattatttcttgaagcaccagacattgtctctagcatgataacctatatacacatatcaaatatgttaacctacaaatcacaactaacttctcttttgatgtccttttgcagaattaattctatgtgtcgcaggtttcaacagcttaagaaaatgggatgtttcttcctgttggtcagaagttccatctcttacaaatatgcatggccagtattctcttgagcagtttcatctaaacatgatcactttctttgtatatgggatatgctcatattttctgtctcaccttgctcagtttgtaccctactgctatcatgtttacagcatacttataaaagcttattagacaaaacttggaaaatgtgttctaataagaagctatcacaatagcgattttgtgaccaccatacatttaagatgttttgggttttcttcactttagattgtagcagagcgtcagcaggagtataaagagaaactccaagggatatgtgatcttcttacccaaactgaaaaccgcctaattggtcaccaagaagccttcatgattggagatggcacagttgagttaaagaaatatcagtccaagcaagaggtagaatttggttttctatcagcagatctatgttgatgttatgttcgattactatcatttggaagtcagtgaagattattgaaaataccagtaattttagctttttagaagcaaggcatacccaagacgccctgggcttgagctttaaactttatactaaaagttagatttccaacttcaagcaagctaggtaatttttttgactttttttggtaagagatattgagtggaggaaatattaaaggggatttgataatgaaaataccttgtgtgatgaattagaatttggattcatttaaggccaacctacttactacttgcaaatcagaggaaatagccatcactttgggttctttctctttcttagctccttcttactccttctttcttgtgatttgttcctttttattgaaggaaagggcaaaaataacagtaacaacagataaagatatctttattttggtgtcaggacagagaacattttcattgtaagtagatagctcctggttcagattccagactctatacattgttagctttataacagtctgtcacagcctcagtttcttcataggtcacactttgttacattattataaaagttaagtaaatattgtgtaagtcactagcacagttaaggtcacatagtcatggctcaattaataggatttctttcaattcaaatacttctaagacaaatttgaagaagattaaaataaagtatggaaaaaataatattaaaactcagtatcatatagagaatgaaaatgcatgataaaggaggaaaagaagaggaaaaactacatggaaaaatctagacataggaaagctataactactaaggagagatcttaatcttgaggtacctagcagctaggcaaagaagcaaacattacatattacagattctggtgtttagaaaaggaaagtatcttagttcactgggaaaattagttcatttttatcctgagtgataaacacattaaaaaataaaagtttagaaacaataaatattagcatatatttacaagcctttgtacatgtgctcatataatattaaaaaatctggtgtgtgcaaatttatatagatcatatactgaatacttatgtgttttcagtgtttcactgactgcattctttcgttaaacatgaaaattcatgcttttctttaatattgtttgagtttcaaattatattaagtattgtgattgaaactcaaattaacatactcaatatgtttattcaagctacatatactagactctctctgtactcactctgtcttttagaattacaactctggaagaactaaataggtaataatttaataaaatatattttttccttttgtgttataaggaattacagaaagatatgcaaggaagtgcacaggcattggctgaagtagtgaaaaacacagagaacttcttaaaagagaatggtgaaaagctgtcacaggaagataaggctttgattgaacagaaacttaatgaagctaagataaagtgtgaacagcttaatttaaaagcagaacagtctaaaaaggagctggataaagttgtgacaacagcaatcaaggaagaaactgaaaaggtccttattcaaatatgtggtgcactattgctatgtcaaaaagcttaacagctacttgatttattattaatatccagtggtagtaaataaggattatcactaaggattattatgggattctgggtttccaggtacataattgaccaagtactacaaaaggtttgaagagttggctttgcttaactttttcttaatatttaagtgaggttgtgaaactttcttcttgtgaaatgtgtgatcactcatcaattatagttaaaattttggaatgtatttttaagaacaggggaaacttcaaagtaactgcctgttgctctgaggtttaatttcagttgttaagttttcaattgtgtcagtttttagtaccctcattctaatttaaaatgttctaagtatttacttttggaatgtcttaaaactatgccttggcccacgttctgaattcctcctgtgaactttcccttcccaggtagcagcagtgaagcagctggaagagagcaaaaccaaaatagaaaaccttttggactggttgtcaaatgttgacaaagactcagaaagggcagggacaaaacacaaacaggtaatcgaacagaacgggacccattttcaagaaggtgatggcaagtcagcaattggagaagaggatgaagttaatggtaacctgttggagactgatgttgatgggcaagttggaaccactcaggagaatctgaatcagcaatatcagaaagttaaggtgtgttgttataaacatatgatatcgttcaattctatttccaggttggtaaagagagaaataacctagcacatgagttcttttcaaaccttactgacaaaagaggtttttttctgtgttcatcatgtcagatataaattattatgagagttctaagcaagtcaaaaaataatgagaaataaattgtagagttggcattctccatgtaagtgaagtagaattattataaagatttaataataatagttaacatttataggacagttaaagtgggcactcttctaagttctttccattttaactcattttgtcttcccagttactccttggggtttttattttcatcttacagatgaggaaactgtaactgacagtattaaagtagctttctcaagttacatatctagaaagggctggaatttggatttaaaactaggccatatgttcactctgctaagtctgaatctgtgttctaagagaacaatcttttttttttttttgagacaaggtctcaccctgtcgcccaggttagagtgcagtgaaacaagcatggctcactgcagcctcaaactccctggcccaattgatcctcccacctcagcctcctgagtagctgggactacaggtctgtgctgccatgcctggctaatttttgtattttttgtagtgatgaggtctctctatgttgcccaggctgctctcgaagtcctgggctcaagcattccgcccacatcctcccaaagtggtgagattacaggcatgagccactgtgtccaggctaagttgagctcacttaagttctttctgagctcagctcacctattcagttaaggctattgttgagaagagatataaaagcccttctaccaatttactccatgacataaattaaagctaacattaatgctactataagagcaaaggcgacttctgtagaactacttttaaagtgtcactcattttatttcaatatttggcttttgacagacggtttctggacctcagaaacttttgcaggtctatttattttgttcctacccttcatatttggaatctttggaatagggtactccctgtgaggttcttatagaaaatacaaattaaaccagaagaagaatgggagtatttactgctcacaattttaacgggctattataggaccttattatgaaaaataaagtctcttaaaatgaaaaatctagtgaattcctaaaggaacattgtgagtcagttacaaagaagtcaggaaaagttagtaagttgaccaaagtagtgagaaatactggtgggtagacttaaacataaagatatcacacaggaaagcccttggttttaggcacagtgtggcatttcccatctgatcattttacctcaaagaatatgggaatctgtgctttagaaaatcctaatctgggccaggcgtggtggctcatgcctgtaatcccagcactttgggaggctgaggcgggtggatcacaaggtcaggagattgagaccatcctggccaacatggtgaagccctgtctctactaaaaatacaaaaattagctgggtgtggtggtgcgtgcctgtaatcccagctacttgggagactgaggcaggagaatcgctggaacccagaaaacagaggttgcaatgagccaagattgtgccactgccctctggcctggcgacagagcgagactccatctcaaaataaataaataaataaataagtaaataaataaataaaagaaagaaagtcctaatctggcagcatggagagagggccaaagcacctgagccaggaacgtctagctttcagtagttgtcccatatgtcctgggccaagccattctcttccttcagcctaagagtcctcatctgtaggaggaaggggatggatctgatcatttatatggtgttgcatatgtctgtccatgctattttgtgcaaagcccttctcggggtggggtgggggtagcatatgaatgtatttcaaataccaaaaacacaagtctgtgggaaagaagttagttaaaaatatttactatgtgcccactaggtggcgggcactgttatagacagtgaggataccagtgttaatgagccagttctgagctgactaattgggatcagacttacaagtgaacggctgccccatagcagtgcttctaaggaagtccttttcacagcatagagttattcttactcagctcctgtgtgccagcactgttctaagtacttgggattacacagtgagcaaaataaattccctgtgccccccttgcacactagttagtgagaatgttacagtagacaataactaagttatatggtaggttagaaggcagtgagtactaagggagaaaaggagttaggtaagggtggttgagtgtggggtgggggaccagttttcagcatttaaacgggactcaatggagatgggtgcaattagccaagcagatatctgatgaaagagctgtaactagacaacaacaggagaaaaagctcctaaagtgtttaccagggtggggatggaggtaagggtgggagcagcaaagaatctggaggtaataaaaggggctctggggtaatgggagcgggtcatttggctccatgtaagccattataagaaatgtgggaaattgcccagaaggattagtatcctttttgccacacttgtatggcaaattggggtgaatggaagaagatgcttatggctggagggaaagggacttcacctacctgatgcctccctgcttccctgaagactgaggggatcagtagctctgcacacctgtgacttgcctgcagcacacctgcctgggagccctgccttcctgccttcagagtggatttgaatttctggcacatgcccagctctgcaggaagtgctctacatatgtgatctcatgtactccttaacagcaacctgtgatgtgtaggagttattgtctccattttcacatgcaggaaactgaggcccagtgaagctgagtagctccaggattctcttttattatatctgcttctctaatgtccattgggcttctctgaatgtacagtgttcttgcttagttatttttgaaacctttttaaagcttaaagttacagattctttttccctatttaaaagtttttccaggatcatttcgtaataaaaaatattatacttgtttgtccaaaaattaggtaaagacattcttttttgggtagttgtgagaaagcagggaataaaatgagatcagattatagacacttattttaaaattggaatagaaattggtttttctaaacttctgaaaaatggtgtctgtcctatctgattaagtacatagagaagattggaaattttctttaaaataagattagcatgctcaaaatgccttgttattctgaaatccaccaataaaagggagtacggtatagcttgaaaaggggaatgagaagcaagttgtagccctgtagatcattgaaacctgtcagtcttgaggcggcaaggagctccctgcaggtgttaccccgttactgcttgaagattatgatcaatttgttttcacataggcccaacacgagaagatcatctctcagcaccaagcagtgatcatagccactcagtctgcacaagtgttgcttgagaaacagggtcagtatctctctcctgaagaaaaagagaaactgcaaaagaacatgaaggaactgaaagtgcattatgaaactgcactggctgagtcagagaagaaaatgaagttaactcactctctgcaggaagaattagaaaagtttgatgctgactataccgagtttgagcactggctacagcagtcagaacaagaacttgaaaacctggaggcaggtgcagatgacatcaatggtttaatgaccaaattgaagaggcagaagagtttctcagaagacgttatttctcacaaaggtgacttgagatacatcacaatttctggaaacagagtgttggaagctgccaaatcttgcagcaagagagacggtggcaaggttgatacttctgcaacccacagagaagtgcagcgcaagttggatcatgctactgatcggttcaggtctctctactctaaggtaatgttattttgattttttaagggaaaagtcaatctgcaattatagttttcaattatagttttggaacaagaggcaagaaacctaaaatccaaaacaggaggaaaaggtagctttagcctacttctatttttttttttttttttgagaaggagtctcactctgtcgcccaggctggagtgcagtggcgtgatctcggctcactgcaacctctgcctcccaggttcaagcaattctcctgcctcagcctcccgactagctgggactacaggcatgtacccccacgcccgtctaattttttttctgtttttagtagagatggggtttcactgtattagccaggatggtctcgatctcctgacctcgtgatccgctcacctcggcttcccaaagtgctgggattgcaggcatgagccacagtgcccagccttctctctatcttattcacctgctttacttctgaacaatgtatttaaatatgagaaacttaaagttactttagtttttgagagcatgatttccagaagtcccagctctcaaatgctctaatatccagtgtgaccacaagatggcggttgtgcattgactctaagcaaaaacagatgcttgcagcctctcaagcttgggaactggtttcatctcagattatcctcttcacaaacactgcaggtgtttgtcttgtatatttgatcagtatgttattttaatacttaatgaataaaagactgttttgcttgttttacttctgtggtcaagtaaaaggttttttttgaaaaaaaaaaatctaagaaaatatttactggtttgtaatataatctgaacagacttgccaagttgcataaatgatttaaagaccatcactggctcttggactttgctccattctaatatagactctttgtcttccttttgttaattaacttgtgcaacatatagaaatttattaagcacctttaaaacccttccatcaaatcgatatctatacacatggtgtatcaaaatctccttcctctgatgattgatgtctttatcttttattctatgttaagactcagctcttgtaaatatgtttttgaattggtataaatccagaactatctctttattttatggttactttttggcttcttatagggtacctcttcatataaaggaggaaatcttagcccaacagagtttttattaactttggtggaagtctggttttttttccaagttacatattttataggtcctaagattatttgatgcatatgaaaatagtgggttttaatctcctaccccttttctcttttgattgttagtgcaatgttcttggaaataatcttaaagatctggtggataaatatcaacactatgaagatgcttcatgtggacttcttgctggactccaggcctgtgaggccacagcgagcaaacacttatctgaacctattgcggtggaccccaaaaatcttcaaaggcaattagaagagaccaaggtaaaaagcgagagaaagatccacatttccagtagtcttactgaaaggcttccaatttctcacacttttgtgatagtttcagctaagagaggggaacaaatgatgtgaaaagtatacttctgcctccagaggtagttttgactctatttctccacagtacattctttttttttccgaattttttttttttttttttttttgagatggagtctcactccatcgtgtaggctggagtgcagtagtgtgatctcagctcacggcaactgccgcctcctgggttcaagtgattctcctgcctcagcctcccaagtagctgggactacaggcgcccgccaccagctgggactacaggcgctaatttttgtatttttagtagagacggggtttcgccatgttggctgggctggtcttgaactcctgacctcaggtaatccacctgcctcagcctcccaaagtgctgggattacaggtgtgaaccaccgcgcccagccttcctgatgttttcttaacaggtttgacattgctgttatggcttgtgacgtgcccctccatccccaaacaaaactcagtattttcctggccacttatttatctttatacttacttatcttgttcactgttttttcctccattagaattaagctccacaagaacacgtgtctttgtctgctttattcattgctgtattcacagcacctagaatattacctggcccaaagttggtactcaataaatatttgttaaggaatggacagttggaagggaagaagggatgctaccatcatattcagcggttctaaggaccaggattagggttcttactgaatatcttcatgattcatagagatacaaacttgaataattactcaatacagttctcaaaaagtccacctgctctttcagaaatacaggcttggtgtcaaaactgcataacagtgcgattctcagtcatacagtggtggagagttcttaaatctatttttataatgtaaaacttattttaaaattctaaagtaaaggatgagaactaatgtgaccaataattttgagtttaaaagtttcattccatcaatctattatatgattccatttcacaggttaataatagtaggttattactgctacagctagaaaataaacacaggattgccagttagacagctgtctttcagaagttaattgcatattatttacagagtcgaaaaattgtgctgttagcacgggaaacaggtaccctgctgggcaagcttaaagttaggtattgcctgagattgacaactctggaaagctaagtcatacccgggtgaaatgtggcaggttaatatcaggcagagagaaggcccgtgaaggggtgggaagcataggatgagagcagggaaggaggtcaagctgggaggtcaagagggtggagggcactgcttctttcccaggctgaagagtttatccagcccttcactggacactagggagatgatgtgggccaggtcagcatccccagatccatgcagcctcctcagggttgcttccttttttccaatgtgcattttcagtcctgtttttttttctttctcctttccacaggtacaagaacaaatctatcttaattaagtttttatatccccatgtattgtatattcaaggacaagatatgtggtgggggtagaggagatactgtgacattaaggtcattattttagtaggaaatacgtatcatttaaaataattattgattgcatatattacatttaattaggaagttattttaagtatagaaaatgcataaaatagaaataacacattttaagttagatctatattagtaaacagattatactgcatataaaagtaatttttatataactagagcagaaaaagaataaaacccaaagaatgtgatggttttttaattaaacagatatgtggataaattttaaaacggaaaaacctatttagtaattgctgcagaagactcttacagtcctaagacagttaaagaaatatgaaaaagaaagagatctcaaaggagaatgaattctaattaagtcatagcgtaatttgaaaaattaaatgtacaattaaagttgttgctgataatgcacatatttttctctcagaagatttcagaatgtatcaaggataaatttttatgaggattaggtggcctccatttctttgatgtttattaacattttacaattacttttaacaataatataaacccatgagactactacaaaaaatcgatctttctacatgtagcatactatcttctacttatattctgatgaatcataaatgtaatttttggggcatccaatttgttcatttcatttgaaatgcttttggccaatagcatgttgttattagcattattattcaaagaactgtgaactgtgttgtcaacaatctgatactactaggccataataacactcctcaagatccccttccagggaaattagtggataaaacaagattttagccccataagaggtgcagaaaacaggattttgggaccagtctcaaggcctgggtgtggaaccagcaatggggattgcattgactgacaatgtcagccttccagacttgcgctaatctttggggtggtgttaagtcaggaaacttttatgaattgtacaaatgcccagaagtgtatagacttcgctgtcttctggtcccaacaggtattctcttgtcacagatccttctttcatgtcttaatttccttgaaatccattcaaaacaatataaggtacccatttgaatactgtaattaacagttttttttccaaaatagcactataaacaactattattgttaaattaggaccttgatacttgctaggaattaaaaatgattaactctcctgaatataattgtcaagagtaaaggcatgtgatgttttgagaagaagaggtgaagaagacatgcttcttttataatgcacttctaagttttaagctggtagtcagggccatctttggtattggatattctaatagaaccatgatcacttttagatgtatttattcattcagtaaatgtttgtatgctgagtttcatgaaggcacaaagatgttaaaaccctgtctctgcccttggtgaactcacaatctaaaaaaaattttcggagggtacccttcacttacttcatctcctaaataaccatgttatatgaataaactgtccctgtggtctagattcagtgtggtcacaggtaaaaagttcatgtcttgagggatttttttttacacttcccgtaattaaactgctaggagaatttttcaaacagatccactctgatgaggattctttggcatcttgaaacaactgtaggttgtggtattctagatcctatgttggtcgtggtttggtgggccttttgacatatgcacagactgcctgtatgtcatctcagtttcttggatatgaagattagttgaggaaatttttgccattagctttaggcatttaagtaatgataataaataatgctgaaatagaagaaaacctttttaggtcttacatctgatatgttcatttatttacttagttgctgatttattcctgaaaaaaatttttggagcctgctatgtgtcaagcactgatctaggcactagtaatagaaagccaaaagggatgacttcctagttctcaagaaggctatagtttgatagaagacacagaaaaatccaataatagtcacagggtatttatgggatttcctgtaaggagtacttactaaagctaggagtgaggagagacttagggaaggttttccagctgagtattaaaaggtgaagaagagccaagttcaggatggcgggggtaggttgcatgaaaaagttggtatgtagagtttctaagacattgggtccagcatgaataaatagctaagaaatagctgtgttagacatttctggaacagaaagttgagattgaaggtagaattagggaatagatttcattggaccttttagactatagcatgctcaagtcttggcctttttgtcaagggagactactaagagattttaacagggttatttggctgttcttgtgttgctataaagaaatacttgattggagcatttagtccatttacatttaaagttaatattgttatgtgtgaatttgatcctgtcattatgatgttagctggttattttgctcgttagttgatgcagttgcttcctagtctcgatggtctttacattttggcgtgattttgcagtggctggtaccggttgttcctttccatgtttagtgcttccttcaggcgctcttttagggcaggcgtggtggtgacaaaatctctcagcattggcttgtctgtaaagtattttatttctccttcacttatgaagcttagtttggctggatatgaaattctgggttgaaaattcttttctttaagaatgttgaatattggcccccactctcttctggcttgtagagtttctgccgagagatctgctgttagtctgatgggcttccctttgtgggtaactcgacctttctctctggctgccctttacattttttccttcatttcaactttggtgaatctgacaattatgtgtcttggagttgctcctctcgaggagtatctttgtggcattctctgtatttcctgaatctgaatgttggcctgccttgctagattggggaagttctcctggataatatcctgcagagtgttttccaacttggttccattctccccatcactttcaggtacactgatcagatgcagatttggtcttttcacatagtcccatatttcttggaggctttgttcgtttctttttattcttttttctctgaacttcccttcttgcttcatttcattcgtttcatcttccatcgctgataccctttcttccagttgatcgcatcggctcctgaggcttctgcattcttcacgtagttctcgagccttggctttcagctccatcagctcctttaagcacttctctgtattggttattctagttatacattcgtctaaatttttttcaaagttttcaacttctttgcctttggtttgaatttcctcctgtagctcggagtagtttgatcgtctgaagccttcttctctcaactcgtcaaagtcattctccgtccagctttgttccgttgctggtgaggaactgtgttcctttggaggaggagaggcactccactttttagagtttccagtttttctgctctgttttttccccatctttgtggttttatctacttttggtctttgatgatggtgatgtacagatgggtttttggtgtggatgtcctttctgtttgttagttttccttgtaacggacaggactctcagctgcaggtctgttggagtttgctagaggtccactccagaccctgtttgcctgggtatcagcagcggtgtctgcagaagagcggattttcgtgaaccgcgaatgctgctgtctgatcattcctctggaagttttgtctcagaggagtacctggccgtgtgaggtgtcagtctgcccctactggggggtgcctcccagttaggctgctcgggggtcaggggtcagggacccacttgaggaggcaatctgcccgttctctaaatgctccaattaaaagacacagactggcaaattggatcaagagtcaagacccatcagtgtgctgtattcaggaaacccatctcacatgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaaccagaagagctaactatcctaaatatatatgcacccaatacaggagcacccagattcataaagcaagtcctgagtgacctacaaagagacttagactcccacacaataataatgggagactttaacaccccactgtcaacattagacagatcaacgagacagaaagttaacaaggatacccaggaattgaactcagctctacaccaagcagacctaatagacatctgcagaactctccaccccaaatcaacagaatatacattttttttcagcaccacaccacacctattccaaaactgaccacatagttggaagtaaagctctcctcagcaaatgtaaaagaacagaaattataacaaactgtctctcagaccacagtgcaatcaaactagagctcaggattaagaaactcactcaaaacctctcaactgcatggaaactgaacaacctgctcctgaatgactactgggtacctaacgaaatgaaggcagaaataaagatgttctttgaaaccaacgagaacaaagacacaacataccagaatctctgggacacattcaaagcagtgtgtagagggaaatttatagcactaaatgcccacaagagaaaggaggaaagatccaaaattgacaccctaacatcacaattaaaagaactagaaaagcaagagcaaacacattcaaaagctagcagaaggcaagaaataacgaaagtcagagcagaactgaaggaaatagagacacaaagaacccttcaaaagatcaatgaatccaggagctggttttttgaaaggatcaacaaaattgatagactgctagcaagactaataaagaaaaaaagagagaagaatcaaatagacgcaataaaaaatgataaaggggatatcaccaccaatcccacagaaatacaaactaccatcagagaatactacaaacacctctacgcaaatacactagaaaatctagaagaaatggataaattcctcgacacatacactctcccaagactaaaccaggaagaagttgaatctctgaatagaccaataacaggctctgaaattgtggcaataatcaatagcttaccaacgaaaaagagtccaggaccagatggattcacagccaaattctaccagaggtacaaggaggaactggtaccattccttctgaaactagtccaatcaatagaaaaagagggaatcctccctaactcattttatgaggccagcatcatcctgatcccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacacaaatcaataaatgtaatgcagcatataaacagaaccaaagacaaaaaccacatgattatctcaatagatgcagaaaaggcctttgacaaaattcaacaacccttcatgctaaaaactgtcaataaattaggtattgatgggacgtatctcaaaataataagagctatctatgacagacccacagccaatatcatactgaatgggcaaaaacgggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcaggcaacatgattgtatatctagaaaaccccatggcctcagccccaaatctccttaagctgataggcaacttcagcaaagtctcaggatacaaaatcaatgtacaaaaatcacaagcattcctatacacccataacagacaaacagagagccaaatcatgagtgaactcccattcacagttgcttccaagagaataaaatacttaggaatccaacttacaagggacgtgaaggacctcttcaaggagaaatacaaaccactgctcaatgaaataaaagaggatacaaacaaatggaagaacattccatgctcatgggtaagaagaatcaatatcgtgaaaatggccatactgcccaagataatttatagattcagtgccatccccatcaagctaccaatgactttcttcacagaattggaaaaaactactttaaagttcatatggaaccaaaaaagagcccgcatcgccaagtcaatcctaagccaaaagaacaaagctggaggcatcaagctacctgacttcaaactatactacaaggctacagtaaccaaaacagcatggtactggtaccaaaacagagatatagatcaatggaacagaacagagccctcagaaataacaccgcgtatctacaactatccgatctttgataaacctgacaaaagcaatggggaaaggattccctatttaataaatggtgctgggaaaaccagctagccatatgtagaaagctgaaactggatcccttccttacaccttatacaaaaattaattcaagatggattaaatacttaaatgttagacctaaaaccataaaaaccctagaagaaaacctaggcattaccattcaggacataggcatgggcaaggacttcatgtctaaagcaccaaaagcaatggcaacaaaagccaaaattgacaaatgggatctaattaaactaaagagcttctgcacagcaaaagaaactaccatcagagtgaacaggcaacctacaaaatgggagaaaattttcgtaacctactcatctgacaaggggctaatatccagaatctacaatgaactccaacaaatttacgggaaaaaaacaaacaaccccatcaaaaagtgggcaaaggatatgaacagacacttctcaaaagaagacatttatgcagccaaaagacacatgaaaaaacgctcatcatcactggccatcagagaaatgcaaatcaaaaccacaatgagataccatctcacaccagtgagaatggcgatcattaaaaagtcaggaaacaacaggtgctggagaggctgtggagaaataggaacacttttacactgttggtgggactgtaaactagttcaaccattgtggaagtcagtgtggcaattcctcagggatctagaactagaaatactatttgacccagccatcccattactgggtatatacccaaaggtctgtaaatcatgctgctataaagacacatgcacccatatgtttattgcagcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcacaaggccaaaaaaccaaacaccgcatgttctcactcataggtgggaattgaacaatgagaacacatggacacaggacggggatcatcacactctggggcctgttgtggggtgggggtaggggggagagatagcattaggagatatacctaatgctaaatgacgagttaatgggtgcagcacaccagcatggcacatgtatacatatgtaactaacctgcacattgtgcacacgtaccctaaaactttaataaaaaaaaaaaagaaaagaaatacttgagactgggtaatttataaagaaaagaagtttagttggctcacgattctacagggtctacaagcatggcactgacatcactcagcttctggggaagcctcagggaacttttactcatggtgcaaggcaaagcaggagcaggcatgtgacatggcaaaagcagaagcaagtgagagagagagagagggagagaggtggggaggtggggaagtgctacatacttttaaatgaccagatcttgctagaattcactcactgtcgaggacagcaccaagatgatgatggtaaaccattcatgagaaatcatctcccaccaggttctcccttgaacattgaggattgcatttcaatgtgagatttgggcggggacaaatatccaaactatatcaggggtgatatgtggtcagatgtatattttaggtagaacacattaggagctatattagagaagtgattggaggcaggatctaacacagttaggattcttttttcaacaatccaagagagagattatcctggaatgatccagaaatatggagcaaaagttgacttttaaaaaatattaagcaggtaaaattgttgattgatttgcacgtgtggaaaaaaaaagctttaaatggttgatttgcatgtggaaaataagccttaggatggaatctaggaggaacttcaggttgactatttgggtagttagatataccccaggagaaagtataggtacagagaatgagatgatgagttcagattcagcttttttgagttggaggtgactgcatacatccagatggaaatactcaagaggcagttggaaagctaggcccatggccaaggatgagttcacatctacaactggacattgggggctttgaaatccaaatgcaggagtagaagaggagcatgagttgcttaagataaattaaagctgggaataggcctgtgtggccaggcagcccacttttgcagaaatctgtaagagctgttagaaatgcagggtcaaacttctggaagacgtatctatggctcctgcttccacctttttttcctccttcccattgttgagccacatctgttcactcagagatacgcggggactgctactcattaaattcaaggactcattagtctttcagtttacattatcctttccgaagcagttgacactgttaaccttttccacttctctcttcctttaatctttggggacagagttattctgggcccatttccaccccatcaattacatgtgttcttttttttcttctctccccatcacttatatataaatattctccatgattctttagaatctccttctctggcattcctgtgctttcttgtttaggagtcacattgtgtatcttgacttccaattctctatgtctgtttccagtttgggttccaactctcttccatttccagtttttgctgtttccttctggaggagggtcccaaaagcactttgaaatcatgaattccaaaacaggcattcctttactcttagcttgctctcactttttttttttttttttttttttttaataaatgccactaattggctgggagccttggctcattcctgtaatcccagcactttggacggccgaggtgggaggattgcttgagcccaggagtttgagaccagcctgtgcaatgtggcaaaaccctggctctacaaaaaatacaaaaaaattagctgggcatggtggcatgcacctgtggttctagctaattgggaggctcaggtgggaggatcacctgagcttgtgaggtcaaggcttcagtgagccaagactgtaccagtgcactccagcctgggcaacagagtgagacgctgcccccccaaccaaaaaaaaaaaaaaaaaagaaaaagtaaattccgctaattacctaggctcaaaatctttggacacttctactcttgtctcctcttgtcctttgttcctgccctctccagcagtgctgtctactagaacattctgtaattatgaaatttatttttttaaatttttatttatttatttatttatttattttaagaaagtaggaatatcactctgtcacccaggctggaattaacagtagcatgatcatagcccactgcagcctcaaattcctgggctcatgcggtcttcctgactcagctcctgagtaattgagactacaggcacagactaccgtgcccggctaattttttaatttttttttgtaaagacaaggtctcactttattacccaggctggtcttgaactcctggcctcaagtgatcctcccaagttggcctcccaaaaagcgttgggattacaagtgagccaccgcaccagctggaaatactttacttatattttgctctgttcaattggtagccactagccacagtgactacttagcacttgaaatgtggctactgtaaccaaggaatggaatttttaattgtttaaaatttcaattaatttaaattttaaaagctacctgtagttggtagctaccatagtggcagcacagctttgcatagtgttaccaagtcctttggactcttcccaactctaactaattccaccttctcagtccaaacagaccgaacggtggaattgtcttcagcccttggccttcagtagtcctcactgctttgttactgctgaagttgtccccagctggtatctctcctttatttcgtttccattggacttttcccatgcagtgctacaaatttagccttcctataggacagccctgagcatctcaaccccttacccaaaagccctgcataactccccattgctatgggataaaatgtaaactccttagcctgatgtttgaagcctttccaggcctatttctatttactcacccataagcattgtcaaactggatgggactctccccttctcctgtgattcttctgtcctcatctttgtgtcttctgtttgttctgcagggagtggttctcccaaatccacactttcttaaggagccatctcagtgtcattaccattgaggtggccctcatttccctcccatttttttcctgttaacttccagcagcattttttcagactcacctgtggcacttaccacttcctgcctcgaaccataaaatccctgaaagtaagctttgtgtctgtttttatttttgtatattcacaaaatgtagcaaggctttttgaatttgttagatgttcagtaacttttattgaattaacagaaataaacatgactcagtattgagtcaggatctactgatttgggcgagcttatttatctcctttcctggagtcagaagtggtctcaaattttggttgttgtttgttttagtagtagttggggtattgtacaaagcctagaagtaggggttaagggtataaagttagagggttgtatgatcaggaaccagggaaattattatgaacatatgctcaaaggtttatttcaaaacttaatttgtgttatccagactggctgatgcttttgctaatgctgctttataactggccttattcgaagaactctggagtaagttgatgatgaaagttggtatgatgaaaagtttattctgtccaattttactttatcttattagaaatcattttttccacattagaaatctattatttagtcctgctgagtataattgaaaagcgtttaatcctacaggctttgcaaggacagatatcaagtcagcaggttgctgtagagaaactgaagaaaacggctgaagtgcttttagatgccaggggatctttacttccagccaagaatgatatccagaaaacacttggtaagatattcatgtccttgcttcctgtctcacaggtaaattctaaagaaaggtgtcctaatagatatggagaaaaatgttcactagttatagattgtgttctatgtgctctttctctgtgaaatggtgttcctgcatctgggaaaaggcatgccttctttggcaggtatattagaatcttagaggcgggggctatgtgtcttgaaaagagtatatttaaatttaaatttgatatttagaaaacataacaggaactcgctatgtaatgtccaccacaggaagtagaacttcacaaaattctcttggttgatgggattgggcagagttaggccttcaacttaaggccaaagtagaatctctgagggtctttatcaatagtgggaacgtgggtttaagaggttgagaaatgtgcttaattgaattgaattgaatttatttttagagacaggggttactttattgcccaggctgagtgcagtggcacaatcatgtctcactgcagccttgacttcctgggctcaagcagtcttcctcatctcagcctcctgagaagtaaggactacaggaatgctctgtcatgtgcagctaattttttaaattttttttgtagagatggggtctcactgtattgtccaggctagtctcaaactcttgggcttaaatgatcctccccaaatgttttgtgcacaaaagtagcactacagctgtaatcaagtttctagtatcactaaagaattggtgtaactgagctctcaatttgagtgaggccactaaaaaacttctagaacacagagaagtgggaagacttctcaaagcacatctctcaggccgggtgcaaaagctgacacctgtaatcccaacatttggggaggatcatttaagcccaagagtttgtgattaatgtgtttcttgagaaaagagctattgtatattatctttctatctaaccacagtatttagtttataccaaatgtgcagtggattatcaatacatattttttactatcttacatatgtattttttgttttcactgccctgcttttcacaatatttaatgttattgtgtatttctgtgtgtgaatatgtgaagtaaaaatattccacaacagatgattagacatatgttttaccctaaatagagcatgaattaaaatctgagtcaaaattttatttgaagagaagaatggaacttagctcttttaagatcactgtgtaaaagggaaatcctgtctttcattcttacatgtatccagatgttttttattatgtacccctgtcaaaaatgatcttcagcctgcatccccatatatgcagatgtatgtataagtcatgtgaacatattactgtattattctatgtgttataattataaaacacaaaaatatagagttttaaagtataaaatgaaaatatgaatggaagttctaacattttgttcctctgtcccaatgcagcatctcatatatccacattagataccattgctgtgaggacttgggtataaggatatgaaggagaaagaaagactatcttatttgtatttatgttactcgaagaggcattttgacatttttttcttattgttaagtgtacatagtttcacttttagttgcttaaaattcatttgttacattattttaaaactaaaacttctggcataattttctaggaaatatgtgaaactatttaaggtatagaggagtttctctaagatctttctgacttctaagaaaaccaatgatttaaaaaaataacattcttacagtagatttttgtacctttttctaaaatattttttagtttactaaaatgaagaatttacttcagtgacaatattttatcactaagaagtgcaaactaaacagtgtcttcgtttagcccactatgacaaaaatagcatcggctgggtagcttaaacaacatacatttatttccaatagttctggaggctggaaatcagagaacaggctgccagtatggtcgggttctggtgagggcccttttcctggcttacagatggccactatcttgctggtagagagtggtggagagacatcatttctctcctgtttcttcttctaagggcgctaatcccattcacacgggctctaccctcatgacctaattacctcctcagagagagaggaaacctgattctttttgctactcactctcatacaccattgaacatgacacagaacacttctgtgaccagatgtgtgtgtatttctccccatacaccaaacaattctccaacagataccagctggatgtcctataattcaattcagttcaattcaattctgacactgtctacctggaattagcttcagaccccacaggttaaggggtcagtctcataatgctgccccccacttcagataccaatcacaagtcccaaattgtgatccgtatttcagactgatcagctataaattaggattcccatgacccttctcacgttcaattaattgctagagtgactcacagaactcagagaaagactttacttacatttacccacttactataaagaatattacaaaggatacagatgaacagccagatggaagagatacacagggtgaggtatgggagaaggggagcagaatttctgtgccctctatgggcatgccatgctcaggactccatgtgttcagctattcagaagctccccagacgaatcctattgggtttttatggcagcttcattacataagcatgattgattacatcattggccattggtagcagctcaatcttcagcccctcttccctcctcagaggttgacagggtgacagttccaactgtctaatcacatggttgattccctggcaacatctgccactgtcccctgctccccctaccctaagactatccaggaggccaccaggcgtcacctcattcaaacaaaagatgcccctcatgaaggaattccaagggacttaggagctctgccatacactcctgtcacttaggaaatcacaaaggtcttaggagctctatgtcaggaactgaggtcaacgaccaaatatcagaacaaaagattctcttagtgtctgtattactgaggaaatcagaagggttttaggaactctatgtcaagagctatggccagagaccaaatatttcttattatatgataatatcacatcttccaaaggccccagcacccaacactatcacattgggactttggccccaatatatgaattttgggggacacatttagtctatagcaaactaacactcaaatctgttaattatatgaaaatagctggctttccttcgaaagtcacttattatggctgaacaggtcactcattttacttaccctgttgatgcagttgcccaattaagaagtcgctaacctgccaacttcaagctgccattcagagcatgtgctcttgtgagtttccaaattagagctcattttttttcttcaacttttattttagaatcagagggtacatatgcaggtttgttagaaaggtatattgtatgatgctgaggtttggcatatgatcgaacccatcacccaagtaatgagcatagtctccaacaggtagtttttcagcccttaccttcccacccctctcccccaactagtagtttccagcatctattgttgagagcttatttttgaacccactgcttgtttcctctgccgatggcattttcgtgcatattaaatgctgtctccctccccactcagtatgctgatgggcttcattgagttttagtaagaggagcatgattttctctttaaatcatccaaacttaacctctcactccagtgaaaattttcaagatgttttctcatgttgtagcattagaacaattatattattttgttgtatagattatgtttcatgggccaaatacaagtcagtaagatgttagagatgtttcaggacacagcttgtccctactgaagcgttctacaatgtataagactaaagcattcagaaataattaaaatatttttcaaattctcggacaataagtgataaataaatttaaaacatcattttccagagagaaagagatgaatacattaaaaaccattgttcaaacttttcattggtctacaatatagaatgtaggatgttaacatgtagggctttagtcaagtgaaaactggacgagaaagggtttttttttttagcatcttgaatctttagaattgaagataaagtttatcctcatatgagataggttagcctgtttatttttctcttttgtctgctgttaaacttttaaataaattcaattagtgtatattttagaagcataatcttaactttaaatggattttcattgttgcctgttttcttaattacttgcatctgccagtttctgtgcatttgagtgatttgcttaagttgtgaagtatgacaaaagcttagcatgcgtgtgtatgaaggagggagatagggtgataatttttatatgtaaaagttaattcttcagaaatctttgtaactgtgtattgtcttgagaatggctgtgtgtgactcacctttttttcctccgaaagtaattttcaataagtatggctaatgtgaaatgtcagattgagaaccagtatttatttcaaagatttgctgttcggactactcttttgtctctctgtgacaattcaaatgtttatgcatccaaaaaaatctcttttcaaatgcagatgggatatatattaacttttaaaaaaagatttcaattttcagtatccattgggctcttttctttctttatattttaacattttaggtggtgttctgattatgcattaggaatttatcattgaactttttattttttaaattttttgtgtggaaattgtatgattcaccttcatgtgtttttgaaaagggatagggcaaagagaactttgtggttaatattcctgatctgtttggagtagatgacattgttgggagatatgaggatctgtccaagtctgttaatgaacgaaatgaaaaactccagataaccttgacccgttcactgagtgtgcaggatggcttggatgaaatgctggactggatgggaaatgtggaaagttctctgaaagaacaaggtcaagtgcctttaaactctactgctcttcaggatattatcagtaaaaacattgtaagtgactttaaaaaaaagtcccattttcagttttttaaaaaaacagttttataagctcaaagtgtagttagatttaagataaacttaaggacacaaaaaagagacatttactgaatatgagtgtggaaagtaatgcttgcacaaaatcaagtgtgtaaaatggtttatctgtgaagaagtgtaggaaggactttgtgtactttttcttgaatattattcattatagagggcttatgcatacattgagtcttatcttgtttatcattgtttcagccagctgcacatgaggttaatcagatcagtcttgtctagtcttttaagaattaggaccatggctaatccccaggctccattagattctaggggttgctgagtagcagcagcctcctgcctctttcgaccaactagccagctgttcttcactctctcagagagatttaagatggcattcctcaagggacagaccaaacttgtcattcagtttcaactgttaaccttcctaggcacaggttgtgcaagcttatgttgttaggaatagtcatttaaaaaaattctgtcacattatttataagcatcataataaaagatatgcaatatttggtttattttagatgttggaacaggatattgcaggtcgtcagagcagtataaatgccatgaatgaaaaagtgaagaaatttatggaaacaacagatccatccactgcatcctcactgcaagccaaaatgaaagacttgtctgctcggttttcagaagcaagtcataaacacaaagaaactcttgccaaaatggaggagctaaaaaccaaagtagaactgtttgagaacctctcagaaaagctccagacatttttagaaacaaaaactcaggctcttactgaagtagatgtgccaggaaaagatgttactgaattgtctcagtatatgcaggtatgcctcccttactactcaggaggctaatcagatagattaatagttagggcaaactcatatacttagtgccagaattataattggcaatcattttaattgcttatagattagtaaagatctatgttttactcctttaagaatttcaaaccttatcttttccttgaagcctttgctgattgattggaaataaatatcatttatcacatgtatcataggtagtataagtatcatcttacgtaccagaagccacaaagagacaaaatatagaatgcattttaaattaaataaggtttactgtgttccctttcaaatagcctatatgcatgtttattatatttagaatactggccataggcagactcattcttatgtgaaattatgaatagagccattctgatcccgcacagacctctggatggaatgccatttgaagatctagcaacatttatattgactgaatatcttaatgctttgtaggaatcaacttctgaatttttagaacacaagaaacatcttgaagttttgcatagtctcttgaaggagatatccagccatggcttaccaagtgataaggctttggtccttgaaaaaacaaataatttgtcaaagaaattcaaggaaatggaggataccatcaaagaaaagtaagtaccactttaaaaattatattttattctatttatattaattagagtgagatacttgtatttacttatatagataactgaaacaattttgaaaacttgagaataagcatagggctactttatagatgtttttatattttgatcattttttgctattaaagttaactgcattatttggtttaacatttagaaggaaaattcaatacttcttacataaaagtggaaaatgttgcataagaaaaacgatggcggtggtatattactgaaaatgatctaaacttgctgtagtctctgaagcctagggcaaatatcacatttttatttgcaaaggcagaaataaccttgaacaacagctcgtggttctttgctttctgagctcaactcagaaacgatgtgcaatttcaatatggcctttttaatataatagtttactttttaaagagcagtagatgagatatgaacctgtgaaaaaacactattagaaacaagtgaatgaacctaagttgagctaaaaagctgtacagggccttgtgattgagcttttgtgtttctgatctcacgttagtttagaatatacatcggattttgctaaagtttatgtagaaaagcctcagaacatagaaaagtcatttctcttccaactactgttctttatttcttcagaattctctacctaaaatgtttgagtgctgcctttacttctcacagagctatatgttccatcctgtcatatggtatttaattcacattgcgtagaagaaatgttcttggttttcttaggtgatctctaggttgtttcttctttcaaatgggtccaactttaaaataatgtagttatcagtattagtccagctgcagtgcattcttatctgccagtattctgcacgcttgcatatatgtacgtgtcatccacatgccagatgtaactgtcctcacagttgttcatgtgctgggcatgtgcactgcctccgtggtgcagagcatacagaacgacccatacagttcaccagggagtttcctgagtctctgtaggggaggcacacatgaaaattctctagtcactaggtttcaactcattttgggagacttgaatctggactacctgcagcagtttatccatccataaacgtgactgtagtatagtgtagaaaccagtaggtggcattatgttttcctcatgtcagtgattgtcaacctttcccttctggttctgtgcctgccggcattcagcatcacataaaggggacagatcaaagctcattgaatgtaaataatgttcaaactgtttgtgtattcttagagtttatgtagcattatagagagtgccattacatatgggctacagatttcttgaatactcctatctttatcaatgaaccttgcctgaaaaatagaccaacagttatttagctcaggggtcccctaacccctgaggtatctactggtctatggcctattatgaactgggctgcacagtaggaggtgagtggtggcagcaaagcttcatctgtatttacagctgctctccatctctcacattgctgcctgagctctgcctcctgtcagatcgtcagaggcattagattctcataggaccaggaaccctattgtgaactgcatgcaagggatctagggtgcatgctccttatgagaatctaatgcctgatgatctgccaccatctcccatcacccccagatgggactgcctagtttcaggaaaacaagctcaggctcccattgattctacattatggcgagttgcataattattttaatatatattacaatgtaaatataatagaaataaagcacacaataaatgtaatgcatttaatcatcccaaaaccatcccccctccctggcctgtggaaaaaattatcttctacgaaactggtccctggtacctgaaaggctggggactactgatttagctgatttcagttgtcacctatgaaacctttcctcctgtatcaaagggttagagtacatggaagatggtttcttaacattgtgtgacatgagaataataatttatttattcttctttctgtgacttaaattcttgtatgatttttgttatgtagaaaagaagctgtaacttcttgtcaagaacagttggatgctttccaagttcttgttaaatcattgaagtcatggataaaagaaacaacaaaaaaagttcccattgtacagccttcttttggtgcagaggatttaggaaaatctttggaagacactaaggtgaatcattgttatctaatactaaatttccatttgtgtcaataatgaaagattaaaagactaatggtagttttctttgatctaatatcatctaagttttatcctcatatatgtactgtatattttgttgacctttggaaatcatggcatggggcttaactaattcttttggaaaaggacataaattttcagtggatttgcttttttaaaaaaaggtgaattaatgagttgctgactattctagtaatcaagtttcctttcctaccaaatctctacttagtttcagtaattttttataccacttctcataatattaagcaaaacatcctcttcactcagcattttactctagcttgtatatattactataaagagtatttggaaagagaagttatttgaatctcctgcataaatagtgcacaagtcttttgtcttctgactcaaggcttatgccttgaccaatatggcattttttttcccccattccaaatttgtggatgtgtgtgtgtgtttttgttttttttttttttcgagacagagtcttgctcttttgcccaggctggagtgcagtggtgtgatcttggctcactgcaagctctgcctcctgggttcacgccattctcctgcctcagcctccctagtagctgggactacaggtggctgccaccacgcccagctaattttttgtattttttttagtagagacagggtttcatcatgttagccaggatggtctcgatctcctgacctcatgatccacctgccttggccttccaaagtgctaggattacaggtgtgagccacctcgcccgaccgtgtgtgtgtttttaaaagtaattgaaatttttaggattaaaatatgctgtaaaatgaagttctgaattcctatttatttttattgttcctagtaccttttatttgtgactggtctcttacctagtacagttttacagacttacagttgacagttattttggaacccatagcagccaggaatagcctgactcccactttggctaggattttacttgccacttctgaaacctttgaaggcagaatgggccatacatacccaaccgttaactgagataacagtcacctgggctgtgggaacaaataggtgcctttttctttcatcgactccctcacaaatcagggtctacaattattactactttaagatatgtttaagaaactgaattataatgtgcaactctgaaaatattaagatggaaaaataatgtgtttttatatctcaagaaattacaagaaaagtggagtttaaaaacaccagagattcagaaagtaaacaacagtgggatctcactatgtaacttaataagtgctgtgaccacccctgcaaaggcaatagcagcagttaaatcaggtatgagctttatttacatttatggcaaaaactaagaatcaggtttactcatgtcaattttgtgtatgttattttttaaattaatgcataaaataacctcagaaatacaaagtgaaagtgacaagaaacatggcatctgtaagcacactgtgctgggaatgtatctgtactaatcaaatttcaaatccttcttatgttttattttattagactgtatttaaaatgtagctaaattaatatgtaagaataaggaatgttatattggggaagggaacagatcatattcaaatttgtttgctttttaccttaattaaatggagatattgaaattctatttaaaatatttaattataatatttgataaagaaatgagtctgggcagctgggaaagaagtgagggaaggaaataggcccttttctatagcgtgggcactctgttattttattcctgcgtattttattctgtacatcattcccaaagaaaacaattatgcagtatgtgagccggcatatctgtatcgcaatctaagtcatggttgagccacctttctcaataaaatgggagattcatgtgtaaatattgattctaaaattaatttaagcaagttatgggtatagtttttagtttgaaacatacagtaacaagtttttttaaaaaaataatgggcagaaggcagctctgatatcttttttctgagagttctgagtatcctctgtggggtatctagtctgaccagcccccagctgtccctattgtgatactgatgttccagctgggcccttctcagccaaccatttattccactctattaatcctatttcagggactacccatattataatggtgtgatgatttctcctttttcttctaatcagatttcctgaagtgtgaagttttgttgttttttttttaagaagaggaattctactgtgctttatttattttagctcttcatgtcccctttatatttgccataaatatcaagtgttttttttgttgttgttgctgttgctttgggatttttttttttttttttttactcttggtaactaccaagcatggtaggaattagtagtgagcatctacaggatattttcacttccatctgaaatcccatcatgtttaattttttttaaagggacaaagttaagattcagatattttaatgtttctgtttagacttgttattatgtttttgatctgagaaatgtctttgtgttttggatacatagccgatagatactagtatgagaaagtctaactgatattttaatattctgattatgaaaaagtaccaatgctagattgttatgtaataaaagtgaactgttagtttactgcttactgactagtttctacttgctaagcaatggacctttggttcccacagtggtgtttggttcccacagttaggtattattattcccatcagtttggctgattgatttgtccagtcacctggctagtaattagtgaggctggggcttaaatttaggtaagttatacagcaagacctaggtactcctaaccaccatgctctctcttagtgttgacgtaatatgagtttaataatcgatttattttctttttcactttcaacttcttttttatgtatttaaaaaaattattctgcctccattaagcccatgataacaccatgtaactgcaccagacaattttcaatctttaagtaaggcagatgctcttttgtcagtcatgtatgcattgttcaacacacttatatactgagcaccttctgagcttcaggacctttatcattaagataattttaacagtaaagtgagaggtggctggcaagatggctgaataggaacagctccagtctgcagctcccagtgaaatcaatgcagaaggcgggtgatttctgcatttccaactgaggtacccagctcatctcattgggactggttagacagtgggtgcagcccacggagggcgagcagaagcagggtggggtgttgcctcacctcggaagcacaaggggtcggaaaacttccctgcctagccaagggaagctgtgagggactgtgccatgaggaatggtgcattctggcccagatactacacttttcctatggtcttcgcaactcacagaccaggagattccctcgggtgcctgcaccaccagggctctgggtttcaagcacaaaactgggtggccatttgggcggacaccaagctagctgcaggagtttttttttctatactgcagtggcacctggaacaccagtgagacagaaccattcactcccctggaaagggggctgaagccatggagctaagtggtctagctcagcagatccaacccctacggagcccagcaagctaggatccactggcttgaaattctcactgccagcacagcagtctgcagtcgacctgggatgcttgagcttggtgaggggaggggtgtccaccattactgaggcttgagtaggtggttttcccctcacagtgtaaacaaactgccagggaagttcgaactgggcagagcccaccgcagctcagtaaagctgctgtagccagactgcctctctagattcctcctctttgggcaggacatctctgaaaaggcagcagcaccagtcagggtcttatagataaaacccccatctccctgggacagagcacctgggggaaggggtggctgtgggagcagcttcagcagacttaaacatccctgcctgctggctctgaagagagcagcggatctcccagcacagtgctcaagctctgctaaggaacagactgccatctcaagtgggttcctgacgcctgtgcctcctgactggaagacacctcccagcaggggtcgacagacatctcatacaggagagctccagctggcatctagcagatgcctgagtaaaccaataagttctgaaattgaggtagtaattaatagcctatcaaccaaaaaaagcccaggaccagacagattcacagctgaattctagcagaggtacaaagaggagctggtatcattccttccgaaactattccaaacaatagaaaaagagggactcttagccgggcgtggtggctgatgcctgtaatcccagcacttttggaggccaaggcgagcggatcacaagatcaggagattgagaccatcgtggttaacacggtgaaaccccatctctactaaaaatacaaaaattaactgggcttggtggtgggtgcctgtagtcccagctactcaggaggttgatgtgggagaatggcgtgaacccaggagatggagcttgcggtgagccgagattgtgccactgcactccagcctgggtgacagagcaatactccgtcacaaaaaaaaaaaaagaaaaaaaaaaaagaaaagagaaagagggactcctccctaactcattttatgaggccagcatcattctgataccaaaacctggcagagacacaaaaacagaaaatttcaggccaagatccctgatgaacatcgatgcaaaaatcctcagtaaaatactggcaaactgaatccagcagcacatcaaaaagcttatccaccacgataaaatcggctttatccctgggaagcaaggctggttcatacccaatcaataaacgtaatccatcacataaacagaaccaacaacaaaacccacattattatctcaatagatgcagaaaaggccttcgataacattcaaccctccatgctaaaaactcttaataaactaggtatcgatggaatgtatctcaaaacaataagagttatttgtgacaaacccacagccaatatcatagtgaatgggcaaaagctggaagcgttccctttgaaaactggcacaagacaaggatgccctctctcaccagtcctattcagcatagtattggaagttctgaccaggcaatcaggtaagagaaagtaataaaggatattcagacaggaagagaggaagtcaaattgtctctatttgaggatgacataattatatatttagaaaaccccatcatctcagcccaaaatctccttaagctgttaagcaacttcagcaaagtctcaggatacaaaaccaatgtgcaaaaatcacaagcattcctgtacacaaataatagacaaacagccaaaccatgagtgaactcccattcacaatcgctacaaagagaataaaatacctaggaatagaacttacaagggatgcgaaggacctcttcaaggagaactacaaaccactgctcaaggaaataagagaggatacaaacaaatagaaaaacattccatgctcatgggtaggaagaatcaatatcgtgaaaatggtcacactacccaaagtaatttgtagattcagtgctatcgccatcaagctaccattgactttcttcacagaattagaaaaaactactttaaatttcatatggaaccaaaaaagagcccgtatagccgagacaatcctaagcaaaaagaacaaagctggaggcatcatgctacctgacttcaaactatactacaaggctacagtaaccaaaacagcatggtactggtaccaaaacagacatatagaccaacagaacagaacagaggcctcagaaataacaccacacatccgcaactatctgatctttgacaaatctgacaaaagcaatgggggaaggattccctatttaataaatgatgttgggaaaactagctagccatatgcagaaaactgaaactggaccccttccttacaccttatacaaaaactaactgaaaatggattaaagacgtaaacgtaaggcctaaaaccataaaaatcctagaagaaaacctaggcaaataccattcaggacataggcatgggcaaagacttcatgactaaaacaccaaaagcaatggcaacaaaagccaaaattgacaaatgggatctaattaaagagcttctgcacagcataagaaactatcatcagagtgaacaggcaacctacagaatgggagacaaattttgcaacctatccacctgacaaatggctgataccagaatctacaaggaacttatacaaatttacaagaaaaaaaacaaccccatcaaaaagtgggcgaaggatatgaacagacacttctcaaaagaagacatttatgcagccaacagacacatgaaaaaatgctcatcatcactggtcattagagaaacgcagatcaaaaccacaatgaggtaccatctcacactagttagaatggcaatcattaaaaagtcaggaaacaacagatgccggagaggatgtggagaaataggaacacttttacactgttgatgggagtgtaaattagttcaaccattgtggaagacagtgtggcaattcctcaaggatctagaaccagaaataccatttgacccagcaatcctattactgggtatatatccaaaggactataaatcattctaataaagacacacacacacctatgtttatcgcagcactattcacaatagcaaagacttggaacccacccaaatgcccatcaatgatagactggataaagaaaatgtggtacatatataccatggaatactatgcagccataaaaaaggatatgttcatgtcctttcctgggatatggatgaagctggaaactatcattctcagcaaactaacacaggaacagaaaaccaaacaccgcatgttctcactcataagtgggagttaaacaatgagaacacatggatacggggatgggaacattacacaccggggcctgtcagggggtggggggcctggggggtggatagcattaggagaaataatgtagataatgggttgacgggtgcagcaaacctccatggcatgtgtatacctatgtaacaaacctgtacattctgcacatgtatcccagaacttaaaatataataaaataaataaataaaaataaatacaaattaaaaaaaaactaaagctccacttactgctctaaaatacaatttaataaatatgattcttcctagaataaaggaatttattggataaaacacaaagcaacttcacaaaaatttttatgaattaatatttaatgattaatttatataatataaacatactgaaatggtagtgtttaagacaatactttaagaataaattttacatagaagagaggatattgtttgatatttacattttggaccttcatttgattttgaagttgagtcagtgttttatgtgtgattactgttgatggggtttgatttaatgccatctactgttaatgtatagaaatactatgaaactgtgattattttagtgttactatttttgcaggtggagcagtattaaatggtgaaggaacagccacaaatactgaggaattttgggcaaataaaggtgagtattaattttaatttgttactgattaatgtaatttgatgtttttttaataagagaaaatcttagaggcaaacagtagttatattgaaatttcaagcctgaattacaatggtatttaatctaatagtcacaatctccataaaaattatatttatataacattttttgcagttttgtgtatctgaaataagtaaaatcaagttgttcagtttgacacttggttttgttgctttctttttggttaatttgagatattttgtcacttgggataacgttatttgacctaatttattgagtttggtgcttgagatattgctaagtaacattttgtggtttgttttttgttacatttaaaatgtcttttttatttcacttgttatgcaattttcttgaattatttgtgactaaatagcattataagatgatccaaacttttatttctgaaaagcttatgactttatctactaggcttaataatgacaagctagaagtgacaaaataccatgtaaaacaaacttttatttctagacctctgctccaaatgtcctgaaaatgtgtcagtatagttgtttttcttactcctaggtttaacatccattaaaaaggacatgactgacataagtcatggttatgaagatcttggcctcttactcaaggacaaaatagcggaactgaacactaaactctccaaattgcaaaaggctcaggaagaatcaagtgcaatgatgcagtggttacagaaaatgaacaaaactgcaacaaaatggcagcagacacctgcacctacagatactgaagctgtgaagactcaagttgagcagaataaggtatattctgtgggtgcacctatggaagacatgaaagagaatggattagcagttggaacggagctctggtagtcagaagctctgctctgttttcttttctagctctgtaacctttagcacataattgacagttttgtttaatgtgcctttctataaagattgataataatagttacttttttttaaatttttggcacagccatgtcataggttagcaaactgttgggtgtaagccactttgccacctttaaatcagtttaagtctaggatgttaaccagtcaactactggaaaagatttatttaagggctaaatgtatgaaggatctgttctctgtagtataaaaatagggtagctaataccttccttttctttaatagagggtatttctttctacagctgccaaggttgggaaaatggctttatatggtagcagtgatggcaagatttctacaaattaccaacctacatttgaattctataatgtgttgcccaaaaaaagtgtttattcacatgtagattctccacttctggcagcctttattaagactgattttcttatttattataattttactgatatcatcttgctttattccagagtggcttgtttgaatatatgaaattctttctcactaatggggacaagagtcattatcttcatagtcatagtgttcctctgtggggattcctgtatcacacaattgaacactagctaagaagaggaaaggaaaataattgcaaaatccaggccctcacccaccacaacatttaacagtagattttttcctcttttcattattctagagaaaaataatgctctatcattattgtatttttgtcttttgctgtacacatgatttattattatttttcccttgttagtcgtttgaggcagaactgaagcagaatgtaaacaaagtacaggagttgaaagacaaattgacagagctgttggaggagaacccagatactcctgaggcccccagatggaaacagatgttgacagaaataggtatgttgcgttacttagatgaatgcctatgaagaaaagtgcaatcatttttcatgtttatcatgatctttatcagaaaacattcaacagtcacttatttttggatttgctttaatgtttcagaatctattttttgcataaagtgtcatttcaaattatattgtgcagaaaattggcatatcttatgttttttatggtaaacacagtaattaaatctatttttatgaagaaggtagatactagttaatgaagtgctgtgcatggagtacctgttttcattaatgtttctttttcctagcttttggtgctttattatgctttatatatttttaagctgtattatattgtaaatatttctttcattcatctggaaaagctgtgctcccttctccttcatggagttacttctgggacccctcctgctccatactttatgctcttatgctcttccccaatcaattttttcatccaaagttatcctcctacccacatcctgtccctgtgtaaacagaggagtatacactgctcctcggaggtacagaattttctttacaagccctattgtcttaccaatttttattactataatgatgtagaaaatgagtgtaaagggggtagaaaaaaagaaaatgagtgtaagagaacggtaataattttccccacttcatagtttcatttggagaacccaataagttaatgtgtatatggctcaaacaaatagtacctggcacatatcaagtgctatataagtatatactatgattataataattattttactttcaatggttccattactaaatattgtccttcctttagagtcaggtatgctatgataaatgtagaaatctctaagtatattttagtttgaaaaaggttaccctaagggatcttcatgttcaaagatatatttaatccaactatagagattcctgtcaagttgtaattaatttgacactcattcagtgactctcttctaggatctcagaattacttggggagagtattagcaagacattttagaataggagtgggaatgaggaatatgtagttcaaaaaaccttctggatgagtttttctatttttccttcctgatttattgctttaatggcattattttgttgccagattgtgtttgactggaaaatgtcatgtagaatgatgttattaggtaaggtttcagtgattgtgttctattaaagtcatccctttagtgtgttatgctaaatgaaaactctctcaagtcaagtgatcacaccatcaatgaatatttatcgagtgactgtgttgaagtgctgaaagaagtgctctgatcagtaacccttgactgcagggagcatactgtcttgaggatggagaaaacagaaaaggcttcctagcagagggtaaatccaatggaatgtaaaggaaggatagggttgggatatatagagaggaggtatagcatctcaggcacaggacctgtgtgagcaaaagcctgtttggattataaggatgaaatcagcagggatagattagaggatcgtctcagagtacaaaccttcaaagattgtgggaggccttgaatgtcaggcaatggtcttcagattttatcgtctaggtaacgaggagttagttattgaaggatttgagcagtgaagtgacagttttaaaagtgacattttttttagggaaattgtattagaaacaagtggcttgcagctgagaaacattaatagcagggatactagttagaagactgctagactaggtcattagttctccaagtgtgctcctgggatcagcagcaacagcatcatctgggaattatttagaaatgcagaatttcagatactactccagacctactgaatcaaaaactcagggtagagcccagaaatctctgttaaagatgcctccaggtgattcttaatgcagctgaagtgtgagaactactggtcaaggtaaaacatgatgatgttagctcatcacctggatggattgtgttaaattatcacatgcactctaaaaatacatatctactatatatcaatgtaaaaaatacaaataattttaaaaaacacatgatgaaggccaaaatggagttatggcattgagaatgtaaaggagggctttaaggttttatgatcgagggtataatagagttaggaagctcataaaagaattttctgaattattgcatctttatgacatgggagaaaagataacctttgaaagaaatctaaaagtcttaaaagtccaccagttttgagaggaatataatgagttttattttttaatgttgagtttaattggtgagacttcctacgggaactttccagcagctggttgttaatgtgtaatttgaatgggaaagaataattggggatagatatacaaatttgggagcaatttgcctagaacggataagtgaagatttgatattaaaaggattattgttcattgttctagtaagtcatagtttaataacacactctataggacttatagaaggaatgagagatcccagaatgctgtctgctttaatgaatattcgatattctacgatatcttctaaagtcagattcaaaattttttccctatactttagttgacatacaaccatcagacctataaaatcgtaggttagtcctttaagtaactatgtaacaagagtcataaaaatgggattatagccattatatatcattttaaatcataccatacagtcctcatagacatagtcatgttaaatgcaaaaaatgtcaaacaccagtttcattttttttcttttagattctaagtggcaagaactcaatcaattaacaattgatagacaacaaaaactggaagaatcctccaataatctaacccagttccagactgtagaggcccaattgaaacagtggcttgtggaaaaagaacttatggtcagtgttcttgggcccttgtcaattgacccaaatatgctaaacacacaaaggcagcaggtgcaggtgagtattacctaataacctgtctctcgtgcatagcaatttgacttactgagaccaatgttttcattataaatatattaactttggtcagtaggtgttttatttaactgctttgaagtatatatgtaatgtttcagatgcccataagatactgtcctgatattagtgggaatccccaaagaactaaagctataaggcatcttagaggcctcctttgaatcccatgaatgggccaagtctcctgattatttcagtcatattgtgggtggtacagatctggttaaaagggccttctttgaagtattaatgcaattaagtaatatctttatgagaggctagtctatactttttactgtttagaaattactcctttgaggttttatttattttgattgtggtagtagataatgaaacttgtaaaactcatgcatttgagtcctgatggaggagagagagaatgagaagaggacaaagaataagggaagcagagagggaaccctgaaacccagggtgttagttagactagtctagttacaaagcagataaatccacaagggaaaaaaatccaaaaaaatgagttttatttttaatgtttaatgttttacagtcaggcataatagcagaagctctgtggtgatttcagttagttttttaatgtctgagtactggctttagagcagggaggctgttttataagctgaaaattcaaataagtttttgtaaaagtcagatgtttgaattcatatctgttcataatccaaagacaatgaaaacaaaagataaaagtaaatatctggggagaaataattgcctctagtcttggtagtctcccagagatagatagataaataaaatatagataaaagtataaaagatagataaaatatgatactaaaagaatgagatttttggatcattaattttatgagtcaagttgagcctatacattctgagcagcatgatttgttgactaaaacctttataataaagactgtaaacatcaataaattttatgttacaaaaacctttgcaactcaatgcatcatgagttaatatattctaacacctttatcactgtgcattttctttaatataaaattctatagggtattccaaaaatcctacgaagacaaaaacatgagtgggtaaaaacaaatttggtgtaagtgcagtgtgaacttgtttaacagcagtgtttctctttttatatgaaaatttacacatgaatttttgttcattttgtccatatttttcctttagggggatgggattagtttagacaggatatctctgtgaagcactgtggctcttcggatttaagagaattgtactgccctttaagtaaaaagtaggaaagtgataactaaaaaacaaaaactggagaaataattaccatttctgtctgtttggacaccaaatctgtgttttctacaatcaattatataataatttgcgtttgtttacccttgttaccttagattttgctgcaagaattcgccactcggaaacctcaatatgaacagctgacagcagctggtcagggcattctgagcaggcctggagaagacccttctttacgtgggattgtgaaagagcaactggcagctgtgacccaaaaatgggatagcctaacagggcaattgagtgacagatgtgactggattgaccaagccattgttaaaagcacacagtatcaaagcctgctgagaagcctttctgataaactgagtgacttggataataaactcagcagcagtctggctgtgagcacgcaccctgatgctatgaaccaacagttggaaacagcccaaaaaatgaagcaggagatacagcaggaaaagaagcagataaaagtggcccaggcactctgtgaggatttgtcagcactggttaaagaagagtacttgaaagcagaacttagtaggcaactagaaggcatcttaaaatcatttaaggatgttgaacagaaagcaggtttgtctacttttaatacatatatttcctggtcagaaataaatgtcatatattgcctatttccaagatgttgccaataatccaggaccccaaagagactctgccccactgttaacatcagtgaagaggaggatgaatacaggagctcagagagcagttttgtgttcataggcacatggaatgttagggtcattctacacacataatctgttggcaaaattggcttcctgaaggcctattaaaatctcaggtaccccaaactggtttttaaaaaatgtaaatgttttttgctgtatgaaagtcttatttagccagaaaaaaacatgaatagttagtaaaaggctttgcatcatcttctcatctgctgttactttatctattctgtcatagaaaacttttctagagaaatgtgcgaaagagaggcatttgtcactattttcctctctcactgtggctataattctgtggcatatgtgatgatatttgtcagaggtagcagtgaattattagaattcacttcatcagaaagccctgatgaagaaagacacattttgttgttaagtttgttctgtttgaaaagtttctagtttcttgcacctagtagatactcaagttatgctttttaattgattggatttactgatcacagcaactgtttcagacttattcctttatttgacatgacattaacaatagtaaatatcagctattatcattattattcttaatggtatgaacagttatgtgataggtattaaactaaaagctttacatgtactgtaatttaatctgtatacctactattaatattgtcaatttacagtgggagaaattaggcttaaaggtttaatcatttgcctggggtcttccaactctgaagaggttaaaccaagatacaaactcatgtagtttttatgtgctacattatgttgcctccataatatgtaaaagtcatagacgtggccaggagcggtggctcacacctgtaatcccagcactttgggaggccgaggccggcggatcacgaggtcaggagatcgagaccatcctggctaacacggtgaaaccctgtctctactaaaaatacaaaaaattagccgggcgtggtggcgggtgcctgtagtcccagctactcaggaggctgaggcaggagaatggtgtgaacccaggaggaggagcttgcagtgagctgagatagcgcctcaacactccagtctgggtgacagagcgagactctgcctcaaaaaaaaaaaaaaaaaaaaaaaaaaaaagtcatagacgcgaaaaagtcatatttaataagagatggattatttatcaacataattaagaactttgccatcatcacttctccatactggaatagagaagacaccagcacagcaggcgatgtgtggcatggccactccctgcaccttgatgcatttttacttatttccttattctttgttttcccctctcatctgtatcctgcatcttttcttgattgtgtattttcttctgcctacttcttgcttcttttcccctttgtcaataacttaagttcacttgtagttcttatagtcaatgctaaaagcccttgcttttcaacaattctatatattcattcagagatttttattttggcttttcatagattaaattaacattttgatgtaaaataaacatatcttgtaattttatttctagagaatcatgtccagcaccttcagtcggcctgtgcaagctctcatcaatttcagcaaatgtctagagattttcaggcttggctggatacaaagaaagaagagcaaaacaaatctcatccaatatctgccaaactcgatgtcttggagtcattaattaaagatcataaagactttagtaaaactttgaccgctcagtctcatatgtatgaaaaaaccattgcagaaggtgaaaatctgttattaaaaacacaagggtctgagaaggcagccttacagttacagcttaatacaattaaaaccaattgggatacatttaataagcaggtgaaagaaagagaaaacaagttaaaagagtcattggaaaaagcccttaagtataaagagcaagtagagactctctggccatggatagacaaatgccaaaacaacctggaggaaataaaattttgcttggatcctgctgaaggagagaattctattgccaagttaaagtctctgcagaaggaaatggaccaacactttggtatggtagaattactgaacaacacagccaatagcttgctcagtgtctgtgagatagataaagaagttgttacagatgagaataagtcactgatccagaaggtggacatggtcactgaacaacttcacagtaagaaattctgtctggagaacatgactcagaagtttaaagaatttcaagaagtttccaaagaatctaaaaggcagcttcagtgtgcaaaggagcagctagatatccatgattcgctgggatcccaggcttacagtaacaaatacctgaccatgttgcaaactcagcagaaatcacttcaggccttgaagcatcaggtagatttggctaaaagacttgcacaggaccttgtggtagaggcctcagactcaaagggaacctctgatgttttattacaagtggaaaccatagctcaagagcatagtacactaagtcagcaggttgatgaaaagtgttctttcttagaaaccaagcttcagggcattgggcatttccagaataccattcgagaaatgttttctcagttcgcagagtttgatgatgaactggatagcatggctccagtggggagagatgcagaaacattgcaaaagcaaaaggaaactataaaagcctttctaaagaaactagaagccctcatggcaagcaatgacaatgccaataaaacctgcaagatgatgttagccacagaagaaacctctcctgaccttgttggaatcaaaagggacttggaggccttaagcaaacaatgcaacaagttactggaccgagcccaagccagagaagagcaggttgaagggacaattaagcgccttgaagaattttacagcaaattgaaagaattttctattctgctccagaaagccgaagaacatgaagagtcacaaggtcctgttggtatggaaacggagacaattaatcagcagcttaacatgttcaaggtagggaactcttcatttttacccagtgtttttattgtcaatgaagtttctaatttgcttagaaaggagattgcctattttgtagaactttttaataatgattgtcatacaatatttgagccagaatgagcatatatgggggtaacacccaggcaggtggggcagttacaaggccactggggatttgggcctttgtgggataaggtctgagataaaatcagaccaaagggtgcttggcaaagttccaggcaagccagaaactgacatcatagggtccatttctggaattattcacaattgccatctgtggtgaccgtggctgtgttttgaactctattgcagatgtttatcttccagcaatttcttcaatggtgaattaccgtcttttctgccctttctttttataattatcttctcatccttcttaatttcttccacagacatttttcttctaaaagctcatatttttaaaggcaatatggagttccatgttgtaatctgtttcattaaacaaaggtcttaggctcatgccccagaggattagaggtgaattttttttttattgcatgacataagctcctcagtgccaagaaatgactgccactcaacagtgatcaatgacacttaatgaatgaaacatttgataaaaatggtgggccagtttccgtgtcattggatttggccttatttatgatagtgagaacagaagtcacatctgtataggggacaaagataggtttatccctggaaacaaagggtcctaaatagcaagcaattttctatatggggctgatataaacctttagggtttcacagctcctgttatatttatgaggtgtgttttactggcaaagatatattgcaccattagtgcataaagaataaactaagaccaaataaaaacagtttataaaaccacaaattattttctttgagagatgaatatgaatcaaatggacttccaaattctgtgcagttatagttgataaactctttcatttgcttgtctttaataacattatttaggtgactgaatcttgaaaaataccttctttttctttgtattgttattagttatgattatttgcagtttattaaacgcctttgaagcccagttccttcaaggctcacaaagctgtgattctgtatttagttcttgattcttgaaggtgaaggaaacgtccttattgttgacttgacctccttcattgctctgtcaaatttttgtatttctgatttgcaaaataaagatttcacgtgagagaatcctctattagaaaaacatagttctgtggcaattgctgcatcaaagactgggagagatcttgggagcaactcttccttcgtcagtaaagtttggaattctctctagaaccctgtcagcaccttaaagattaaatgacagtaaccaagcactgtttatactaatgaaatttaaccacattaaatggttaaattgtgaaacattatgatttctttcggtttcctgtgcatttgtttagaaaaaagaccttcatttctctttgctgtttctaactacttgtaagacaatggacaaagtaataatactggtgctgctatttgcgggtgtctcccctttggtgttcccaagtacagtgaaaaatgtggctgttcatgtggagaactgaaagtaagaaaaagcaagagataggaggagctttctcaccattgcactgaaagtgttttgcaaactgcaaagtcccaaataagtaacattaccattaatagctacagagattgttttatttgattgtgaagaaatatagagtgataatttctcctaaaataaaccatttagcatgctgtgtttgtttgctttcagattatttggaaagagttgattgattttattgaaattcagcaataaagaacatcatggcatactttcagtatcttgaaacccagtgacttgaaaaaaaagttttcaagtagacaaatactctgcatttagtatattccagtgccataggtaaaaaaaggacaagaatatgattatggtagctcacacaaccactaattccatttatctgtgtatgtgtgtgtgtgtattccttaaaaatagtaattacaataatcaacaaatcaatttattatgggcttactatgtgtcaagcactattttaatttatctttaatcctgttaacagtcatgagaggtagatgctattactattctgcatcttattataaagaagcctaggctcaaggaggttaagtgacttgtccaaggtcacacggatagtgtcagaacctgattcttttgatgaaaatgatgcactgcttcgtgtaaactttatttgtcatccatgtttcacatctggtattttctctgggggattttctaatcatctttgctgtagcctaatttagacagcccgaatacccagccattgttcattttaatccaaaataccaagaacacccacttaaggaacatgttctataaaactagcagctatgagaaatatgagatgaacatgtaaaacagtcttagaaactgatgttatgtaggtgccgtgatatgataagggtgatgatgataatgatgatgttgatggtggagattccagtgatcaccactactgctgctactgagatggagccaaacatttcattgttttagtgattatatctttcttggttaaagtagtaaattgacttgtttacagttcagtatttaatttagtttctgttgggccttagacttttgttaaacattagttttaacataatttttggaaagttttttaaattttttaaatggaatgatttgtattgagtgaaaagctagttataattcctaaaagtgaaacagaaaagtagtgaaggactgagtctgtcttccttattgactttgaaatataatctagtttgacattaatctatctggtagctttagtttaacctaatgtcacagataaaatcctataatagtttttcttaatacaaaataaactgccttctgagcagaactgagaataatagctattacccagttactcagcagggggtgccttctattcactggacccgtaatagaggatttaaagcaggtttgatagacttccccgattctgtttttctttctatagttcaagaaatagctgttaatagttacttgaggttttcttgtaaagacaaggacaaaattcattcgttcatgtttaagataccaattcaaacataatacttaaagcaaatgctattctaaaccaaatgtcctaactcactcagtgaaaactatcctgagattttgaaagtagattggtgttatcttttgtgttagttagcttgacgttttaaaactattttgattatatataagttctgttgtacataagtttttctacttctgaatactagtcattggactaacatgtctgaagggtgaagtgttttctatactgttggtaagttagagtaccattttccacttacacttatttatgattacggttaaattctatgcacactgttataaattggtggaatgaatagcagggcgattctgtttgtctctaggcaggaagaaagaaactcctttggtgttccctctatccctactcctatctgaagactcctagctcaagattatcttcaaatctaaaccacattattaagtaacattaatattaacacattattatttatcaaagacatatgtaactgactgtatacaaggaatgcctcccagtaattcctattatgtgattaacagccaatcaggtcttctgatcattatgaagtaaccattatcaccatattgcatgatttaatttcaatgaaaatcaaagagacttgatgctttaatgagtcctagctaaatctgtaccttccccacctctatctaggccaagcttgtcccacccatggcccacggcccacctgtggcccaggatggctttgaatgtggcccaacacaaattcataaactttcttaaataacatgacaagattttttttgccatttttttaagctcatcagctgtcattgctgttagtgtattttatgggtggcctaagacaactcttcttcttccagtgtggcccagggaagccaaaagattggacacccctgatctagaccattgtgaaaaaatgccttacctcagaacctgcttacagtttatttctggccactctgttgctgccccaattgtaattcattttgtccccacaaatgagtacatctccagtacattctctctgaggatttctttttattttcaaatggacatagaattacattgagcagaggatttttaagccaagttgaaaccagagacaaagagcagaacatatgcctaattatactgtaataaattttctctggtccaggtgaaggcattgtttaacccaggcatcattattttaatattcggtaaaccaaaatgccaagtagcatgaggctaaggaagacaggcagtttgagcacaaattcttattatggtgtttatcaaatgatccagaaacaacctctgatgtcaccatattgaaaatcaaactgtccaaaaactgctttaatagtacttttaaagtgttcatattgttatatagaggtcaatgacaaattattttccattttattaagaatggggaaattagataaaactgttgcagaagaggtttttgttagggaaaattccttaatagattggatttttgttaatgaagctaccttagcaaaggggttgcatgttcccttcctctggtatttttaatggtgaaaatatttccactatagacactgtaactagatgcatggcttttataggaagatcacattatttaataaacccagagcaaagtggcatttaacaactttaggaagaaagaatactccatatgctggtcaagagagaagccctactgaagcagagaccacacctagctatgaagaggtggagctgatctgctgtgtggtattattaacacctcatattcttatccacacaaactaggcataacaggtggataccctctttttcacatgatacaaggaatataccatacttctcggaaagggctgtcaaaagggaactttgcaacatgttctcttttcagttttgctgctaactaatgctacggccctttatgtcacagagctcctcttaacttttattccttcatttgagattgaggaattaaagttggttgttctgaaggcagttccagccagagattttataatgtaggattttttggtagttgttattttgttttgcttttaccttgataaacctatatcaccattttagagtgatccaataaaacagccaaactgcggtatctactgtcattattataggcccacctttgatcaaaggaaaccttcataatgtattttattaatatggaaagttgcttaaagttgtgtgtgagagagagacagagaagaatttgccttgttatgaaattagacattggtttcttgaaaagaacatttgagtggtaaatgtttatctaggtctctaatcattcattaataacaatgtaggataaggaaatgctacgattttaagtgaaaagtgtctggagctgctcaagaactggatacaacaagaaaatgtctgtgctcacagatcctattctcacatatctccagttgtcttcatttcaagctttatttcttttgtcagtattttaatatgaaaagtatttccagattttgtttgtttttttttttctctgaagaaaattgaatagggccattaacatgtgagttgcttctgcttgctggatagcttttctttaaatgaactttttgacatttatatatatatatatatatatatatatatatatatatatatatgaaatatgtatatatttcaattaataagatttatatatagaatcatcttctgttacatagaattttttttcactgtcaccagaaaacctcattgaagatgtgggaaaggcatagtcttagtattgtagtaacttacaggaagaagagcaagtgctcattaaagatattaactaaggttcacatcaagataaactcctgtcaagatcagttggtgaatctcttgtttctaaatcggtttagggctttaggatgagaatattctactttcttctaaatataaactgtattcccatgaaataaatagttattgcatattcatatgatgcatattcatatctttggaaacgtttagccatttatgtgaataaatttaatagtttgaaaactaaaaatatagcatgccttcagttttcattagctaatggcttatttgttttagaaagaacaatttttgctcttaatgcctgtttatgtacttgcagcacaaaacgcatatcccttgtttgacttctcatcctgatttcaagagctatcaggccaagagttattcattgataatagtgcgtttacttacatagacatttttcacttactgcacattgaacttaatacctccaatccttcaaccctaaaacctccatgtttcagctgataaaattgctcttttctatgagtaaataatgtgtaaataataatcataaatgtgaatgataaaacttttctatgatgtacattgttgcacttagtgggaagacttttcagggactttccttttaaaagatttaattaaactttaggaatataaaatgagaaaatattactgttttgcttataattcaattagtagttgtgtacttttctgaaatcatctgctttagtagatagtttagctggattatatctagtaggctacaaaaagtaagtaaagctacattttgaaaacagcattatgatttctgtattatgaaataatagtgttggctatttttcaggaaaactttacgtaccttattatgtatttctctcattgtgaaaatgtgagggggctgggcacagtgggtcatgcctgtaatcccagcactttgggagactgaggcaggaggactgcttgagcccaggtgttcaaaaccatcctgggcaacagagtgagaccccatctccacaaaaaatttttaaaattagccaggtgtagtggtgcgcatctgtacttgggaggctgagacaggaggatcacatgagcccgagaggtcaaggctgcagtgagctgtgatcatgccactgcatttcagcctgggtgacagagcaagaccctgtctcagaaaaaaagaaaatgtgatggatctagatatcatgattaatatttaacatggtttaatatatcttgattttattaacattagaggctataacatttatagtagctgtctaaaccaaatttttggggaaaaataaaccagtccggttctgctctatatatgagctcttacatgtcatccaggtaagactttggaatgtgatttcaagtaacaaagatatatgtaaattattgtgacaaattttaatagcacaaatcttaatgtgaatcaatataaaaatcagttcaataaaaaaggaatttagttattaaataagtggtgtatacttgaactcaattaactagggaatattttcccatagcactgtttacttccgaactgtgtcatggccattttctcattcacattcccattctagtgtaagtggtgtaaggacagtggtggctatgtctttacaacatcatttttccagtgcttacatgttgtttggcagacagtgagtgctatttttttgaatcatttaatttatgaatgaattatttgtgcagttttaaaaatgtactacccacctcaaatgtgaggttatatgttgctcctcttagcttttcataagcctagaataatattgtgctaatgattcagagttagagtctaaggtgaactgaattagagccattctttattatgaaaagttctgtaaggatcttagagtgtttagagaaaggcactcagagatctcaaggaaactttattattcatattgccatgaataagtagttttctaagcttacatatcaagagagcggcagctgggagtaagactcttggcctctactatttcccagtctagtgcccaatccactgttcaagcgtggtaagtatgagaccatttttctttctcttatcagtgccttattacagcctgtgtgcttgaacaccacagaatcaggtgcttgttgaaatatttcacgtcttgaacatgaaaaattggcattgatattgtgatgtggatggatatttttaaatctctttttctttatagatagtcatatatctagtcaacttaatgatggccacatactgagttgcatctaataatctaataattgttgaatggatgagttaccgatagagttttcattatgaaaagatttttttaaaaaagattcaactcttagatttatcgaatgaatattgagataacgttttctcattaaaggcacaaaagtttcctcccacatcttttctgtaaaattaacaaagaaagtataaagttgtttttactagaactgccttcttcatttggagttagcacagttttgttcatgttcaaatgattattttatgagattgaagaaagaccgcttcatttgtaactgacactctgacgatgtttcttattttgtaaaatagagaatgtttagattttatttaaataaaactattaaatttcctacaaagactaagagttggcttgctgaatttattttcaaacagtatttttagaagggtgttcagtagataaaaatctgtggaggtgattttgtttattaaatatctggagtcagtgagtaccactcttgggccttgtgttaacctcaagagtactgtatggttattagtaactactaatattcatgtcagcagtgctgagagcccctcactggtaggaatactttactctggagaacagttagatttgaacttgggcttcaaaagggaacggcaaaacactctcgacttcaaagtgatctgcactttgcatcgcagatactgctgaagcatcagattcttcagtgtaaaagtgcggtttcaactgaaggatagggacctatgtagccccccttttcccatttagtattcaaatgagtgcggtctctggaccttcacaaaataatttcttcgcggatctcccggtgccaggttctgcctccgcaagccctacggatcccctcccattttgaagtagtcggcggggtttccgcggtgtttgaacctgagctgtccctctccccagtggccggactcggcctgctttgcgctgatgtcaccacaagctgttacattgcagcctctcggcttcgaggtacctcccactgaaaccgctcgccgactcccgggaagaagcgaaagatgactgcgaagttaagtcacgggagggcgtagcaccgaagtggtagagagctgcggctccggaacgcccggcaggcccagagacgcagcagatggtgcctgaagagagagggcgttgctgcaagcgccctggctggagagcatgcctgcccggcaccgtgctgccctgaggagccgcggacagccccggagctcccttccggagttctttctgctgcctccaccgccaccgtctctctctagccccagctgaaatgaaggccataccgcggccacagaacttggttcagtttcaaaggctaatgtagtccctgggttttctgctcaatgtgaattacgctgcctgtgccttagaggaagccgcggagctcttcgttgctgcaattgcctcaggtggaataagccttcctaaggaggaccagataagaatctttggaaatggctttttttttttttttttttttttttttaaagaagcttagtagtacaccatgctttctgtttactttaaacggttgctggattgtactgccctgggtgtctaaaagtctggtgtttttttctttcttcctttgagtagttctgaatagcattgaagaagcttaaaacaggaagaaaacctgccttttcaatcaagtttatttatagctactcccccctccaaaaaaaaaaagtaaaagaaaaatgtaactttctcataacgttagacttaacttatttttctctgaagatttgttctgtgccttgatgtgaacaataccaggtccctgtgtttgtcttttaaatttctggagcatggtttatttaccagaatggtggagttctgcaagccatctttaagtggattacagttaaccagagctctgccgaaattaacattcaggctgttaaaatgcttgctcatttggaaattttaatctggaaatatcagactaaaaagggaaatggactgacaatggaatgttctgagtgtttgagccactgttaagtgtgtgtttgtttattttctgtgttttggagtgtgtgaacggggactttgggagctgggaaaggtggacaaaggagatttttgttctctgttattgatgcactttattgtttagaatcatcctaaaatcaaccaggtaaaaggatagttgcatttatactgatgcactgctgatgaccttaaacacctcatgtattatgaaatatattatttgagcatgtgtctttatgctaaagacactccatagctctgttcagaagtatacttttttggaagatgctttatcttatttcttatctgtgtcaagagctgcaatatttgttttaactatctgcaaaatggggaagccactcagcagaccagactgtttacgtcagaatcccccatgtgtagggaagggtgaagaagaggaggacctaaatatcgaagactgttacgtcccacagcggtcaatctatgatactgttagactaaatgaacagatagactctggttcaaaaggtagtctatcttccaggcattttacagatcgaactttaccctacagtcacagaacactggatgttagttctttatgctctaatggtgcccttacttcttccagtgtatttgagctgagaggtcgggaagctaacaaactagatgaaaagatgatctttgatgcactcaaactaaatagtgatatcattcgaaccacaggattacctaaagccaaatctcatgcggaaaagaaagagcatagacggtcatggcgaatgtttgtcccggccaattttatggattatgcaaacaaaagtgaaagctcttttgttgaacctgctgatatgtcagatgctgttaccaaggccagcaagtgcagatggggtactaattctctcacttcggaggaggatgactctggtttatgtagccctccagcagagagggaagaaaaacagggcattttaactggagaccagtcacgaattaaaagtttgtcttctactgaagatattcttgtaacagaccaatacagaccatttttttctgttaattccattagcgaacagaaaatcccactgctttcatgtcaaagtgcccaccctgatgaaaatttcaaaatgattttacatgatgtttctccactagaggaagcaaaacatgtaaatggtcaaagggaaatccacgatgaaaattgttgcctgcagaataatttgaaagagagccctgtgaagtgtgacccattaattatgccaagaaatagagaaaatgagcatatttttaaccttggagaagaggacgaaacatacggacctggagaatcccaaatcacagcacaaagtagggaactcttgaaggattcccctcaagatttagatctctctcacacagatctaggggagagtgatgtagattgtggtagcaccagcttagtagaaaatgtgacacttttgacacaatatgattcaggagaatgcaacattgcatctaaagaggaagtggaggctcctctttctgcccaggagagcgaaatgctctataagaagttctccctgaaattcgtatcagcaagaaagaaagcagcacccagaaaaacaggggcccaggcaggaatattggacacagtctgcaatggctttcagttggttcaggtaattcatggaaatatgaaactctgcagtgtcaaaagtttgcggttctgctaaaagtttgtggttctgtttcagagtggtcactagtgtttctaataataatgaaatccacacttttgttttggaggtttgactagcaccctgcaagatgccacatattgataaatggataattataacaaattaatagggactgttttggagaagaattgatattcccagctgttcagggtcctgttattgattgtgcagatggtggccattccccttcatttagaaggcctccactgtgaatatatgttaatgttaggcttttacacaaattgtggtaaagacactgccatttaagagccattatattggatttattaagcttgaacaggcttagtcatgaaggtacaaacagtattatattgttatggcctgcaaagtactctatccacattaaggactttttttaataggttgaaaaatttctctcaggagctctgcatgtgagagtagagttattatgctgtactttgcaggcattatagctcccaactttttgtgagtggtgaatgaggtaagaaagtaaagggtgcagccttgtaataagtagagattgcttgtcaagcctgtaatttttttcttcccactcagattgaagttcagctgttttggtacttttactaaactcttctggtaaacttggcctcaaaggtagttttattttattttaaacttctcttcatgcttgtgtgctgtgggttagattagggggaaaggctctcttcataggtattttgttaacattgagagataaggaacttagacaatatcagaaccgttcctcttctcagtctgtgaaataattgttcttgttagttatgcctttttcttagacatgcagtaaatggcatgctaatttaaaagcttagcaaattaatttttttctgtaaaggatatttcagtttatttgtagaaaacaattaaatcttaggggagtatatactctttagtagttatctttttaaatccttagtatatttttgggggcactttagaaaactatcagatttacctagatctactccaatataaacccctgaaattaatttaaaaccaagaccagaggttaaggcaatttaatagaacattattgttatccttttgtcctgaaaactatataagagggaaaataaaacgtttccttgaatgtttatttacaagttcctggaatttaaaaggtagcagtttttgtacacccccaccctccgcccccactttttgataagtagtaaaacatatccaaagctattagtcctggaagttataacttagaaagtggtatagaaatgaaattgaattataatgccaaattctatctttaacattttgttgccaagtttctgtttacatatttgataaattttacctttttgcaaaattacggagacttcctaagtttttcctcaatgatttgggtgaatctcataatttatttgattatgtgtaattgatttttaaatatttattattgttatatataaactgccagtatggaaattgtctatatacattttctgtggaaaaggtagtttgagtttttagctaggaggagattttagagaaaatgatcattaatttgtttgctgttctctaatttactcatgtatacagtaacacaggagtatcctgtatgctaggccttagaccagagtctggaggatttgtctcctgcagcctctacatctttcaaagttatttttcatactgtgtctgcaatttttttcctgaagtgctattttaatatgtgcctttattatgtttctatgtattatgattaactgtccaatcattggtatatttatatagtgcccttcaggataatgactcagaatctcaaactatgttttaccttaatatcgatgtaaaactttccttccttagttccaataatttattttcctcatggcatcctccaagccctatattaaaaacatattatctatgaaagagttggctcatacctgtaatcccagcactttgcaaggctgaggtaagaaggttgcttgagcccaggagtttgagaccagcctggacaacatagtgggacccagtctctaccaaaaaaaaattttcttttaattagctgggcgtggtgacatgcagctgtggtcccagctactggggaggctaaggtgggaggatggcttgagcctgggagacagaggttgcagtgagctgtgactgcactactgccctccagcatgggtgacagagtgaggccatgtctcaaaaaaataatcataatattgatgtatctactcccagtattatctgttaaggggttgaagtcatccacctaagatagaaatataaatttctatactgatattaatttggcaaataaatattggcaaatattacatgctaggtaccatggtaggcccaggtcatagaactactgtaaggaaaacaaatttctgctttcatggcacttgtattttaatctagcacattaaatcctttgccagtcacaggcaactggggaactgtaaattggatgggatagacagtaagggagagattgctaggaatccactgtcagtgcaggtatgggtgacaatgactacagagtaaccagagttgctgtgctggtaaggtatgtgatcagatccatggggtgaggtcattgtatttcttgagagtccattggcatctctgtagacattgaggaggctatttgtgtagggatccatactattgcagcacatgcctatgtatttttcattttcctatctctgtattttggccctcctgccaagccatgttttggccacttggctcacctcatcctgtccctgattttccatttccaatgtgagtctcaagcttcagttgccagctagcagcagccattcttaggagagcctattaggattgccttgcccatgaaggctcattttgtacttattttatatttttgctctttagcattttctgtaaatcttttgctacagttaaactgggacaacagaaacattttcatcctatgataatgaagcaataaagagaggagacatgtactgtcttcttggttttataagtaacttaagtgtactcagaatatcattctttagtattctcaaatgtttttgatgtgctactaatttatatttagtttctttctgttcttcagaaggtagctatgacctatggctagacaataaaaattatctttacctctgtaataattgatggtttccacaacctgatgcctaaagaaatgcttattatatatttggcggttgataggtaatataactcatataattattactcttttaactgcaggtattccagaaagaagagattgaacccttgcaaggtaaacagcaagatgtaaactggttaggtcaaggccttattcagagtgctgccaaaagcactagcactcagggcttggagcatgacctggatgatgtcaatgcacggtggaagactctcaataagaaggtaattttctcacccccttcattgctattttgctgattattattcatgagcatttgtggtgaccatgaatcatatttgtggtagccaaacttttctaaatatgtctactgttttatattactgtaaactggatggctcaaactcagatgcctactggagctaggtagggaatctaaatgaaaggaagcaaactgggtaagacagagcctcttcctgctgttatctcgcctttaatcaagacagggtcacagatacaacagtgcaggtatgatgggcacatgcatctgtaaaggtacaggtcactacttagttccagaagatcattgacatgtaggcatgtaggcccactgttgccagatattctgtttactttcaaaataacctggaaatctcactttctatgtgaaaccttcctattttcaaatattagcaactaagttcacaccatacaaacaaagttatgtctttatgtcattcctggactaagtcctgctaccctcactgtagaccatcagccctcaattacttgtaagatgtaggtccaacctttttctaaattcccatgagagaaaacactagaaataatgctctgatgtcttagggagataatgctgacatacgatggcaggcagctcttacgagacataaattatcagaaaattattatgggatggcagtgcatatctggttgtggcagtggtggttactcttgttgttttctttcgattgacatcttcagcaggtaccaggtcttgaaactatattattcattctttaaagtctgatacatatgtgtagtgcaccttaaacacagttggaatgctgtatcaggtgtaaatataatccatagcacttacaatatcttgccagctactttattcagtccaaaaggaaaatatctgttgagacaagcaataagatatctctatgtaggacacagagactccatttactggtagacaaagggcctggtttgttgaaaaaagactccagagcttggagctagcagaacttaattggatacttttgttattcttgcctagcaaaatataattctgattctctctgctataatagttctgtttattcttaatcttttaaaaatcattatctctgatatttattagaaggaaataaaatgcaatattgataaaaatgactaatgtgctgttttttacgataactctaaaatatttgaatcattcattgctaatcataaaacgtattagacaatccaaaaacctccaagattgagtgctctatgttgactgtgatggtaaccttattttcatgcctacttgcttaaagtttgtctccttttcactgctatcctgcctactatcgatactttgggtaaattttaagtgaaaagtaaaagaaaatttgtgaccacacgggaaaataagcatgtaaaatagtgatttgtgctcagattgcattattttgtgaaacaaataaataagtggaaacaattggcactttgcaggtggctcagcgagcagcccagctgcaggaggccttgctgcactgtgggaggttccaggatgccctggagtccctgctcagctggatggtggacactgaggagcttgtggccaatcagaagcccccgtcggctgagttcaaagtggtaaaggcccagatacaagaacaaaaggtaagttagtcatgcttttgtattgcgtttcatattaaatcttaataacaagagaaaaaatgcaaattgtgactcttttaattaataggataacctagttaaccggttgttgctgctgtagacattattttgttagtcattcgacaaatatttattgaacatctaccatgggccaggccttgttccagttgctgggaatatatccttgaataaaaaagatgaacatttctcattgagttcaaagccaagtgggaagggtgtgccaggattgaaagacaataagtaaagtaaataaatgaatggtgataagttagcaagtgatgaataaagcagggatcggggagaggcatcaggaagcaatagagcaaagatgagggacctaaagtgctggaatggagggagggagggggtgtgtgtaattttaaatagggtcatgaagggaggtcactgacaagatggcatttgtatggaaataacattgttcccttatatattaggttgatccctatgaaattgtctttttatatattaaatattgacagcttcttttggttccacctattactaaagagacaaatatttgattcatatatgctgaggaatgtgccattgtgtcttttgacactactaaagtggggccaatttgggaaaatagtgtcttcagagggttgatatgtacctgagactgaccacatgatagtttttgtgcccctgatagcaatggtcgggtatgaagtatttaataccactttgagtagtaatcagccagccatgacttgagatgacatgtgggaaggatcctagagcatggcgtactgttaaggtttctcccctctggaactttaaaaagaagaggatggattatgttaattacgttattttaaaactcaaagaaattttttaaaattttacattaattttttttaatttataaaaaagacaacattttaaatttctctttctgtacctggcttatttcacttagcatggctgctaataatgtactgtatatttcaaagttgctaaaagaatagattttaaaggtcctcaccacaaaaaaatgatgagtaggtgaggtgatggatatgtcaatcagattgatttaatcattccacaatgtatacatacatcaaagcattgaattgcaccccataaattcaattattattcatcaattaaaaatggaaaaaaacaaaaaattccacatttaccctcaattttttttttgtatttaagacttactgcttactttaatttctacatttaatactatctccctagaagtttttgaaaacttcagcatattgggaaattataccaattagaaatagatttagaggtaaggattaaggacacataactggaaacacattgcatttgtgcgatttttgcataatacagtgtctaccattcacaatttaaagttaactcccagagtcatgatgcttagccaacaaaacctattaattgattttgcttttttaattgctagaagctttattattaaaatgtatcaaagtaattagttctccttgctgccaaagcacctgttgtactttgattatatcatgactttagtatataaaaacctgtgccaacacagtttgtatgtcttacccttctctttaaacaagttcctcttaccttctgccttggtggtcctgatctcaaaatactcttttagctttttacttctgggtaactgtcaaatctttactccttaattagcagtcaggatcattaaggaagcagtgaagcatagtgtttcatacacttacgccttcctcattgctggtagcacagtgcctgtgcacagcagttgctcatgagccatttgtttgattagattagagcaaggtaaaaggctaattatagcaaacatttcatttcaggtgctttgaaatgtttaattagaatcaaattgaattttgtttctggtgctaaatcctgaaatattagtcttatttagccagctttggagatttctgacatcttctaccctctcttcctgttgccaatgatgtgtaaaagctgttttagtttgcagcctcacacagattttaggagccagttccacctagtaaaaggagccaagagcctctcgttttagccttgttaacttgtgaacttgggctgagtcttaacttccttgtctataatggattgtttaacgtgggaaagggttttgaaaacagtaatgatttataggaaccttttgtatcttgacaggacagatagttgttgaatgtttaaggcagtcttatttcattccgataatggagattttgcacttttttcatgattcattggagttatcctaagtggcaccttctaccgtattattctatattaaaaaattagtaatgagtttagtggccttaccaatattagttttgtctactgtgaaaagcccctgccacagtgtctgacccaatagtaataaatcattaaacaaatgagttacctttaaaatctcgcttttcagatcctttcatatgtgcatacatacaaaatacatttttgtcatacttcaaatgtacttagaatacattgtactttatattcatacaattattcccttgcttttttatatttaatgttttgtctcaagcttctccagagattgttggatgaccgaaaatctacggtggaggtaatcaaacgagaaggagaaaaaattgctacaacagcagagcccgcagataaagtgaagattttgaaacagctcagtctcttggatagcagatgggaggcattgcttaataaagctgaaacaaggtaacttatatacttccagttcttttgaaagagtagcagtggcctctgtctacaaaactgacattttgtattttgttaatacttcaaatcatgattttcctatgtttatcatgtatgtgaacagagatagcaaagattgtagtgcctctttcctcattcctctaatggtaatggcttgtcaccgctatatcccaactttttaagacaagcatttcccttgggagtgattacttcatttgtttattacatagttactgcctgcttaccatgcatcaggcacagagttaggtcttgtgttataggggtgagctgggcagatcatctctgtcatcagatagggtacagtctaagagggtttatagccattgagaagtaatgataaatgtgatgtctcaaagttgaaatacaggttgctgtgggagcatatcacaggaagaacctagcctaggggcagggaaatgacagttaagctaagttttagaggggaatgggagctaggaaacaaagaaggtggaagggtgctctaacttcatgaaggctaggaagcctagagcctggctccactgggtgtttgttctcaacaattttattacaaaaccccaacccatatttcagtatctgcattgatgccgccattgactagccatagtagtagctacattgaagagtagtcacctaggctggttgggttgaaatagatgaaaatagaagaatcactgacctgagtgagtatgttatataaattcccaccttctttggaaccagaatagtgaagagaaggatttgtctaaacttcaaatacagagtataattaattatagctttagggccatagaataaagtgctcccaaagaggtgaaaaatctcatgttgtcctctgatatgtgtcaacagattaaccgttctgtgtaatgccctgggagctgtgccctggctgccatgggagatactctcagtaattttaaaataataaatgagtgaatgtctagatctctgctttactaccataactagtcttcttttcctaaaactttcttcacagagatattaaattgagggatattggtaatggttatgattcatgcccagatttattgtggacagtttaaatcatagtaagtgaaatcccatcacagaatagttatttccactgattttagatgattggatatttgaatttagaagaaaaggtcacagatagtgataatccagaggtaattacgaatatagtaattttattcatttttaggatcaaatatatcaactgaaagtttttaaaaatgtgtgtgcattgtgatatgttatagaaattatgtttaatagcttatgccaattttctgtaattcccttcttcttcatagaaagctaatttttcaaaacatgtaattccctgaaaattaaacatgataagaagttaaggcagcaatatctcttgatcccagcagaaattatgtatacaggatttgatactgaatcaggtactccgtatgcagaccagaacaatagcttgctctagataaatactgaggacagcggaaacaggttttagctttagtcctctgcaactgaggaaacgtatttccaaagatattttaaagtaccagtaaaagtccaatgaatacttctcccctgttcatgatattttaatccataaaatattaatattgcttttgggaagtaaacctaaccctgcgcttttataaaataggaatcactattaattccactaaggagaggaggaagaagctatgtatgctcttcaaaatttgaaaccagttttgaccatttgattaagagcaatctcagtaactgttgctccaattgaaattaatatataaagcacttaaaatggggcctggcacagaatatgtgttcaataaattttacctgttgtcgttactattactgctgttattattataacattgctgtcattattataactgtaactattggaagtattgttacagaagattacttcagactttcatgagattcaggaacttgaggatgatctgttgttcaactttaattttttttaacagaagaattgttttaatatgttctttaaatgttaagagatttaaattgtaaccttagatagtttctacagaaaatgtttagaatagattgcaagagcatgactgaagatttttgttgaatatttcacacattcttcatccctaaatgaccttttggcacatttgtaggaatcgtcagttggaaggtatctcggtggtagcacagcaatttcatgaaaccttagaaccactgaacgagtggcttacaaccatagaaaagaggctggtgaattgtgaacccataggaacccaagcatctaaacttgaggaacaaattgcacagcacaaagtaagatataaatcacacattagcgaggttcagtttttattgtgtggttttgtgacataaatttgagttatgtactattgttttgtttaattgcaaactaaatccatttaacatgtcatgctttagttttatttatgttttcatttttatttgtccattctttttgtttttcttctttatttttttaaactttgcttaggccttagaagatgacatcatcaatcacaataaacatttacaccaggctgttagcattggccagtccttaaaggttttgagctccagggaggataaagatatggtgcagagtaaattagacttctctcaagtatggtacattgagattcaagagaaaagtcacagcaggtctgagctcctccagcaggccttatgtaatgctaagatttttggggaagatgaagttgaactgatgaactggctgaatgaagtgcatgacaaactgagcaagctctcagtccaggattacagcactgaggggctatggaagcagcagtctgaacttcgggtattttgatttattttattttatcttattttttcatttcaattgtcattatttcttagtccttatttctgtacaattttatgtttatgatgatttcgatgaattgctgtacttaaaaaaagactgtttatacagattacttttaatgaagtcattttaaagaaaagagtgactctatccaattagctggatatttcacttttcattttgttattttattgttgtatacaaagacctgtattaaccagtacttcagtatgtccacaaagcccattttcatagggccctaagtattttctgaaaaggaatatgctgtgaattatggtagatgaacatgggacatgggccacagaggtgaaaagaagaggtctaaacatgggaacaataagaacatttgaaaatgtgagatatttactcaaatatgtctctgtgaaatctaattaaagttctctgagattaactaatgttaatgctaacttaaatgtttttccccccacataaaaatggtacctgtgttttcaggttctgcaagaggacatcttactcaggaaacaaaatgtagatcaggctttactaaatggtttagaactacttaaacaaaccacaggtgagatatctttcaaatcaaatcatcatgtggtcagcattttatattgttttcaaaatattttagggatgggaaaaaaccaaaacactttataatttttggtccattccaagacttttattctggagaatgctttgaagaccaatcaagggggtggttaggatatgatctcacttttttctcatgatctcacttgagttcttgatggaagttgtgtgtattactcataacataaagcactttggcacaggagctcatcagagaagcccaggacagagtcacattacttttccacttgtggaaggcagatgaacacgtaggttgtagacaatttctttttaagatagatcgcattgcagtgacacacagtatggctacgtgcatagctatacatgggcttcatttcttcatgtctgaatcaccaagaaaactgatacatagtttagtatctagatgagatttttaggacaactcagggaaactagttttagtgattcctttggccataggaatttcactatacctatattcagttcagcaatatgtgtatgttgggggcaagtaccattcattatgcattgaagaaattaaatgtagaatcaagagcctttagttagaagtctgaagcccaggacacagtttttctgtgtgtcaaaaaatgaggtagaggcaaataaagatctgttggaatagtgcagatgagtaatgatgaataactaagagcagagaggctaagtatcttgcccaaagtaacccagcttttaagccatgcatgaagtcagtatttgaactcaagcagtttttaacctctcttctttgaaaacaaagtctcatacagatagatacaaaagtactgctttccacatagctaaagacatttagccttttccagttcctacatttgtattttcagagtgatttagatttgctggaaatcttgggaaagattaaaatttagaaaagggcttctcttgagtaagattatctttagaaaaatgtctccttttgttctgtggaaatttcatcagtgttccataatatctgaagaaaccctctccctgccttttttttccttcataagaaataacgtgactttgaaattttaggtgatgaagttttaataattcaagataaattggaagccattaaagcaaggtacaaagacattactaaactgagcactgatgtggccaagactctggaacaggcgctgcagcttgcaaggcggctgcactccacacacgaagagctgtgtacctggctggacaaagtggaggtggaattactttcatatgaaactcaggttctgaaaggagaagaagcaagtcaagcacaaatgagaccaaaggtaagctctgatttctgcattttggattagtcttttatcttttaggcagtcttattcacacaaaaataaaattatatttgtcttatgtcattacatatgctgaaggatgccttggtgggtggagacccaatagaaattggcagcagatcaactgtttaaagttttaggagcccagagatgaaaacagtatgttataattgttgcaagagtcttatatttgggagtatagtttattacccaagggacagaatgatgaaaacagaaaaaaaaaaggaaaatgatcattgtttcagagacacacataatttggttggaataccaatatttctataagataacatggggtgggttttctaattatatcacaaacgtaatacactgcatggtaatcattcctcttttccaagatatcagcctctgtttttatcatccttgaagtatgatcacatgtgggtgaaagggagttggtgaggtcaggctcactgagcctgtaatgattctactgtcatgatataaagccagtttgtcatcattttgagggtcacttaattctggcttggaatatcctcttcattttacttttctgttacctgattacttagaggttcccagaaagcaaagaataatacaagttaacttgcttgtttttgcttctgaaattttaaatatttatattaaatttcaaagataaaatcttgccgtgtcgacaaatgaattgttctttgaacttctcaggaaacatttttctttttgcaaaatagctttagataaaaaaggtttatttaactcgactgaaactaagggagggggggagtggggcaaagcatcacattattcgcctgcaaaggacttgagctccaagaacagttaaaggaaaagtctgttgaagctcttaagtgttactaacttatttgtatgttttcaggaactgaaaaaggaagctaagaacaacaaagccttactggactcccttaatgaagtgagcagtgctttgctggaactggtaccatggagggcaagagaaggacttgagaaaatggtagctgaggacaatgagcgctaccgattagtgagcgacaccatcactcagaaggtggaggagatcgatgcagccattctgcgatcacagcaggtagggaaaaatggtttgttgtttaggcaataaattttctccagctgttcttggagcttttacctgaacaaagatgactgttaatactgtttccattcatttgctgtgcttccaaaatgaaagagtggatttgaaaagaagttgactgggcttcttcgacgtctgagcaccagggcaaggctaatctgcacattgttcacagccatctgcctcattgtttcacagatttatccttaccaagtcagacactgcgaagatcagcccagctttccaaacaaaatgcttttgtctacacatatgcatattgctgatattaatttttatgtattgactaagtctaatctgtatgtgagtaaatactgtgaattgttatgtaagtcagtattaactgttcatttacagaaagctggggcaaagagaatgttttctttttaaaaaggaagcagttttgttggtaatgtgaagtttttttctgaagatgacagaaggggggaaaagatgataggttccaatttgtctataactcctgcagaatgtatactccaagagttttataggcattcagcccttagccacagctccctgggaagactgtgggcaatgagtggggtcctggagatagaagttcgtaatataatacatgtgttgattaactttagttgaaatttctgtgaatatttatattaagtcatcacagttactacaaagtttatgtgtgggggtagtatgatattgcactgtactttagagcagagcttgtgatggtgtgtgactaagcttttactagtatgagccaaaagcaagaggcataaatcaagctgattctgtgggagcatccagaattaattttctaatgttgccatagaaatggaatttatagttagttctaaagcataatgttctgctcctcattttagtgctgtgctctgggatcacaacagctgatgaaatgcagtgatagcaaaagccctggctaagaaatttttgtgaaggagggcattcatgcttgaggaatgtatttgtgtgactctgtttaaacagaggagtttgtatgcctcatttttataggaaaatgagggtgtttatttgtgaagtttatttaactattgaaaaatatatttttttcactgaaatgtatttgaacgtttcccaactggcactgaaggcttctctaaacagcaagaaaattattctgtactcttgggagtaagaatttcttgagaagttgactgtggttggctggttcagtaaagtgaggaagtaataagggcacagtcacagattgagttttcgttggttagtaatctctgatatatgccaaggtcattaactgtggccaggttcttcaaggttttgcgtatgttttccaaaggcatgggggaaagtaagtcagtgtaagtcttccggaatcctttaggaaaataatgattttttttttctgatagaattagtccttatttaaaatttcaagattttctcaaagaatatagaaaaattcatgaaagaaagcatatgtaagcaatttggtctgtatccttccagtcttcgtcttgaaagaggaggagaatttatatagtaaaatccttttgaaagtgaaagacaatgtatatagtaaaagtcttactaccaacagattacacatcttaatgccactgatatcttctggttgttcatgtgtgtatttttatcttcatttctttgaaatacctgcaagtctgtccaatgaaaatacctccaataaggctacatagacacacagatgtttagagctgggaggaacatgcccagcatgcatgggataaagtgacttgcatgtggtctcacaagcagtaagtggcagagtagcaactaaaatttaatccctatctcattctccctcactgctgtgcctcctcataaattatatatagagaaaaacccttgagggtggtaaaccattttttttctaaaattcttcaataatccgaaggttccattattacaacaaagtggaggtatctaatgaaaatatttccagctgtaaagactgtggaggatgaggatacaacactaaaaggatcataaaacattaccgtgtagggaaacgtaagaatagagtagtaggtacctgtcttcctggtgtggcagagattttgcacttaaaagataagtttccaaactcataattttcaagtttataaagaagctaatatatccctgaaatattttataaggttgcctacttatagatgtttggaattaggaccagagtacagtttgataaaaatgtttgttttctgttttacccaataactacatccatgaaatataaaaaggagtgattaaaaaaagcatatctttagacctggacattagccacgtattttggactatctgttttgcattgtttaaacaaattaccattctgagtctcttctctgtatgaaatagggacacgatatgacctgagctcatctttttagacacacctttagtcatatgcaatttgttttattaacagtgactctttccccagacccctgcccccagcctaccaacagccacacatgatggggtaaggacatgtgtcttgaataatacttaacaattttaaaatttatagatttaatgatttgtcccagttaaatcagggagagttaaattagattttcaatgactaggtgttctgttttctgagcagaaatatctcttaagatacttcatattttttcccagttttaaggttgcatatatacagatatacctcttttataatgtcaacctgctttttgaaatttaacaaaagcataagcactttgtgaactgtcaagccacaatcgcagaatgtattgacttctaatcatcagcatggaagatgtcaagaaaaacatggaaaagacttaaaagtttgaagggagaacagaagggaacatacagataccttctcattagcacatactttgtaaccactttgtataaatttaggtttttaaaaagttttgatttgacagggttagattttcttgttaatcctatatcacaataacagttttgaaaagatacgctattgaactttcataacataggtgtgaaggccgtatttgttattatttgagaaataattgaaaaacctcagtaatgggtgaatgagtaagaacttgtacattcactgataccacccaccagtcccccaaatctgactctagatttgcgggcattgatattctaaaaagggtattattttttaaagtagttgggcccattcattacttttaggaagaatctgaatgggacaaggcagcttagtaaataatgatgttgagctgaactgcctcccttttacaatacatgccattatctgagttataaactgtacatatttttgcattttaaacctacgcagagtagcatatctttgttgctttctttctacaagctttgtggaaatggagaaaggcacttttacttgaaaaatgtacagacttgggttctgaattcagactaccttgattctttaagcctcagagcaattcatcatcctttgcttcttataatgtacaactgtcagtagttgctaaaatatgtatatcttactgggtctgggaatcccaagctttcttcagcagttctaattgcttggcttatgtaagtgggccccataataaccctgttagaaaggcccttggattggtggtttgggtgcagttaatgcaaacaactcattgggtcattaggaatcagcctggagaaaaatatcacctgtttatttcttttaaaggaccagaaggaaacatctcctacggaaatgagatttgttcagaccctccaggtgttgtggatgggaaaatatgtcttgtgttataaataaagacaagcaaagtggaaggaaatgctaatcaaaagaaagtgataagatccccagtaaggggaagggagtgaaaaggatgtccttgaggttaaggtttgcttatcactttgccttaaacctctattaaaacctattgtgtattgactgttgtgatatttggcagtctagaagtcagaccaccttcgttagaatctcaggctcagcatttactacctgagtagtctttggtaagttagttaacttccctttacctcatttttctaagctggaaatggagttaatggtaatacatgatacagctgtcaggattaaaggaggtattgcatgttaagcacttagaacaatgtgctcagtaggatgctggctgttactgttttagagagtgtttttcaggcatatttagatgtagctacttaaaatgtcttgcactaacttttagaaaattcctgaaaggctaattcaactataaacagaagttacagtagctagagttggtggttcggctcctctgatgctattaaagtatttccccaaatacaattatggatgccaagattatcaacattttatgttaagtcaaattttacttacttgtatgagtagtaaacaaatttactaaaatttgacctagtgtatttctctccatgttgcttacatataaagtgagccatgtttatggtccattagaaatatgtttatggaccatgtttatgttccattagaaatgttaaccagtcatttgagtgagtcatagacctaaaatgcctcgccttactataaattacttaatgtagatcctgtagctactccctttgttgcttaacaatatttgataatttaattttaaaagtttctcagatgacaggcgggaaatatctgtttgaagtcttttttttttttttttttttttttccttagcagagcaaatgtttgacttgatcaaagaaacattgtttggatttcagctttccttttttggcaacttagatggtatcaccatactgtttattgctggaaagtttttttttttttttaaatagggaagacatagtgttaaactaatattaatatttcacagcctgactgtctttatgaggacactcatttaaatactgtcaggctgaacacaaacaagagggttggggtattactttattttttttttcaggaaccagtggaagaaaaaaatttataactgttaaattttattcagatatcttgcagtatttacactcaggtagaaaggcctgaactgtttttctcagtcttatattctttaaatgaatcacataatcaatttttacctgtagctttacatgccttgaaaagtaagaatccacagaagactaactttcacttctttttcatggggattctttctccacacctgaagctgctgaattagttgatgaaatgtttttcttttgttttcatattgatcaataattgctcatgaataacttcatttgaaattaaataatatcacagaaattattgaaccagcttaagatagattattttaagtggtttcttggtttccttataattacagaaagtctacctataaacttgacgatattaaattttcaatatcaaaaaataaattataccccacgtttatgaagttatagcaaaacactgcttgtgggagtgtacattagcacattctacctgaagggcaattgggcagtattatatcgaagagagaaaacacaaataggaactgataggtgagacgttacccacagagttggttttctttcttttaaaattttttttatttaatatattttcttttaatttttaatttttatggacacatagtagatgtgtatatttatgaggtacataagttattttgatacacgtatacaatgtcttattaaaattaaacttgttttaagataattctaagttcacctgcagctgtagaaacaatacagagagatcccattgtatcctctactcagttttccccagtggtaacatctttatagtaaaatatcacaagcagcatattgacattgatacagtcaagatacagaatattcccctcaccacaagaattcttcatgctgctctgtgagccatacccattccatcccaccctaccctccgtaacttttgtcaaccacaaagctattctccatttctataatgttatttcaagaatgttcaagtattttttcagtcacaatctctttctcttctccttctgggactctgataacatgaatattaggacttttgttgtagttccacaggtacctgcagttctgattattttttaagttattttctattattcagtttgggtaatttccatttctatttctaagtggtaatttcttttccttcactgattctttcttctgtccccttcattgagctcatccactgagatttttatttcagttacatttttcagttctacattttcatttggttcttctttatactgtatattctttttctttgctgagatgttctgtgttgttgatgaagccttctaatttctcatttgtttcaactgtgaacattcagaagtactcattgaagcatttttatcatggctgctttaaaatcattgtcaggtaattctaacatgtctgccatctgggtattggcatctatttgattatcttctttaattcagtttgagattttcctggctcttatatgatcttatgagtgttagagcttaagctttctgttttagctgccttcctcttaccactctggcagaaggtgggggtgctaccaggtgaagatagaagtccaggttcccaattccacctctgttgacacctaggagatggctcgtcatttctgctgagtgggagtgggagttccagctccctatgtggtctctactggtaccacagtgcaggtggctgtgatggtgacacactgagtgatgatgaagatcctgactctccactaggccttctctgatatcaccccagaggagtggagggaggggcagttcgttattgcttagtgggggtggaagcccagcctccccacatggtctcaactgacaggatgatctggggatgaaaattctggctccctacttggcattctctaacatctcccggcaagagtgttggggaccttgtcatggcattgcaaggatagaagtgtaggccccccatttgtcctttcttggcatgagtgtgagtggagcaaccattttttctgtagtgtttggttggaatagagtggttattgtttaaaagttgtctgttttgctaaactactcctttcctggttctttggctagagagagcaggcttgttttgggactttgtacccgtttagtgttgtgtggttgctagtttttccagtatttagtcttagatacgtgaggcaaaaagaaaatcccagagaactcaccactgtgttcttccttgtggcccaaggtccatggtagttctgtcctcttctctcccctttgtggaatcttcttatgtatgttttatatataatgcctgggatttgtaggtgtacttaccacgaagaacagagaaaagctaatgtactccatcttcccatgagttggcatagtgttgcagagtttttaaagtatgaatttttaaaaatctagtttcttatctccacccatctttctccccacctacctgttctcccacctcatctggatttccagattcctttgaaaagttagaagatctggcagtactggacttgaatagccaaaatgttcattcctcattaattcttccaactgaggtcatttcagtgatcatttatggttggtactgtggtgtcacaggcccattttattcatgggaggcactggggtttatccgatggaagacattgaaaatgttcgtgctctttgacttgatagtcacttctaggaatctacactaaggaactaactagagatgccaacagaaatttatatacaaatatattcattatagggttgtttgtataataacaaaaatgcagaaagcttaaacgaaaatccaggtatgctagaatataatggtattatttgaaaatcacatttaaaggagtatgacatgggaaatgttcatactaaatgaaaaagcaggatatgaagctgtttatacagtgtcatcccagacattttttttacaaatctttctctcttgatttgtggaagaaaattcactacaataccagcagtgttaaatctaggttttaattttcttctgtatgtttttctctgctttatgaatttgtactgtgcttataaattactgttttaattactgttatgatcaggaaaataacatttattaaaatatttaagaatgctcttaaaaatgttttctgccattattaaatgagatgcttaaaaattatacatgaatcatttaggggtatactctgcatatatagagatgtatatttacacatgcatttataaacataatagtataataaataaatggggatattctattctttttgcttggaactatgtactttgatagcagaatgttagttgcatatcataggagttgaagtgatgggtgaaatgattaaaagatggtacctggctgttggctttcataactgttagatttggacagtactcctaaggtgcaaattattaagactgcctgaaaagaaggcaatagtgctagctgtcctaaaatcattaatgcagtgctataaatccagcatgttttaagagcttgtgtttaattactctgtggaaagttctcctttctttaaaatttagtcattatcacgaattattttaggatgccatgaggagacaagctcggattttccacttgtgtaataaggatatttcaaagaactgtagataggtattttctggcatcaggaacgggaacgtgctgacctaattatttatcttttgtttagtttgaccaagcagctgatgctgagttatcctggattactgaaacagaaaaaaaattgatgtctctgggtgacatcaggcttgagcaagaccagacttctgctcagcttcaagttcaaaaggtgaagaaatacatttccaattgccatatgaattatttgctggtgtgctccaactctataaaatgtgcttgtatgatttactttttaagacccctctagtgtaacgtgatatttttaactacttagcctaattgttttcattttagtcatacaatttcttgttttattttttgtctttattttggtaaatcacagacattcaccatggagattttgagacacaaggatattattgatgaccttgttaaatctgggcataaaatcatgaccgcatgcagtgaagaggaaaagcaatcaatgaaggtataatcttgtctgtggactggtagtgggactcttgaaaaaacagcaggtgttgagctttcagtcctagaaaaacacttctccgttatccacagctgccatttaagcagcaaaaataattagtttaaataaggcatttttcaagtttatagaataacagtgaaaggaatatttcttaagagaatcactatgaggacaatctttttgaataggcacaaaggctattaaggtttgagaccttggttaactggcacgcattaagcattcagttaatgttagctgtattattaccattattatcagtataaattattgttttttatatgtatcaactattgtttatgtgcttcagagacatttgggcctcttaataaaaaccaaaatatgtggctctctctaatgctgaaatccattttgtataaagttacagtaagctatatagggaaaatatgatctgagtaattaaggaagcattcagcttgtgtagttttaattatcctttaatttggcagaaaaccagccacaaataaaaatgttcaattcatattcagacatctaagcagcctgaagaaattgatgcatattcatgcttctggtaggaaagatatcccatgcatggcaaaaaaaataggaatctctatgcctaaaatcatattttaaagagtatgcattgcttttaaggtagaccacagataaaataataggatgcacaatgtaatgatatgcactcttttatttatttatactctacaatggcaatttgcttgtttataattgaatattatttttataaagactctgatgtgaaaaatacagattgttatgaaataatttctttgttattctgtggtttattgagttatgattgtgctttatcttcttctgctattagtttttgctatgagtttataccataatctagatcactgtgactaccccattaaatccgtgtatagcacaatggcaaatgttctgctttgattcctctttctctttctccttctctttctctttctctttctttctctttctctttctctctttctctttctctctctctctctccctctctctctttctatatatatatacacacacacatatatatacacatatacacatatatatgtgtgtgtgtatatatataattaaattttgttaactaaaaattttgacaatttcatttgcaaaaagtggtctttattttttttctgcaaaatatatgttgccagaatcatatgggacttgttttctaatcttgaagccattgtaagaatgactggagaattgtgtgtattgtttttggagatctcagtgtcttattcataaaaacttgaggcactttaatttaaagtgaacttttgtacgtataaaccattaaaatctgaatagcttttactgatgtattcatttaacatatatttgtcaaacgcccactctgtccaggtgtactgtgctggacagagcactctggagtgtgtgtgctcgttggcctgaccagttaaacatttcatccttttattttctagaaaaaactggacaaggtactgaagaactatgataccatctgccagattaattcagaaaggtatctgcagctggaacgggcacagtccctggttaaccaattctgggaaacatatgaagaactttggccatggctgacagaaacacaatcaatcatctctcagcttcccgccccagcccttgaatatgaaactctaaggcagcagcaggaagaacatcgggtaagcctggtgtgaaagagaatattgtattccccattaaaagagaatcatgatttttatggtggtttttagtacagttaaacacttacatgattaaggcattttagaataccgtgttctggtctgtgtaatttgcttacctcataattgcttcttatacagggttatagtgagaagactcatgtggatatacttgttgtatatgtcattaattacatcacaacttttataaaatatgcagtataaatcatctagatagaaaaaattcccatttaaaaatgttataggattaagcttttgaagtgctttcaatttacacacattgaattgttttaaatttatacatttagaatgtaaatgcagagtggaaatatatgggagaaccattatacagacaaggccattgagtttggagaaaatgtgtaatataatgaatgtgtcaaaatagcaatattatgaaagctatgaaaaggaaaaatgatgaagtataaagacagattattttgttcaccttaggtacatggaactcctttgaagttcttgttcctgtaagtgtaaatgggtaaagtaggaggagcacatttacaactacagttacatcacattttaaacatgtatgaaatggcacataaagccctcttttcagcagtcacttaattgttaatatggcttaaaattttgtaagggtttatgtgagagagcattccagactgtcagaaaaaaactagatttcttgctatttatggacttgtgaacctagttgctcttccagatctgtacagaatgtactctgagactaatcatggtgtgcatgtgtgtgtgtatgcgcatgagggggtgtgtgtgtgtgtgtgtgtgtgtgtgtgtgtgtatacgcctgtgcccaagagagaaggagggagagagggagagagagaaagggagggaaaagttcaattcagggtttattacatcattgtttggaatatgtgacatcttgttaatcttgtttgtttacctttttaatgaattggcattgaagactatactgaagtatttatttaaaagagagttttagagaccacactttaactttatttaatatagaacaggaatcttatggagttctatctaaatgattcagcaggagaaagacaagtatgtagaattcaatttttgtataaagatttatttgtggcagaaatctgatatctacttactgaattattttaaatgaaaaatgtttcatggatttctatgctgaggtgatttgaatagccacatttttagcatagcatcaaatagtatggaaaggctcattattgagctgaaattttaaaaattgagtttttttgcctttttgcataatctttaagctctcaaaacaaatttgtgattgtctgtataaagggaggtacaaaactttgtagccacatcttcaaattgtttaaactaaaagctttgctgttgcagaatatttgtagcctcctaggatggcatttcttttccagctctacagcatcttctccatgtattttgggggaaaatctagttcattctagccaggaatgaaaaatggctccaagggccatgttaccacatgatagatatcaagtcacaccagatagctccagcatgactggactcctatgacagcatgtgccaagaatcattttgtcacatataaggcaaaaggcatctccttttgggcccttttctgatacacacacatacctgagtagatggctggtaggtgttctcttgcctgtcatggaatggtttaagaagggtttaaaaaaggctcctcggccaggcacagtggctcatgcctgtaatcccagcactttgggaggccgaggcaggtggatcacctgaggtcgggagtttgagaccagcctgaccaacatggagaaaccctgcctctactaaaaatacaaaattagtcagatgtggtgactcacgcctgtaatcccagcagtttgggaggccgaggcaggtggaccacctgaggtcaggaattcgagaccagcctgaccaacatggagaaaccccatctctactaaaaatacaaaatcagttgggcatggtggtgcatacctataatcccagctacttggcatgctgaggcaggagaatcacttgaacctgggaggcggaggttgtggtgagccaagatcgtgccacggcactccagcctgggcaacaagagcaaaactctgtcttaaaaaaaaaaaaaaaggctcctctcactacttgccaagccaagttgccttatagtgatgctatacaggtgagatctacctagacccaaaggaactccagaaatatcagcagagatgtagcattttatttgagagtctcttgataactcttgagtgaaagcttgttttccaagcattcctgaaagaacattgacaggagaacgtatgtaacatcttcagttttccttttccatgagattatctatagctgatataccatcaccacctccattcggtaaagcagcatgaagatacctaattatgccaaataaaaataaaaacttggcctgggacgcccaggagctagattgcaaacatggccctcccacattcttatgtgcagcatgctatattagactcttccttcttttaaaattgaattcatctttatttagccctttctaaaactattttgaggcagtcttttgaaaaccttcaaaaacattttattacattggtgatagttaatgatgtaattcctcaacaggttctcaaaataatgctcataattgattttagtagacactttcaataaaaatctaggtatgtggccatcctggtgactgatagaaattagagtttgcaggaaaagattggtagcttatctctagaccatctttcctgaaagtaagattccccagagaagcttttgtgaggggctggagtttggagatacacattctggtgaggacaaagagctgctgatgagggaacctaatcaataatgtggtgcaaatgaaagacccctcaatgctgcacagaggccagcctcagaaaaacctgcaagcaaaggcagatcttccccctgggggtggctttggttttgacccatgaaaaactgctcattgaaatccatgggatccatgaggtgtatgtattctagctttattcaggcttccaacacatcttctctattaaagggaatggggatccacttgaattctacacccacgcactagtataaatatcattgtatttcttgattagctagcaaaattatgcacattcatatgacatgtgtttttccttaaatataccttacaaacaatgctcagtatatagctgtgtattgatagattgcccttgcagcctttaatattttaaaataatgaatatagattcattcatatgtgtgtctatatatcatatatatatagaatagattcatacataaatataaaatgtaatacatgttcattcattttatatcagtccgcatatataaatgcaatgccttgtgggcttacatcaccctaacattccttatcttgaggttttgtctcagcattgcatctaacttatattgagcttctttctattcttttttcttccttcccttctccctccttccccccgtcttgtctctctctctctctctttttctttcttctatttttgtatatatcatgagtgtgcagaaaggaacaccatcagatatgacttggtgtctgtaggttggggacatagcgagttcagaatacttttatataatatgaccctaggctaatgctcttgtcaaaatgtgctactcttggtatgagatgcataataaactgggattcattatttcactgaaccagcatctttgtaccctaaagggtctttggtgtgaccagactgttgtttaatctttgtgtcaggaccttctcttcctggcaaagagctgtatgagccatcatgtgttaaatgccttgtgatggggaggggtttgtttggagtttcttgccagctggatgcattgcaggtgtagacagctgtaatatggaggtgtgaccctgagatactgaaaagctgtttggtttgttatagcaactgcgtgagttgatagctgaacacaagcctcatatagataagatgaacaaaactgggccacagttactggaattgagccctggggaaggcttttctatccaagagaagtatgtggcagccgacaccctttacagtcaaattaaagaagatgtcaaaaagcgtgctgtggcactggatgaagccatttctcaatcaactcaggtaattgtttacactagatatagaattgggttcttgcagacaacagagcacagaaagacattttcctggatttcctgattaaattttaactaaaattatttcaccacattcactcttgagtattgatgtctgtgtccctcagaggtgatgtttgcttgcatccagcctttatctccttatctttctctgcctgcttatagatataatacaaataattttcaatgacttaagaaacgtgcagttgtcatcattgtctgaatatttaattcagtgtccatcctgagtagaatgtaatatttgccattgggggagataaaggaaagtgttataattattaataaagtactctcaagaaggcaatgagaagaaagaatgataggctaaatgaaaagaaaaagaatataaagttggatattgatggttttttcttttctgaaaatatcttttttcaagaagttgaattttgaaatacccaaagattttccattttcaagatttggttttcattattagatatggcacattagagtgggccagtgtcacaatcctgtgtgattattcctttaactttgagatagtatagaacaaagttcattcatagatgtgaatgaacaagtttttatagctttgcttaattgtctatggaacctttacaaataaaaattttacattctctcatgtgtctgattatgtgtttaaccatgaagtaaataaaaacttctgacacttgtaacttctgttatatcagaagttacaacattggggaggttttttgttaaaattttttttaacatttttcaattcaggaaatgcataacttaaggattccctggaatctaatcaaaacttcccatgaatttcacattaaataatataacttttcaggatgccataatagttcattaaaaatgaagtaaacaatccattgtaatagacaaatactcagcttattgaacttgatttttaaaattaatttgaattatgataacaggatgaagcagcaggtaaagagacattgctgccatgtcgtcctggtccaattacatattaatatataccatttcttaatggatacactcaaatattcataagaaactaagtctattgtacataggtagtgtgacagaggtgcatatacttcatgattttaggcatgtcttcacacaccaggtggatgtaacttttgaatgggtctgttgataaagaggctaagatttattcttaattctgacattaaattgtaaaaaatgttttttcatttaaatttcacacttggtattacagatcttttttccataaaagatctctttgttttgcccctagttccatgacaagatagatcagatccttgagagcctggaacgcatcgtggaacgtctgaggcagccaccctctatctctgcagaggttgagaagatcaaggaacagatcagtgaaaataagaatgtgtcagtagacatggaaaagctacagccgttgtatgaaactcttaaacagaggggagaggaaatgattgctagatctggggggactgataaagacatatctgccaaaggtaatacttttggaatagggaaacaaattttaaagcattctaaatgtttatgcggtttactcaccgtccaattggataacaaaatgccgcatcttaaaaaagatactacaaatgtgatgtgtttagggttgaagggctgtgtatgcaaatcccttgttaatgtcttcctgtgtttgtgaaattatttggttgaatacaaagcgtgccattatacatagaccatgtataaagaccatatgttcaaagaccatgtgtattcaggccttttaaatcagtaggttgaagcatattgctaataaggccatatctggggttttttcctcattactgactctgctaccttacatagcatggatcctgcatcacatagccacaaaaatgggaaccactaccacagccagccatctttgagatacgagctgagggtcaaaagggagagcatgtgcgtagtggaaattcacaatgagagtactctagaagcaagcccaaagtacataccatacattgttacattcctgggactgaacggacaattttactcttgatttggggagcataaaagtgtacctaggtgattatttcactccctttgggattaaggatagccttaatgaacttgaaacttgataaacttggttctactctgagctcacttttgtcaggaagaaccttggtttggcaagaatagcagacccagagatattatgttatttggcatagactcttggacccactgatatccactggactggggtcattcaaaacttggtccagttttagatacttagcaaattggatcactactttctgtgtgaactataacattctgctttgttggttacgtggggctaaccagtcgccttgtggatattgttttgcttcatagctgttcaggataagcttgaccaaatggttttcatttgggagaacatacacacactggtggaagagagggaagccaaactactggatgtgatggagctagcagaaaagttctggtgtgatcacatgtcattgatagttaccattaaagatactcaagatttcatccgggacctggaagatcctggaattgatccttcagtagtaaaacaacagcaagaagcagcagaggtaagcagaaaatctcatttaaagttagaaaaataagttgtggcataatgaaatccagattccttgggtaaatgttaggagttactctgttaacatttatatttggttctgaaaatggaatgtgcagtgatacagtaggagatagagtatacccacaaatttcactttgagattgtatgtttaaaacaatttctcaggcctgcgtggtggctcatgcctgtattcccagaactttgggaggccgaggtgggcggatcacttgaggccaggagtttgagaccagcttggccaacatgacgaaaccctgtctctactaaaagtacaaaaattagttaagcgtggtggtacacacctgtagtaccagctagttcgagggtgaagcatgagaatcacttgaacctgggaggtggaggttacagtcagccaagatcgtgccactatactctaacctgggcgacagagtgagcccctgtctcagaagacaaacaaaaacacaaaacaacaacaacaaaaaatttctctttatcctcactgtttttgccttatttcagggccttattatctctctctttctttttggcttccaaagtaatccaaagtgcagactgtcttttccttgctaggcctctgaccttgctgccagtcttctctctagatctgctcttactgtgttgctgcctaaaccccgtcagaggcatcccctgccatctggatcaagcccaaactccctagagcagggcatgcagctttttgcatgccagcctagctcatgcctatgtttccaaagttatgtttttctcttgctcctttaccaaactccctccctgctactgattagaaagggcgtttcccaaaacaaactgttttgctctttctagcgtcagtgcctttgcgcatcttatttcctcactctagaatgtccttcctgccactctactggcaaagtccactcagggttcagttggatcattacccccatgtaaaaccttttcttgtatacttagcagagttagtgcatctgtgttcccgtaatactttattcatgcaaaggactctgcacatagtatggtttactgttgcttatgcctctgtctttcctgctgtagtgtgggccccttgaggggaatagccatatctatttttctttgtatccccagtgcctggtttagggcttggtttatggttattcagtgtttgttgaatgaatgaatgtatttaaccaagaagatgaaagcaaaagtaggatactgcctttctgttgtggtatctttgtaccttacaggtcctacctggtcctgcctagggtaatgacataaaatgtaaatccaaagctagattattctaaatctactaacaaatatattaatttgtattgtttttggatttatattttacttgtctatgttaaatgtatattggtttggaaaccaaaatgtctttctaagccttacagtattgttgatatttttaaaaatttgttttggtatttgttaaggtatttcttatttatcatttcttaaatatctttataataaacatttgacatttgttactaaaagggtgctgtttttcttttaaaatatttcttgttgaaaaaatttattgcagaaacttagaaaacagaaaaatgattagaatgccaccttctagaaataactaccattgatattgttgtgtactttttaaagttttgatgtggttttgcttaaaattctaaggctgtcattttcttattctagaccataagggaagaaatagatggactacaggaggagctggatatagttattaacctaggttctgaactcattgcggcatgtggggagcctgataaacccattgtcaagaagagtatagatgaggtacaactggcttacttatcagaatggcttttaaaaagtttttagttaactaaaatattttgttaacagtagttgaaagtttaaaatatggcactaaaagaattctaacatacatcttgtagttaaattcagcatgggattctctaaataaagcttggaaagaccggattgacaaacttgaggaggcaatgcaggctgccgttcagtaccaggatggactgcaggtaaggggattacagtgtatgtgctggtcttagctggaaggaggaatcgtactaattgatgtctacatattggcaccacctcaagatctgccagtgcatatgcaattgtgggcaaattattcctgcagttgcctgtgtatctcatttcatgttttgtcttttagaagatatttctgacctttcagatatgtgtagatttatatacacatctaaacacatttctgtatacacattcagtgaaatttactttgaaaagaaatattttgattttttttaagtgaaagtaaatgttctcacacagtgttttttataaatggctcagcaccagacagtgaaatggaactaaatgtgaattctgttctgagtggaataagatgaaaggagtaaacactatctaaaaatatcaccaagtttaactaaagtcagaagtaaagaaatttgatttgaagccagtgttctccatgtacaaaaatagatttctattaggtcataatctggtgtgtaaaaagtgttttcttcttttccatgtatataatttcttttaatagttgtttttcacttaagggttttcattcagttcattaaccatttataaggtttttttttaatattaaaaattatcttgtcagttgaggccaactcgggtatatttctctccctacctcccttaaccttgctccgtttcctaacagactggcaggagtttaatctttcatccttcttaccatatggaaaaagcttaagtatttccataacactaagtgaatattatttttaaagcccagatgagaacatcttttccttttttattatgccattccatttctatatttgtaaaaataaatgtcacagctaggctttatgccagctgagaagttttttgaactttggaaatatatgaaagattttactacaaataacactttattatattctccctccctcttctttttttttttttcttttgtaacctaagtgataatttactctattaggtatcaatgacaagtaactaattcgggctccagtctgtgaggctaggtcattgttaaatcattgagttgtaatctcttccatggctagaggtggcaatgccaccacatgcagccatttaggaggtcacacgcaagccaccatggcttgtatagtctctttatcactaccagaaaagtaaggcctgtcataagtcctgttgatcatgtattagtagcatcacctgtgctagcaaagggcagattgatttattaagtagctacagtacagctagctgtagctagatgtcaaagctctggatgctaattttcaagatttgattgtaaagtaaaatacgttttatttcccaggttgctgcttaagtacttagtcagggttggctaatgataacttaaaaatccaagatttatcgccctactatatggtttgtaaacttcattaaagtgcaaaatatcccagtgctttgggaggctgaggtgggaggatcacttgaggccaggagttcaagatcagcctgggaaacatagcaagatcctgtcaaaacaagagctgaagtaccccatctacaatttttttttctttttttattagccagccatggtggcatgtgcctatagtctgagctacttggaaggctgaggtaggaggattgcttgagcccaggagtttgaggttacagtgagctatttgattgtgccactgcactccagcttgggtgacagagtaatggcaaaatgattttattttgtattcagtacctaaaaaaaatgtgacttgagcctttttagactatttttattacctaaataaataagaaatgcaggagagtctgaaacctgttataattcagaataatggtcttaatgctaataatttatatgtgcaggatcttaatgctaatctaaataatatgtaagggtttgagtcaaatattttgcctaagttctaaacagtaatttcttgcttatttgaatgaacaaatagatttgaatcttttcctttcagtatatttatacaagctgccttttaagcacatgtaatgaagaattccatgtgattggattctataaatgttttcaaatgatttttttagaagttcataatatatcaagaatctattgaataaacaatttcttttgcaaacttgtatgtatctatttcatatttgggacaaccattttggtatattactgcttttactaatttaggtgaaccatgttaattttttataaaatagtctaattctataatatcttttagatttatgattgtatttttctgtagtacttgaaatactgtagcaatttcaaatgtactgttgtaacaacacgtgggcgaatgtgtctttcaggcggtatttgactgggtagatattgcaggtggtaaattagcttcaatgtctccaattggaacagatctcgaaactgtcaagcagcagattgaagagctaaaggtatgtgtgggggctaatttatcgaagactcccttgcagttttaagtccttgattcacataattttgtacataaatttattttacctaatgtaagtatgacagcttaattataaagctagtttaatgtacatagtgctttcacatgctaagcaatatataagtgttctttaaataaaggaaagaaatactattaatagttttctttttatagtcaattaataactgttcgtatagaaaaatcagaaaatgcaaataaaaaggagaaaaacaaattatttcaagtcacccaaaatgttatatacctagagatcacctttcttagatttgatttatagcctttctgatatcttcatgttagggacatggggtgtgtgtgtgtgtgtgtgtgtgtgtgtgtgtgtatgtataggtagagagagagatgtatttagataatagtgtaaggatttttataacttgtttaacttgtttattcagtagtatattgttgtcactacactagtatgttgtcaatacactacagcatcatttttcttttcctgatatttttaattttaatttttaattttcgtgggtacattgtaggggtatatatctatgggttacatgacatattttgatacaggcatgaaatatataataactacatcagggaaaatggaggtacccatcacctcaagcatttatcctttgtgttgcaaataatccaattatactcttttagttatttttaattgtacaaaaattatttttgactatagtgaccttggtgtgctagcaaatacagggtcttattcattctttctatttttttatacccattaacccaacatttttattttctttagaatgttctgagtaattaatttagtctcaacaggttaaaaacacatccatgatataagaatgtttcccaaaaggtttgttttgtaaatgtttgttgttttccattgctgttctctgtagtttttgcttttgtaattcttgatctgcagatgtgaaagtggctgaactgtttcctctttgaattcctctataccaataatcatttatcaaaatgggatcagctatttccttcccaattttaactctccatatgcagagacatcacactgtttgcaatgaactttgctagattttatgtgaaaatattatctggctttaaaattgtagcattttcatatctaagtgtgacatagaatatttcatttagaaacaaattttctttttgagaattttatccttaccactaaattgaaattttgtttaactttaatttgttcatgtggcaaacatatgatatactttatgtacaattatgggtgtggataatttattttggttattttcgtataggtcagtgatttttatatagcagcctggttagaagtgctcactctgaaatcaggttatctgagtttaggtccaggttcacccacttagggcatatggcctcagtggtcttactggtcttactaactggttttactcctatgtctttagcttacattaaggataaaattatttccccaataagtgggttgaaagtaacttgaacataccaagtgcttactatacctttgttattattttcaaattattattcatgtatttttgaacaaagttaagggacttctagccatgaattttgtactgttacatattaaaataaatattttatgaaaggacagttacctattacaagcaactgtttgctaacctgttggttggcaaagccaagatgattaactatgtcagtgacttagaaagtagaaggagagagaatagcattctgtgtcagcagtgggtgaggcataggaatattaatgaacacagcacagctacagaaaacataaaattatcaggggatacaagatgtgtgtgtgtttcagagcaggaaatactaatttgagtttcttaagacttttttggctttcatatgtgtcaacatatgtttcattttcttttgtataattttaaaactcatttttcaaatgcatatattggaataagttcagccttgaaatttatttttttattgtagagaacaaaatgaaatgaaatgtcaaaattataaatagaaacatctatccatccaaaaatattgaataaagagaaaatattttccttattttttttgcctataattcttccattggtaagcctcatgtgagatttttactttgcgtcacctcccctcagtaagtagtgtgaattagaataatgatataaccaatagatttctttgtttggagttagtgatttttaacaatattttctttgtatatctcttttaaaatagcaatttaagtctgaggcctatcaacagcagatagaaatggaaagactgaatcatcaagcagagcttttgctaaagaaagtaacagaagagagtgacaaacacactgttcaagacccattaatggaactgaaattgatatgggatagcctggaggagagaatcatcaacagacaggtaaataccaagacttttcttaagaaattataaattttcaatttcagatattaatgtaaaataattattaaagataaaattagaattatttctgcttctcatatattctattttaaccatgaggagcgtcaaacttaaaacatagaaggatatgatgattaggcttcactggatacgtttatggacttatacaacatgaaacaattatttttgtccttgttttatagacatgtcattcataatatcaaatttataaatggattttctttccactttttctgtagcataaactggagggtgctctattagccttgggtcagttccaacatgccctggatgagctcctggcatggctgacacacaccgagggcttgctaagtgagcagaaacctgttggaggagaccctaaagccattgaaattgaacttgccaagcatcatgtacgtagctgttaatgcatgttatgtttcttctctgtccatttctagtgtcatcagatttcttggatatatttcttctttatgcgtgtttcaagtttatgattttgacacaagttcatatttgacatttataactaaaggttaactacttaaaacattatagtcaaaatgtttttcttaaaagattatggtcaaaatatttttctcattcaaggcaatttttatcaaacaaaacaaggatgagcaatttgtactaaagtttattagagctgcatggcaaacactaaagatttaaatccttaattatacctgtcattgtgataatgtcacctattttttaaagttgttagggatagcctaaaaaatcataggctgaaaatgtcctactgcaggttttatgtatattttcactctggtcatccatatttccatgtctctttcatttgcagcttgtttgtcatttctgacatatttttatctgtctgtacatctcttcttatgttggggcttatccctttgtctccatgtcactcttgtctttgactggatttttgtgtcttactcctttctggattttttaaagtatttattacgttttaaaaagttgttatatgtcctgcacttgatttaaagctagtaagttgaaaaaattttgtcttaagagatatatgcaaagcaatcttatattgttgtcacctttgtgacacttcttaatagatcattccctatcccttcagtcactagacttaatggataaaagattatgcacagtagagtttatcctggcattcaacaatctttcatagactttgacattcacattaatagtgatatcttcagagtcctaaatcctaaactaaaataaattttccttaactatcaaataggaaatgtttgattattttacatattgattcacattttttaaaaaggtaggtttttagcactgtatgctgtacagtttttgactattcttgcttttgttcttcttctttcatagttccccacagtaattgtttcctagtttaaaattttatttttctattaccttgtctatctacattgatagtcattgcccagccacatttgattaaacaatttggatttattttgcacacttaatgttgacatagaagcttgtttcattatttaatgtctacattatacatttgcttaaagccctaatgactggtgagaccaactgcctagcaacaaaatatgtttattctcatggtgtgagtttatagctgcatttacatttttataaacctatcaactgtcttaaaggtaacatacatcaggataggaactttgtataatatggtagaggtggaaaaatgaggcaccctgatccagttattttggtgggggataggtaaagacctcttacttctgtttgtctaattttaagtactttgaaatggccccttttctcttctctcttttctttccattcctcaaagatcaaaattagaggacataaaattcccagcagaattgctggaggaaggggcgaatgtttccgttcctttcctgctttcttctcctactcctaagctctgactttgtagcaggactcagaccattcagaagaatgaattttatagaactctcttttatattttggccatgaaaacatttaactttttgattctgagagtgatcctactcttaacataccaaagtgagtgctttctataaagataacttcttactcagttggttttgttggcttttaaaaacactccctaaccagatgcctcagaatatgagtgaaaacagtcagagaaacagtgatgtcagagggttactgatcttcactgaaaatccaccctggtctgaatttctttccagatgtgtgatgtgttacataggatgggagataatgttctttttctttactattgccaacactgagtcaatgagtaaagagtaggatcaacttttaccaacattagagggaggtttcttctgctttccaaaaatgtaagcatagcctccttgaaaggaaactattaatattactaaggctatactcattcagtaaaagaaattgatatttttaaaccttagggttgctttctgcacttaccccattttagtgcatttaagcgttattaacctattcatatatttccactgtataaaaggaaggcattatttgctgggttctgtagtaagctttttattatatatgttttctacttgaagaacaactgaattttggaatactgggtttaagtatctctgacatagagtgttagttttagggccttccaatatttcaacttagcagtcaattccaggacccctcgtatgagagaagataaaggaatattctggaattttttttctctttcagaatgctgattgtaaaatatggtactgtatgccttagacatgataattttatatttgaaaatgaatatataggagtaaaatatatattttggttacttgacatgagaattaaactaaaattggcttgaaccaagtgagaaattttagaaccttttaattataatctctagatatttagtgtcatcaattgcaaggtcattccagtgggaataactagcaaactgttctcacacagtcatttcaggggacattgatagagtaaaggtacatccaggaaggttgcaaatttaggggaaaagaagttcatcatttaaaaacttaatattagccagcctgggcaacatagtgagactacatctgtataaaaaataaaacaaaattagccaaccatggcagtgtgtgcctgtagtcccagctatttgagaggctgaaatgggacgattgcttgagcccaggtgttgaggttgcagtgagctctaatagaaccactacactgcagcctgggccacagagtaagaccccatctctttaaaaaaaattaaaattctacacatataacgtttttgtttgaggatgtttcataaccagaaaggaaaacaattgcattaaagatgatattaacatgttacaaactagcaaacatggtgttatctttatattttcaggtgctccaaaatgatgtattagcccatcagtccacagtggaagccgttaataaagcaggaaatgatctaattgaatcaagtgcaggagaagaagcaagcaaccttcagaacaagctagaggttttaaatcaacgctggcaaaatgttttggaaaaaacagaacaaaggaagcagcagctggatggtgccttgcgccaggtgagtaagagaataaattctgaaagtttttatagcattcaagaccaaaatagcatggaattcttttattagttcacagactcctgtttaatttttataccttaaggagaggagtaaaaataagtgaaataaagaacagaacagcagaagagaacacagctttctagttcttagcataatactcttatctactagagctctcctgatgaagaaaggcaaatctaatggtacctggctgttcttaagaatgcatagagaggcttagcaggctgggattgtttgaagcttatttcctgcttgaaactgacagtgtttatggccccaacttaaaactgcctattacttcaggccaaagggttccatggcgaaattgaggatttgcagcagtggctgactgacacggagcgtcatctgttggcatctaaaccgctgggaggtttaccggaaacagccaaggagcagcttaatgtccatatggtaagcaaagtatttcctacagctttagcctcagaataacaaactgaccatgttatatgggccctggcgatacataaatcgtgggagaaggctttaaagatatagtttatggcagaaatcactgtgtatacatgttagaaacacaccatttattgattaaaattttaaagtcagaacccattctttatttctttctttttttaattttattattattatactttaagttttagggtacatgtgcacaatgtgcaggttagttacatatgtatacatgtgccatgctggtgtcctgcacccattaactcgtcatttagcattaggtgtatctcctaatgctatctgtcccccctcccctgaccccacaacagtccccagagtgtgatgttccccttcctgtgtccatgtgttctcattgttcagttcccacctatgagtgagaatatgcagtgtttgggtttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaacagtgccacaaaggttagtgtgtcagtatgttttagaattctagacactttttagacacaaaccttcccccacaaaataagcctgtatgggtggtggtaatataacacagtgtaaattattaaattattgtgccttgaagtgtaaagaaaaacctccaaaataatcagaatgacttaaaattattgttataagcatgattgtctcatttggtttcatggaaggttagaaaatatactcttgttccgttaaaaaaaaaaaacttccttgtttgttttaatggtgatagagctttatcttcaacttcatacttacaccaaatacagacacaaagaggaggcttctgtttaactgtccagtctggagtgttgtacctgtgcgctgttcctacctagatcatgtgacacagttggctcctaagaaagatgaggaaaaaatgatgagacttgaaatgtgggctttctttcatagaaatggggactgtgaaattaaatttaggctactttggatttattgacattttaaattcatattccattgtaattcagcactagaagttctgagaggaaacagtgtttcagattttgaaagagtcccctaattttttacttttgtgaatttacatcagaaattttttaaaatattcaaatactgatgattattatcttgggagataaaagtagaagtacttagaaatttggcaaaagaaatagatcagtgtacatcaatatctacactctttaatagagatataatgttgttgtaagatcttaataaaactgctcttatttggaaataattttgaatttagtgatttgaggagggcgtaaccatcatgtagatgttgtaaagaaataaaacagattatgacagtaggtagcatcatatttatttcacaatcaccatcagtagtttaagtaagtcctactaattcggtgtagaattttctagaaatctttatggtatacttattgttttagaaagttatgtatgtggtttttgttgttgtcgttattggtttttagtgccacaggagacctatttgtttcactggaaaagtaatagactaaacttgtaagtgcttatcttcctttttgaaaaaaaacctgagaaacttccagatagctccttactttcctggaaagtacttgcacagctttgacagtgtccattaattataagtttaatgaactcatgaacagatagatgcttgggattattttctaataatataaatatttttaaaatgttaacttagaagaatataagaacttgaaagcaaagaacctacctttaagaatactttacttttagaaaatattccatttcagcgaactgagtttgggcggggtatttaaaatgaatcttttgtaaccctatataataaatcatagaaatctgtttaaataagtttaaatttgtgatttaaagcattctaaagagttgttgatatttgtaatatcatttcaataaagttcttttgattttgttgtgctagaaatgaagaaaagtacaaaacttacaatattagtttcctgagtttttagctatatctgaaagttttgctttaggatttaaagcttttagtagatgatattgtaaatatatttatatagggctttttttaaagcttaagaaataaatttttgaggtgatgaaaatgttctggagttagtggtgattacaaaaccttgtgaatataattttaaaaacactgaattgtatacttataatagtgtattttatattatatgagttatattgcaagttttaaaacgtataaagttgaaaatgtgagacataaaatatataatctttcagtgagaactatgatttaacccacattatagttgaataaataaaatagaactagtcttaattttttaaatgagaagtaactgttgttttgttggtcttaaactttgaatttgtttaagcaatattttatgtcctgtatagaagatacatacaacattctagttagaagctttagaaatgttctaaatgagaataatattcatagtaccacaagtttgattcttataattctgaataatcaacttaaatatattactgtgctggttatttactttctatccattgcatgttttctgagtgcagaattaaatcgtaccaatgaaatactacattcattgtatcatagtacaaggagggatctacgagagcctctcattttacagaggaaggaattgaggctcagagagatgaaattacttgcccaaactcacagaactaattagttactgtacagtgaaagctttcttgacagcatttaaactgttgcttcaaatcttagcatgccagaatgggctgataatgataacaccattttttagatttcccagtagacagggtatgactgtaggtttaattgttgtttcaatgtagtgaaaagtataaatgcgtcaaggttgccctgagagagcaaacagagatgaatatatgatgaggagcttgggactgatgacctagaaaaatagaactcttaaattttactttcttaaagtgatataacttgagggtatctcaatttaggaagtctgtgctgcctttgaagctaaagaagaaacatataagagtctgatgcagaaaggccagcagatgcttgcaagatgcccaaaatctgcagagacaaatattgaccaagacataaataacttgaaagaaaaatgggaatcggtggaaaccaaactcaatgaaaggaaagtatgtgctttgattaatataatagaatcagtgttttagttgtttcatgtcttggacttggccttatttctgagtagagctatcaggagtagaactttcaatgatttatgtttaaacattttttgtatatatttggagatttcatggggtagttgaaaataatattctgttttaacatgagaacatatttaaaggggtgggatatattcaaaaatagataaatatatagatcaaatgttacttagttatatttttaaatgttaagaactactcaaattctgggtcattaaataattaattctattttaatctaattaaacaaaagactatatatatgggtgagggagagagggaaagcaagagagtgagatgattgtgtatattcttttaagtacttacatttaaaaattcatgagaatggattaaaatgtatattaaattatgaatatgtctttgttacttttttaaaaccgcaaaactgacaatctaagaaatctcaatattgcatgaaaaaaacaataggcaagaaatacaagattatatgccatcactgatggagcataaagtatgtatttcataatattttgagtccccaaattaattgtatgaatgtcaacttttctttttacagattatatttagtaattgtgttctttggttaatttccaaaaaacatgctttagcgtatattaatttttttttagttacagtgagatgctgcttactaggcttaaagggttttggtttgccagtattttagtgaggcccattacatttataagatatttagttaatatattaatagatatgcataaataaagtggggataggaaaggaatctgccagagaatatttaaactgaaacaaacaaaataaccaaggcccttaaacatcacatactaaacaatctgtccttgcagactaaactggaagaggctctcaacttggcaatggagttccacaattctctccaagacttcatcaactggcttactcaggctgaacagaccctaaatgtagcttctcggccaagtctcatcttggacacagtcttatttcaaattgacgaacacaaggtatgtagtgagtcaaatagataggattctcttttcagacaccaggcttttttttttttttttgagactgagtctcactcctctgtcgtccaggactgtggtggtgtgatcttggcttacttcaacctctgcctcccggttcaagcgattcttgtgcctcagcctccccacaggtagctaggattataggtgcccaccagcatgcctggctaatttttgtatttttagtagagatggggtttcagcatgtttgccaggctagtcttgaactcctgacctcaagtgatccacccacctcagcctccaaaagtgctgatcacaggcgtgagccactgcacccggctgacagcaggcctttttaaagtcaaaagcatgcatttggtatttcgaaagctttcgtttgtcctttaaaataatttcaggtttatgacaccagaagcatttttaagattgatctgattttcatttgtttctacttatttcctttttttctgggaaaggtttttgccaatgaagtaaattctcatcgtgagcagataatagagctggacaaaactggaacccacctaaaatattttagtcagaaacaagatgttgttctaatcaagaatctacttatcagtgtacaaagtcgatgggaaaaagtggttcaacggttggtagagagaggaagatctttggatgatgcaaggaagagagccaagcaggtaataaccctttagaaaaattctctgaacttgtcaataaaccacttcttgctgttgaaatatatgttatggatgtacttttatcacaggctgtattaggcataacaatcatggcatggtgccatggtggttctttcctaaaagggctgtggcctcagtttggatgctgacatcactttttgacctggcagcaatttcagcccctggggactaatcttaagaagactgattatagcttgacttcatagacaggctattatcattgaggcccagaaagaagctcagaatttttttttattgggtttgttttctttttctttgtccttttgacctctgttctcataatcagagtgagacatcatacttcattgtattgctaccttttgtttagttcctaagccagactttcttcacaagctatcagtgctgagagccagacatgtagccctcccgacagctttctgaaggggcatattctctgtctgagttggtcggcactccccacctctttgaacacttgttgacagaccttcatttcttctctaatattttgagcagataatagagctccatctcactttgaaattaatttttttgaatcttttggggccactttaaaattttaatctagagattttcacaaatttcacagagaactctcctctccttactccctttacctgttgttaacattccattctagactaaacacaaagaggtaaagttatgcatctctgtgtgtctttgtactccatggaagagagaggtgtacctacctcgcttgacaaatatatatatttttaaacatttgatttttactagaaatttagtgtaatattgtaggaggattttacaattactttttgcctcagtcagctgcaattttctagccttagtgttgtaccccattgttttgaggagttaagctcagttgggtgatgcaaaaagatgtcacgggagtcaggtgtttcaatgtttaatgctaacagtacaaatgtttgaaggcttgagaaatgacaaattgcattgttatagcattacacaccatagaccccattttgaatgggaggtgtgaaatgttcagtgttacaaatgagtcactgggatatactccatctctaatgtttctttaagacagtattaattctcagcctgacagttttctctccacattatgtggtgcaataacatgtgtagtgccggcatttcttgagttatgaacatcagtttataaatgtttcttggatatcagtagccagttgctcatctttttcctcctttctcgatttaatcaattttattttctcattttgtctaattaactttataaatatttgctactgtttttagtgcaaatgtatagcatttcctctatttatatggcttaaaaatagttttgaaagcagaaccagcctcagaacttgtgcgtttgtatcattgaccttaccatccaactgttatagcctgtattatttggagtcaaactacctaacaccttgactagctgtttctactatttatttcttcttcttctaatatctcagtttttggctcagatattgatcatacttctctgactttcacaattcatgtgtctattctagtttccatttttccatgttttaattgattaaagttgtgagagggatatgaaggtttgtaatgagatgatctccagagagcccttacagttttgtgagtctgtgtccttactctgctcttattgttaaatatcttgttgttatttcattattcatgtgctttggtatacaatagatttaattttgattactaaattttttgttaggtatctgttcacttaagcttattgtgacaaataatttataaccaatttcacaattgtatcagaaaatagtacctgctggttcttgatgacaaaccgaaaagaaactgtgctcaaaatcaaatatatatagtaccagaatgtttgcaaggttatagatgccaaagagaataacattgtgttagaacccaaatattgtggctgctcagtcatataaaaccaatatgtgaggcacaggcattgatttgaggatattgatagcagcaataaagatgttgaactatctttgcattaaataggaatgcaatggcctcttttttgtttttgctactttaaaaaatcaatttacaagctttatacttacccctccccatttttgttcctctttcttaacatagggattaaattccctagaagtaaacccagatctgtcaacagacagcagtaaacaacagcaacaacaaaaatacaaaacattttctgagagtttatgttaattattgaacaagaagaaagtataaggaagaagttctttctgtagcttcctaacttttttctaggctcttttagagctgatatgttgaatgaattaaaacaaagtgacagtggggcacagccacaaatgctaagcattatcaagactttttttgtaatttgctgatgaaagcattacttttttcttcttcagtggaaattttgaaataataattttcaggattttcatcactattaatctctgtcttaaaactgtgctagatctcaagtataatatgcttgaaaaattttcagacaaaggtgtgaatttctttctagttccatgaagcttggagtaaacttatggagtggctagaagagtcagaaaagtctttggattctgaactggaaatcgcaaatgatccagacaaaataaaaacacaacttgcacaacataaggtgggtccataattaagaagagcatattgtctcattatatagttcaagatcactttaaaatccttacttcatcacgtgtttattcatcactaaagaaaaaatgtaggtccagtgtgaacctgtattaaatttaaaagctattgctcttcatgttgcttatgttgcaatatcttcactcttcagtgaccatttcactaatgattcccaggttaattgttaaaaagaaaaacatacaaaataaaaatggaaatcctctacaatctaaaacatataaaggatttgtagtggttttaaacattggcatttcagtttttcatgatagctgtcttttcctgtactttctttgacagacaaaatagcaccttgaaggtaattctgtagtaaaaagtaatagatattttgcggtatggattcttttaaacaatagagtgagaaaaattggatgcttgtacctaaattgtaaattaatattttattgtgtttgtgcacgtataaaattccacccaacctcaaaggtacccaaagacatgtttatatagactagaaaagcatgtagaaacattgttttttaaatattttctaccttttctatgcctatcatattttatatcttccacatgacattcaaagagcattccctcccaccctccccagctcttttgaatttggatttttatgtaattctatttataaagttgaccccaccagccatcaggatgaggatgtgggtaaaaggagagtgattcttgcaaagggttttacaattttaggcacgtacatataaattatcgcttgaaacataatttttaaaggctggaaaaattggggtgatataaaatttgtcatcatcaggaggaaatcctggccatcatcttcacataggttggctgcttgcatcagtgggtctaaccttaggaggtcatgattagagggatgggaggaaacatattgagcatctgttccctggccagatgagggctaatgaatggcttgctctgctggcaccctttgcctgtgagctgccacattcaatattgggagcacagtgacagtgaacagcaccttccttccttcccctctgatggcgaaatgagagcttccttctcaaaacagaatgctttatttgaacttgaatgtggatgttgtatcgtgtagtcttatgaaagtatattacatattaaagttagagagtcctataaataagaatatctacctttttaaagtctctatttggcaacagtgacctgtattcaaccataacattttttgtatatctgctttgtgaagaaaatctctgtcaataccatgattctataacactggcattctgtttagcataatatgaaaaaaaatttatggataactgtagaaataatgtgattgtaattgtgttgtctattacttagaaatttccagatgtagttgcctattacccatgacaaattaaataatttagtcatattaaaacactttaaagtatgtagcttttaaaggccgtaaaaacttcttaggtaattataaccttgagattattttagaaaagtgtacatttgcatagcattttactatctagggtaattttaatttgctacaaggattgagaatcactgtattaatgtttccattatattttgtgagtttgtaagcttcccattaagttgacctttctttgttctcattcctgctattgtatattcagtaacagttatctcattctttctactcttcctattgaatatttataaacatctactaggtgtaagatgataatgagaggcctacaaagacaatgtccctgctctataaaagcttatgattgagttgtgtagaaagactatacagatgctcctcaacttacgatgggtttttatccccataaaccctctgtaagttgaaaatacggtaaataaaaaatgcatttaatacacctaacattagcttacaataggacaagatcatctaacccaaaacctgtttctataataaagtgttgaatatcttaggtactttattgaataggtgactgaagtatggtttctactgaatccctatggctttcgtaccatggtaaagtcaaaaaatcctaagtcaagtcattataagtcagaaagcatctataattcatctccatttattagggatgcctctgttaatgcctcttacctgtttattagtcccaagaagaaattcgcatttttttcttgttaaatatttaggagtttcagaaatcactcggagccaagcattctgtctacgacaccaccaacaggactggacgttctctgaaggagaaaacctccctggctgatgacaacctgaaactggatgacatgctgagtgaactcagagacaaatgggataccatatgtggaaaatctgtggaaaggtaaaatgttctttaagacagtttggttactctgtagacctctttcaaatacacagtaatggtgctttgcggggacatttcgggaaccttaaatatttcctttgcctgaggaacttctgcttgtcctaagtatcccacacacatagcacttgcattgagaagtctttgctgttcattaatttttaactactcattacaataaaaagtgatatcattgtccaagcttctgccatctcagacttgactacacccactgcttctgactcgtcttcccatgtccacttttatcacttctttgacttaatttctacataactactggatagtcttttaaaaatgtaaatggaatcttgtcattcccctccttcacaccctttggtgacttactactgggcatgcattgaaacacaggcttcttaatgtgacgtgcaaggtaccactgatctggccccagcatttctttccaactccatctacccctttctgatctccctctttctcattacatttccatgaaaacccaagacatatttcaaaaattttaagtatttaattgagtacaatagtagtagagttcaaatatattgtacatgtttccaaattttcccgctgatccttaatcttaatgatttttgtcagtatcaagattaaatagattatattcagttctggggaactcacagtaagtttttgtcatgttagttttgaaaaaatcctttttttttttttttttttttttttgagacggagtctcgctctgtcacccaggctggagtgcagtggcgggatctcggctcactgcgagctctgcctcccgggttcacgccattctcctgcctcagcctcccaagcagctgggaccacaggcgtccgccactacgcccggctaattttttgtatttttagtagagacggggtttcaccgttttagccgggatggtctcgatctcctgacctcgtgatccgcccgcctcggcctcccaaagtgctgggattacaggcgtgagccactgcgcctggcccttgaaaaaatcttaaattcctcagccacagcatgttacataccttttccagtgttgtatgcatggttttatttacaagatttttgaaaagacaaaaaaataaagtcctgacaaacggatcaatgaatgctaggggtttgaaggcgggggcagggcgtgtctataaagagacagcacgaggaagatttttgggatggttgaactgttctggatcttgattgtggtgatgattacgtgaatctatacatgtgttaaaatgtatagaagtgtataccaaaaaatgtcaagtttactgcctgataatctaaaacaaaattttaaaaatatttaaacagtttaaaaggcttatttttatgaagaaacatgaagggtccatggtttccaaaggtgggaattttcctggaacagatgccatgtatttaaggaataagaaagaaagtttagaaaagttttgtctttttcctaagaagagcaaagaaacaacaatgaataccaacatactgctcttccccttgagtaccactcaaccttcatcaattaattttagatgttcagatatatgagtgacgttttttgttgcaaggatcaatttttctacctttttccctagacaaaacaaattggaggaagccctgttattttctggacaattcacagatgccctacaggctctcattgattggttatatagagttgaaccccagctggcagaagaccagcctgttcatggagacattgatttggtgatgaatctgatcgataatcacaaggtattgttatctgggacattttattttatcttgtttgattattctgagtgtacaggaaatgtaaaccatttaaattagccttttaaaatcagaagactatagatcatactacataacagtctttattgttgaaatatgtgtccgtttgagcagaacctggaagcaaactttaaaagtgatggggaagtattatttagtgtcagtgaaatacttttgcttttaattaccagatctaaaacctttttagaacttggaaagtgatttcattctctggtgctttaaaacagatttcaagaatgttttactatctttagttatgcacttaaacaattatgtaataaaatttaaaatcattcattcagtgacctgacactaagtcattgcataagtatgtagatttgtgacatgacccatggtggtcatgaccaactgcttttaaaaataccgaaccaaaactgttttaaccttgccccttgaattatagcagtttatgagtcagcagcttatgctataagggatttgattattatttacttcgagaaaactggcttccttgaaatctcctgatatgcatgtaaaactgtcatgtcatgtaaatcaaaggtaatattcaaggtgtccaactaagtgtaaggtccaaaataatgaccaaatgatataaagcaacttagccttggaaacaatatgaagcatagtactaatgtagaatagttgtattggagttgactttatataaaaatgtcttacatcactctacttaaattcatcttgtatttcttctctctagtatctgagttcagaaaacttattccatttataatgttctctttatattggttatgctattttgatcttaccattctttttaaaagtcttattacatatttatttttccttttttctttctattctatcattatacccataagagagtttgttacacctgaaaagtgaaacaaactaaattaaaataaaataaaagaataaataaagaacattggtcaagtctacaaaagttaaaaatttaaaaatcacatggctttgcttatattgaaataaatgttttgtgtatggttaatacaaacttctctatttcctggcatttattcaatgagtaatgaatagcgtaatgttactttttacataaatgccatttctgtaaactcactgtctaaatatttactactctaggtaattgccagatcttttatatattaaaggtcatcaagaatgaattaatcatttagcattagtaatacaactggaaggctcaagaagttcaagtatgtaaaaatgctttggaaagtcttctgaaaactattggactagtcctatcataaatgggatatttagatactgtaccatttgcatgtgtgcttgtgtgtgtgtgaatgtgtgtattggtgtatacgtgtgtgtttgtgtctttctgcaggcacatctcattttaactgttagagttgaatcagtcaaataatcacttttgtgataggctcacttttgtgaatgatctgagtatcagaatagaaacctatagatatggccaaatggtaatattcatttatgatgatttttttaaaaacacattaattttattgtgacagaatgttggttattaatgtttgaaagatctagttgcatacacagactcttggatcaaaaataaagagctctgggctcacttcttagatcagtctgtggccaaaataaatgaatttaattcctggcacatcagtttgtcaaaattaggcaggaaaaaaaaaaaaaaaaaaaaaaaaaaaaaagcaaacccagaagcttttcctctaaggtgaaagacaaggatttaagcctctaaaatttgacattatgagttagtacctaagatattatgaaagaccaaggagtgttataggaataaaagaccatctgccaacttcctatggaattccctgccattatctctaagacatccgtggtacacacatcaagattgcttagtcctctgttaggttcttagatacatctcttagagtagtgccaaagccagcatccacttgacattcacactagtgatttgagagaaattgggacaccatattaaagaatcattaagaaaaggaatttgttgcattgttttatgaaattgaaataatgaaggctggctgccattatttaaatccaatatgtcattttaaaataagataatcttatcttgttttctcatgagaatgtgacaggactgaacaaatttatacaagactcttcttgatggtgctcaaataggagcagtgtgtcatttatcttctgaagatgctgccagaaatatggttattaaactgtaggtcttagatatctttacatgatgttatgtgcacatatatatctcaaacagtatgtgttgctgttttggttttgtaattaaaattaatttttcaaaatatggtcttcttaggccttccaaaaagagttggggaagaggaccagcagtgtgcaggccctgaagcgctcagcccgagaactcatagaaggcagtcgggatgactcctcctgggtcaaggtccagatgcaggaattaagcacacgctgggagaccgtgtgtgcactttctatatcaaagcaaacacggttagaagcagccctgcgtcaggtaaaaaccatgtaaatgagagctgggtgtaatgggaaaagtattgaaacctcaacaagaactattctagtaaaaaattgtgaggccctcgtgtctcaatcaggacagtctgaagaaggaaattctaatagcaacattgccttgatccttctcccaccctccctcatgaatttaaattactgctagagggaggcattctaatcttcacatacaagtgctgcgtgagtaatgtctcagcttggaagtatgatggactgccattcatctaaaatcaagttgttaaagtggtaaatttttcttcatataggctttttttttaatatattaagtgttttcttgtaaaatatgtgtatctctatcttcttaatgggagtaatgaagcaattaaatttaaaactttttttttttcattgaagggatgaatccactatacagttttgtaaattgtgctaacaggcatatttgggaattttgtttggggtgtgtgtgtgtgtgaactcttaggcagaggaattccactcggtggtacatgccctcttggagtggctggctgaggcggagcaaaccctgcgtttccatggtgtcctcccagatgatgaggatgctctccggactctcattgatcagcataaagtgagtaatatataaatgctatgtaaagctaaattagaaaatcaaagcagggaaaatagactcgggattacaaatatcaactgcatgaatattttccttcctgagaaatacttaaacacctgatacatttgagagtgtacttctgtccacattgcttacatatgtatgtccccatgcacccacacacatgtatgtgtacctgtcttttgatgtttccttttcagggaaggtagttactctgtttcctatctcaaggaagcatattgatttatctaggctttttggcttttgaccaaaattggtcaagattgttgcagttatcatgtggatttcaaaaataaaacctctttaacgagcagtttggcatttataaaattatacccgtaggattgtaaattagtaattttgccctttgtaaacaagacacacaggtaatttaataactcatctttgaatctatttttaagcctctgctgcttctgtttttaatcaagagccttttaaatcctttttagaagaaacctatagtatacattaaaaactttaaaaatgaatttcataagccaatattctattgaataactaaccaagtctaaatctggctattgagttttcaaatcaagatctttcctgcggcaatgcatgaaacttgccaaaacccttcagagagtaatccaaatatctcttaacaaatgttttttaacctttgactcaaaaagtcaagaatttgaaatggtaacgctcaatgtagtgttgatgtcagcatttcctattaactttaaaggatcttttaaacaccagtaaataattttgtcttttgaagtcaggctggaaatacatcattaattctagtgtagcatggattacatcatgtgtggagacttgttatgttaattaacaccctctatcaaagatgggttgctgaatctatagcgatgaaatattgccatgtcatttaaaaagtggtacaagcttgcatagcattttctggaagaatgaaatgctatatattatatacaccgtttaaatttgaagctagaatataagaagaagacagttacatcaaatgtattataaatttttgagtcagttcaatattttgaaaatgtagtttatattatattactgtgggcttaccatcagccagcattgagttccattaacatacttaggtttgggtctcagagtagcaataaatatttgctggacaccacttaaagcccattgtgcatatctaacaccctacagaaaggagcctatttgtggtatcaccactctcacaccaggaccaggaaacctccagaaggcacgtatccagagcaggggtagtggtttttacaacaaattatttttaaatagcataaaattacctgtaattttataaaacatttcttaataatattttgcagtaacactattcattcttttccatctcctctgcttcccttcatacattcaccattcaccattcaaagaaaaacagaatatttaatttcttaacaccagaactggagacttcttagcatatccagtttctaaaaatggcaagctttcccacatgagaacaaaccagtaaggtaaggttcagactaggttggaagggcatagaattcagtggaatgttgacagtccagtccaccaaattctaggtataaccttggctcctctaggtgtagaagtgattgaaagtacattatttgtatcagctgttctccaggggaaacacagatgttagattaacctatttttttctcttccttataatgttggagttttaaatttttttcatttaggaggatcctgtattgggaaaatgataatttaagttatgatatttaaaaagtaggtgttatcagagtgtgctgtcaattgaacgttgactccattatagtaaacttgtaaataaaaggtctaaaaagcatttattcagtaaatcacaactcttttgaaccaactaccgggaacacaaaaatgaataaaacacagtcttttaatcttgtggaccgaacagtctaacatagcaaaatgccagagtaggaggtatgtcacagagctgcttcacagaggttaaagacaaaaggccacttaaattagaataaaacatataaacatatcatataaatttaaattcagagagtacatgtacacgtttgctatatgagtatattgagtaatagtagggactggacttgttttataccagtcatccaaatgttaaacacggtacccaataggtaatgtttcaactctcaggcccctgtgatcctccgtgctttttggagtcttcagtgtctattatttccatctttatgtccatgtgcgcccattgtttggctcccatttatacatgagaacgtgtgatatttgattttctgtttgagttacttcacttagggtaatgccttccagctctatgcatgttgctgcaaagtacatgatttcattcttttttatggctgcatagtattccatggtatatatgtaccacatttttttttaatccaatcaactgttgatggacacttatattggttctatgactttggtattgtgaatagtgctggaatgaacatatgagtgctgttgtctttttgatataatgatttcttttcctttgggtagataccgagtagtggaattgctgggtcaaatggtagttctaattttagttttttgaaatattttcatactgtttttcataggcatcgaactaatttatattcccaccaacagtgtataagcacgcccttttctcagcatccacatcatttgttgttttttcactttttagtaatagtcatcctgacttgtgtaatatgatatctcagggtggctttaatttgtgtatctctgataattagtgatgttgagcatttttcatgtgtttgttggctgcttgtatgcttgtatttcttcttttgagaaatgtctgttcatgtgtttttcccagttttcaatggagttgtttgttgttttcttgttgagttgtttgagttccttgcagattctggatattagtcttttttcagaggcatgatttgcaaatattttctcccattctgtaggttaactgtttactctgttgattctatcttttgttgtgcagaagcttttttatttaattaagtcccatttgtctatatttgtttttgtcacatttgcttttgggatctttgtcataaattctttgcctaggccgatgtccagaagagtttttttaggttttcttgtatagtaaaacacctatatttcaaagtgaacacccctgttcacatagtgtgagtagcatgggcatcatcgatctctgcggcctctggcactcattgtgtaatcaagtaatcgctcttggtgcaggggtccagagagactggggtgtttgcagatctctaacattctatatgagattttggaagcgtgtcacatttttaagggcaaagattctcattttgtaatcacattttcagagttctatgatctgtcttatctatggatatagttctgatggtagaaagtacaattaagtatgtgagacatttgtaaaacatttatttgaaagatcatccttgaggatgtcaaggctttgttcattccgcttgctggcagagactggctagaactgccagaacagaggagagtggctcttactggcattttaaagggacagttctcacatgggctgacctgctgtcaggctcactcttccaacctccccttcactttttactgcatagacactttgggccctctctcccatacccccaaacatttatctttccttacccaggcttctctctactttgtacttttttattcatgctgccatatttcctggcatagttaatgctattttaaatattaacctccttaccttatttgttagaacttatttttggtcaatcagtattgtttctatctctagcaatactgtctctcccaatgctattctccattaataacataattatatctaaatttgggagagttatttttttgtataatacagtttttgaagcatgaaatatcctataaagttggccctctgtatccagatattcaaaaataaaatggttaaaaatattcaaaaataaaatggatggttgcatctgtactgaagatatacatacttttttccttgtcattattacctaaacaatacagtataacaactatttacaacaatttacattgtattaggtattattagtaatctagagatgatatgaagcatatggggaggatgtacttaggtcatatgcaaatactacatcattttatatcagggacttgagcatcattggattttattatgcacggtatcctggaaccaactccccttggattccaagggatgactgtacttgtattttgaagtacatgttagaaagtactttgttttctattttgtccccttttcctccccaattagtagatgattttcactgtgaataaaccaattgaagtttttgtttatttgtttaattctggcagtcaaacaaatgccaccagagttttgttttcagccaatgccaacagttaattgaagtctttgtttctgctgtaggaattcatgaagaaactggaagaaaagagagctgaactaaataaagccaccactatgggcgacaccgttttggctatctgccaccccgactccatcactaccattaagcactggataacaatcatccgggcgaggtttgaggaggtcagtgtgtctcagataatcttcagagtagcaatagctttgagagttgaggggtgtgggaaatttcaggaattaagatgcacttatggccatgggaaaatgagacctctacatagaaaacgttcttttaaatacgcttcttgtatgcattacaatctctgcaattcacttttctttaaaagctcaaagaaattttgcagctatgtccctggaaaattagaaggcaaatatttagtacactgtataacattttggcctccttccacattgtttctgttgaataatccagcagttggatggtgtttcggagcagtatatactggtggagtgaattggtatacataaagtgaattaattctgtatttaatatcttagcttttttttttctttcttttgacggagtctcgatttattgcccaggctggagtgcagtagctggatctcggctcactgcaacctctgcctcctaggttcaagcagttcctctgcctcagcctcccgagtagctgggattacaggcgcgtgccaccatgcccagctaatttttttgtatttttagtagagatggtttcaccaggttggtcaggctgatcttgaactgacctcgtgatccgcccacctcggcctcccaaagtgctgggattacaggcgtgagccaccacgccctgccagtatcttagctttttacatttctactctgtgccacatggagtaagcttacctgatccttcagagaatgcatatttgaactcaaattagaaagcaaaaggaagcctgagtgattgacatgcatctttaaattctgaagatgatgaacatcatcgtgggctctcatgtcctcctcaagccagatcttgatgccactaatggaatctaaaaagaccagaagcattatgggtctagctcaggatgatcctaattttcatttaaaatttatttattttacatcactgcaattattttactaagttggaggaaattcagagaaatttctgtttctctgacaggtgctggcctgggcaaagcaacatcagcagagattagcaagtgctctggctgggcttattgccaaacaggaattgttggaagctttgctggcttggttgcaatgggctgaaactacacttactgataaggataaagaagtcatcccccaggagatcgaagaggtgaaagcactcattgcagaacaccaggtaaaataaatataatcctaactcctgttaaccattatctcagatattttctttctttcactgctgtacttctcaaaacattgctttgttctcgttattttcacttcttcagactcctcagctccttacaactgtgtttccaactctgcaactgccctaaaacctctctttacaggaaccctctgtgacctttgcaaaactttccttctttgtcctctgtggggttacactcgtggtattgtctcacgttcactcctgccctcccttttgccttctaaatgtcagctctccttactccttaggtgttatcctcagctctctatttctctcactctgttccctcttttggtgatctcacccacctccacctccctggcttcagtgggtacaaggtacccacattaaggtatccacattaaatgtggatgcattatgttcacattgcattaatcaaacaaggtttgattgctctgcatttttatgtctgtgaagatgactgtcatcacttgaaatacatcatatgaaaaagggaacgtgttgtctttcttaggaaaagcagccttcctatatatccttcttgttttaaactcaaatgatgggtgtcacactcactttgatttacttgattgctcacagtttgtttaatatgcatttacaaagagaaatattaagtgttagctcagttggttaagcaattaatgttgccattattttgtgtgtgtgtgtgtgtgtgtgtgtgtgtgtgtgtgtgtgttttaaaagcctaataagacatcaatgtctataatggctctaagtgtaccaggtcatgtttcctgtgatcagaggtattagagttcttcagtgtgacaaatattccagaaaggtgttacttcacttttcccttttgtctgggtctccttttccccatcacttttcacagtctctgcctttccacagcctttgctgcatattccaaatagagggatacctagtaaataataataataagcccaaggagatgagataagcagtggcaagatagttaaaccttttaaatacaatggtagtatactttaacccaaatagtttttaccacccttggaatagcctatttatgaatattttgatatgtccacattaaatgtggatgtattatgtcataatatatcaaagagccatcttttttttttttttttttttttttttgagaggcagggtctcactctgttgcccaggctggaatgcaatggcacagtcgtggctcactgcagcctcaagctcctaggctcaagtgatcctcccacctcagcctcctgtgtagctgggactacaggcacatgccacctggcctaatttttgaattttttgtagagacagggtttcactatgttgcctaatcaaagccatcttaaatatttcaaatatgtaggtgaaatgtgccacagaaaagttcttggaaacatcccagctacctagtttgtttgtagacagatgcttactaaagattcttctgaggagcttggaaacttgagtttggttgatgcacagacaggttattttattcacatgacttctcccatgtgtccatgcaggttattccactaaaacaaattatttttattttcaatttactctctttacaagcattaacattttatttatttatttatttatttttgagacggagcagagtctcactctgttgcctaggctggagtgcagtggcacaatctcggctcactgcaacctctgcctcccaggttcaagcgattctcctgcctcagcctcccaagtagctgggactacaggcgtgcaccaccatgcctggttaatttttgtaattttagtagaaatggggtttcaccatattggtcaggctggtctcaaactcctgacctcaggtgatccacctgccttggcctcccaaagtgctgggattacaggcatgagccactgcacctggccacattttatattctttagaaattagtaaatgcctgcagtatgatggtttagattttttttaccctaaagataaagcatatgatttattcttcttcagaaataataacatggttcttttatccttctgcttttagttcatttctaaagacggttttctgtagtaactcttatttgattgacatcatttctttcatttcagaccttcatggaggaaatgaccagaaaacagcctgatgttgataaagtaacgaagacctataagaggagagctgctgatccttcctcattacaatcccatattccagtcttggataagggacgagcaggaagtaagcagtgatcaatttctttaaaatgtcaataaataagggagctaattttcttttattttgaattatttgaaatttgggggcaattggtgattttacatgagcacttgatatcatgaaatactttctagaaggaatacgtgtgctcaagtattgtagaaacttatttaaaaataaagaaaaaatatacccaggtttctatacgtaactttattgtcttgaagtgtatctttcatattagctagaagaaaattgaaaaaatttacagtaagaatggaaatcatcacaccctttgcattgtctcatttgtcttccattatatatataacattaaagctgaacataacaaaaatgaccatgacgtggataatcttcatgacttagttgttcattggtgaccagcaatctcatagcttttgcccatgttcatgtgacttcaggctctatatacttcttgagctactttaacaacatgacatgacattgaaaacaatcatagttagcttggagaagatttaaaaagaaacacaatttgtgttatatgttttatgcgtttctgaatagaaatgcattttgcgtattacttaattttttaattaaaaagaaatgatgtcggagctattgtaattacttactacacaaggagacaaggtaaactattaagagccctatagccagactccttggctgtctccaacacttaccaaactgagaaacataaccctggacaagttacttaaactcattctgaacctcagtttcctcatctgtagaagggtataattataacttcattggactgcagtgagaattaaatgagctagtacatacaaaatgcttaacctacttccaggcatatagttaaatgctcaagtatttgttgtactataaatcctagctgggacacttaacattctatatgaccctaggctagtaatgtttctaggccgtatttagccatttagtaagatgagaaaaatttgttaaggtcattgttttgtgaagttgttgagacttgtggaaaacagccagaaagcaggaggaaagtttagtaaggcagtaaacttgggtttgagactatgcacaggaaacatgcaatctcagtggaaaatggatgtgggcgaaggctggggtcccatacacatgctgccatattttattggcatttgtgaagtgtcttgctttgactcttgtgactgcccagtgcctgctgccctcatctgctctccctttctgccttattctctaggaaggacagctgggtttgatgtaagtcattgtaaggtagtctcactggcctgggagatttcctttaacaaagtggaggatcacagcatgcttcgttgtcattgaaatggcatgaattttaagctggaagatgttttaagcataattcattgagagaggtttccagtatttaaatgcccctgtccagagatatttctttaaattgcatgaacagtgtgtgatccttaataaggaaaacagatttgggccttgacattatacatcatctaaattaggatacttttacttgcgtaaacacgtaattaagttgatgcagtcttagctagaagcaaaaaaggtcaagccttaacacatttcagcaccctggaaactgccatcctaaccgaagttataccttcacaggaaaacgctttccagcatcaagcttgtatccctctgggtcacagacacaaattgaaaccaaaaatcctagggtaaacttactggtgagcaaatggcagcaagtctggctcctggcgttggaaagaaggaggaaactcaatgatgccttggacagactagaggaggtttggaaattcataccctcaacaccacattgtcatttgccctcattcctcataacacattgccattgccaaaatcttggtattttttaacttttctgataataagcaaactcttgctatttgagtacatttttaaatttccaaaataaataccacaagtatgtgtgattttgtgaaatattgatatatgggatttggatttagggaatcaatgaagtaaaaaaaatgattatgttttaacaatcagaagctgattccttaagaataaaatctaacttgacataatgtttgctggtgatgctgcctggaaaatataatcttttatatttcagatcttttgattgtgtgtatttgattacctaagatttcaagttttagattctgcaattgggaaatttttagaagccctggggagttaagagagtggctaatagtgcagagggagagagattgaagggttaggtaagtgctgttgatctggacctgctatcccagtgagcatgactagtggtggtacttagagccggaccacctttatgactttggcattaatcagaaatttacagcttaagtttttaggaattttatttgtaaagaaaaatcagtgacagcaatggaatacattttaaaggcaaaatgtttctaagtcccctttgcaagatcatacctctttttgaaatgggaaggatatgtgtactacctagagaatcatttcaaaagttattcatatagtatagtctacaattttagtacagcattaactcaatcaaaatactttttgtccttttagctgagggaatttgctaactttgattttgatatctggcgcaaaaaatacatgcgatggatgaatcacaagaaatctcgagtgatggacttcttcaggagaattgataaagaccaggatgggaaaataacgcggcaggaatttattgatggaattctttcctcaagtaagttccaagacagatgactatgactgatacaatttttaaaggaaataagcacattttaaaagtgtgggtctggtaaacttgtgttacaataaagcattgtcttataagttgcctaggaagtcacgacccttaaaaaaatgtttttttggtaaaatttgtggctctggagtcaggaacactcactaactgtgtaatcacagatatgttgttccctccactgaggctgagaacttgttagaataataaagttaataatatatgattcttaaggtgttttctgtgtgtgtgtgtgtgtgtgtgtgtgtgtgtgtgtgtgtgtgttgcctggcatatgtgtaataggaagtcaataaattcaagtccctttttcattctaattcacattctgatctaactttgtcattagtaggaaattagaactctataaaacttcttaagatacttatcacctttttgtttgatggcccaatcatttgtatgtgatttccctgacagatgttactagatgtcattcttaaggtaaatttcatataatttattctttgactagcaattgacccatataaaattgccagtgttaaacattttcaacctaaaaaaacagcattttatatgattcacctaaatagtaattaaagataaattaagattatatataactcttcatttgctgtgatgtaaatcagttttttaaaaaaggattttaatatatttgatcactgatgatttaaccagctacactgagattgaaatgtgcaattgagaatgtcttgagaaagaactaacaagtcactacttaccattgttttcaaaattttagagtttccaaccagtcgcttggagatgagcgcagttgcagacatctttgacagagatggcgatggatatattgactactatgaatttgtagcagcccttcacccaaataaagatgcatataaacctatcacagatgccgacaaaatcgaagatgaggtactcattatcttcccattgcgtacaacactgatagtatgttctgccacgatatcatgcacaattcatacaaccattttattttcactctaattgttgtgtcaaagttttaaggattgtactatgtaatattgacattaaagtaaatatttcatcattgtttttggcaggtgacaaggcaggtagctaagtgtaaatgtgcaaagcgatttcaagttgagcagattggtgataataaatacagggtaagttttcaaagtaatgttgtagttcctttaaaggacataaattgaaatctgtatacaatttgatctccattgttttccaggagtcttatttatttacttttttacctcatgtcaaaatttaatggtatatgaaactcttacatttaacattttaatttgtataacggcagcctgcattttgcatattaggaaatatctttgacatctacatcatgcacattacctttaaagaaaaattcacaagaaaatactcaaatctcatatatttaggttgcttcatattattttatattttgttatgattagaggtaagttttcagatttcaaacaagaaagctactctaatccagaaccacaaagttaaaaatatggactcattttaataaatatgaaaagagaggataatgtcttctccacttgtgcagtaatttttgcttttattcaaaatctcaattaactcggttcactctcttcaaaacagaagaacagtgtgacttcattactctttctctatttttttttttctcttttggaacatctcttatatgtagtagctagataagaaatgtgctgagtttccccaatacagtgtgctacttctaaatgaaatattatttttatttttatacttaaaaaaataatcatcaatgtattcaaaattttaacttaaatttgaaatcctaagattttcaaaaatatgtgtacagaaaatagtctgattatttggtttgaaattgggacaactgggtgcctgcacatctctaaactagatactacatccagaagcacagagtgtgagtatgtgtgtatgttctagagtcatacagaaagtttcctgttgaactaattgtgtctttcttccatttttcatttttatcagttcttcctgggaaatcaggtataaaccagtggaatgtattctcaagttcctgatgatttttttttaactttaattcatagtcattaaagcttgccatggccaatctttcccatgctgtctccctagctactacattgttggttggcgtggtgtttctgtaaacgctataagggtccttgatccaggattcctttttgccttgtgtctctcagatgaggagattacttttaagcaaaccagataatgaattgtagcttggcttgctacaatgttacgaatgcaatttttaattcccattttttataatatgagcatatattttatgctagtactcattggaacacaaatttgattctccacacatctctgtgttaggctcattggtgtttaactgtttaggacatacggtctacagtagctgagaaggatcagcctcaggcagtgacacaggaagacagagagccaagaggtctccttggcactcagccacaagtaacaagttctctccaaagaagctatttgccatttgttcaaaatcaccaattttggggcttggcatctctgagtagaaatgttaactcagtaggctttaagtaatattccttttgaggaaagttatcgctataatatatgcagaatcttaaagtcacattttatgccatcttgatcgaatatttatattattggcacttaagtcaatataaaatgtttatgttgacatttaagtcagtataacctgtgtagtggcactacatcatgatcagaattttgaaactaaggagatactctgttttgatttaaacatgttcatgaagcttttattttattttattttattttactttggaaagaaccatgctatctatagtatctgaccatattacattagatatgactctgccactccattttaaagccatattacatctcaagcttcaaattatctattacctttatttattgcaagcaaataatttatttaaaatagaaatagttacttggaatagatttttaaaacttccattagttatactataatactgaaatgttacttttccattcttgctattttcggagtcagcaaatgggagagcatcttttatttgcagagagaatgagagaaatacctcaaaaggttttactcactgaaagcacagtcagcaacattagtctattttctcttgtcttgtgatttggttactgggaatatttagagaaattctgaagatgatgttagttgtctggagaatgcctaattaaaacagaaaattatttgtattcattacacttgaaatatcatctctataaggaacttttagttatttccttataacttttgttttgagtataatcttgaaccaaaatcatctagtcccattatctggttccttaagggtaattttctttaaatcccctcctttccctttgcttattagcggcaccaatttttttctaacaaaataaatttacacttttatttttaaattttaattaacatttcaggaagaattataggaaagtttaagtctcaatgtttaaggaaaaaagatttagaaatagtggtttttaaaagtttgatggaaaaacacatgagttcctgctggtgcattttacatgctttctaggtccttctgagttttaggatcctgagggatttggttggtattgtttttgggttttcttcttgaaactcagtattaaaacactgaaaagtagcagatttttttctacctagagttttctgtttatccatcatgagcccaaataaagtcacaattgtatgttacctgctttacaaagaagccatttatgtttaattgactgttcattttgctttcttgtctgctgggatgacaaccgtgaaattcagtctggtagtttttatgagttggacatgaacctattagaaatgatttaaagtataaaatcatttctcacaggctttcaaaacataaacctgtgatcagaaacctggaatctagaaatttattcaggacttgcagaatttgtagcatatctacattattggagatctattgaaagggcaagaaaaagatgattgcctgttagtatcaacagttatggtacagacaactatgagagaaaccttttagatttggcagctgtatcattaataatgtgtcattggctattctaatattacagtaatctaaaatggcatattaatccagcctttaacaaattggtttaccagatcattagggatgcagaaattttagttgactgtgaaatttatatgagtcatactcatttactttattctttttaagtgaaaactgcccttacagaaaagaaaatgagtttataaagatttctcacagagttcagtggaaaacggttttactgtaagagagagtttaatgaagaagaatcaaagcttattaaatttttcttagaatcattttattttggataagccctgggcaagtgggccagtgcttactttcatggctatgtttaattcctagaaacattttaaaattactgccttactaatattgtttctgtcataagaaagaaaaataatttttagaccaaagctttggtagtatacttgataacctttgtaatcttttttttttcaaactgtttcctttgggctaaatcagcatgcagccgtctaacacaaatcattacaaacccccttttctgagattttactaatcgctatgaactaagcaagaaattaaagtcggttgctttagctactgcaaattgcacatcatcctgtagtttagaattattattgacaactagaggttctttctttcttcactgaacagtttggagactcccagcaactgcgactggtccggatcctgcggagtactgtgatggttcgtgttggaggtggatggatggcacttgatgagttcttagtgaaaaatgatccttgcaggggtaaggagatgcttatcatgataacatcatgaaagtatttcaattttatattatatccagcaccaaaacatactgggcataattttggtcatttattccaatagtgaatgtttcacattggtctgtcagcctaaagttcccaaagaacctgtggcagtcatgtaaaccatattcttctcatttttttctttcttttttttttttttttttactttttctggataaatatggtgggcgggaaatactagaatccattttctttaggagacttttacatctacgattttccaaacaattataccaaccaaggaaaggattttgtctgttatgacatagcaaagtaagagaaaagaaaattgaggtgatgaagaccgaaaatactggataataaaagtttaaaggtcaaagtttttatgaaatgaagagcaggtgaggaaagccataattaaaaaatttttaaataataatccaatgctaacttgactctttgaagttgcagattagaacattaaaaatataaacatataatactatagctctctacatatcttccagcccaagtcctaagttagcttttaatttttctgttttgagatccttctgtcaatttttaagttctcaaccaatttacgttacacgtggtcatttgattgcaatttctaattaggtaccaattactcagtaggcccatttttcttcccccccaagaaaaaaacaataaaattgttataattttcttttacctgtgagctcactgtaatcctttttagcaaacaacaaatgttcacgtcagtgctgtctccttcagctaccaagtgggatcccaggtttcctcctgtagggcctcttggttttggtgatggtgtcaccatctggtacacatagacatatcagtcatcaggcttctccaccaaggccaccatggattgttatacatgttatacagtagccctgctctctcctggccaaagacacacctgcgagagaagtaaaacaagaacaaaagctcctgtttgttttatattttgaaaataatgtagcctaaggtaaaatgcaactccatttatgaagaaatcagaatacatagtgttctgttgggttgcttaggaaggttagcatggctgtggcacagtcttccaaatacatttttcttattgagccaatcccttgagtgcttcttttcctgatgcaacttttcttctaaaatgtgtgctaaaggccagatgtgagcaccctttgcatattcaactactgtactttgtttcttcttctgctaacagtattctttaatgtgattggtatcctgtgtcattttttctagttcatcatcatgggagtaaaatgttacgttcggaatcaaactcttcaattactactactcagcctactataggttggcaacctctctctttgcctctcccctctttccttttctctttcctacttttccattcttgcttcagtcatttgttttaaaataacatgcttcatccatcgcgtatggcttaactcatatccagctgagctggtgcttccaaatttaaattctgaaaatttgatgactttggttgtgttacacatgcaggtgttataagtgatcaaacacatgctaacacgttgctcaccgggttcttgtggagtgttctccgtgtgcgtatgtgtttgtatgagtgctgcatcactgactacctcacagatccttgggtctggtgtttgttattgcatgttggtaaaacagtttttcaaggcataaaataaaaatactagctgcctcatttaagtgaaaaatccagaagtttatatgttgtcatcatgactaacaagccatcaatcattgtgtgtaattatattctttaatttatccccatgttgaaatactggcattctctttacctcaatagtacatgcaaaagacacagtccctgccttactggtctgtcttctcagtgtgatgagagggtaatgaaaccatgtgggcatctgtagctggtggattaatgatattttagcatgagctttccattttcatgctgacactttctttaatagtggttattcttgctggtgtctagtgttagaataagcacactttattttttcctccccgaactcacctgtatccaaaaggaatgcattgtaaaggaatgcatttaactttttgttatgctgagttggagttggcatggcaaaaagatgttcttgaaattctcaacgtgatctctggtgccaggtggccgttcttcccattaacgattgagcgcctcttcttttccgtcttttctttgtgtgcattgttgtgtgtgtataacccagccaaaggaaggacaaacatggaactgcgtgagaagttcattttagcagatggtgccagccagggtatggctgctttccgaccccgaggccgaagatcccggccatcatcacgaggcgcttcacccaacagatccacttctgtgtccagtcaggctgcgcaggcggcctccccacaggtccctgccaccaccacacccaaggtaagactcaggatgaagacttttcctccacctttgcaatcaatgtcccaagtagacttttgaatgttctatttagggccctagaatttgtaggaccagctatctccatttgtgcaccttctcatactgtgggaaatacaggaatttttttttgaatgtatgcttttgcctagtggcccacatagagatgatctatttaggaagcctttgtgatcttccagattgatttttctttttaaagcttcattcatttttttggtgtgtatgatttgccattggatcttttcacttattttaaattattattcttactgtgaaatgtgactctttgctatgaatatctctttctgtggctttgttttttttatctgctatccttttcatttgatttgccattgttccatacagattctccatcctttaacacgcaattatggtaaaccatggttgacaaacagcaaaatgtcaactccttgtaaagcagcagagtgctcagactttcccgtgccatctgcagaggtattgtaaggccccagagtccagtcttaacattctcctttaactgaagctatcactcactaacatcgttgcaccactccctaaatatatgtactttgctaaccctatgtctttttatacacttctataagataagtatcaaccgagcagttcttggaagatgtgagagtaaggggttaacagaaaagatagtctgcagctctttaaacagtgtcaatttgacccagtcactcctgcagactacctcctttttgttctcattcgtacttagttccactgttatctcttgggagagtaacatagagtaggttatagccagacttaagtaaaatttcttttaaagctactaaatatactagatataatatgggcaagaagtgcaacacattcccttcaaatgggagtaaaaggcagtatgatttgcaagagcatcactgaaaagaatgtttactgaatgttcactgtgggcatggtccttctggatgtctgttacatttatacctgccccaaaactttgggcaggtgtgacataagctctcagtatcagtgcaggggggtcagaggggtaggcttaggtatgcagaaagttatttgtcattttcaacaggtaataaatgtatgggttttttttaaagattttaataactaatttaagcatgctctaactttttaatacggcatgatatatggggagaagatatttaggtgatataaaatttgccaagatgaactcatgtatcaggtcatttacattcaattgaaaatcagctgtatatctttttaagaaatttcactgtgaaacaacagacataggtacaaaataatcagatattttattagaatcccaataattagtggggaaaaatccctaaataccttttcttgaaattgaagaaggtatttcaccttaatgataaaggacgtaacttaaaggccaggatcctcaaataaaagtaatataataacttttaaaagccctcttatgcttttcaaaacactttcttgtctgttacttaatcctcacattaataataagtgacaggcagagaaaaaatgtgttaccttcatgactccatggcaatctcattgctgagaagtgggagaattggaacaaaaacaacccattctttagcgtttcctcatttcttcctcctcattttcccaagcccctcatttccaccccttcccaccaactgggtgatgttagtattatatattacctctagagatgtctgtcaattattatggatctattatagcaaaaacagagaaaggttcaaacaacctcaagggacatattaacatttgctttaaatattgaaggctatgatgctgtgttcaaaattttttttaagtggaaactctctcaaagtctaagtagttattttgactagtgcaaaactgtgtttcatttcaaataacgtgatgaaacaaaaaaccaaaaaacaacatgtttctatgggagggactgtgaaataaaatcaaaacaatcaaggcattctgagaagaatgattttggtctttcacggttatgaattctgccaccttgagtggtatgtttcataatttgtggcttctcactccctcgtgttgttgagattctgtttaagttaggaatttagctagatcagcattgtcagatcttgggcaaatcatgtgcctcctcaggctcttgatttttcacattttcaaggttatgattaggtgagtgtgaggattaattgtggttatgtgtgtaaaagtattttgaaaacttgaacattctatgtatacaaatcacatatagatactacacttaagtgtatgtatagtatacacatatgtagataaatgactattaatattaataagagtaactcatgtatcagatgattataacattttaagctaataaagggaaaatcagttgtttaaaaatatacatgtaatttgtttcaatgcatttcctccaaatagttctctggctgtgttttcattgaggaatattatattacattccctatgttcctcaagatacttgtttattttttttaactttgggagaattttttaaatgttgtgatctggaaaaagtgcaatgattgtataataaaatctcatacttatgattgttttagacattctctacaaactcatataaagattgtaaaaaaaaaacttctccaaatgttgcctatgtattttgtctgtaaagactgtagaagtgatagagccaggaagtgaagtgatgtggtagcaagttatttaaaaatcactttttttctttttgcagttaagtttatttaaatgatgtctgtatccattatttatttacttatcattctgtgtctgtctctgcctggctccataaaagcaatggaggcagcagaatatccagacacagtttttctctgctccatgccccctctatgcatgcagtcaccatctttttagcaatacaccattaactctggaatattcactgacagtctgaaagatactaacatactcaccatttatttctccttgccatcacttttatgctcagttttgggggtctccattttgttttctcttcaaccatgaattcatattgtttagaaagtttctttgaattctgagagagaatgagaaattagaagagaaaatcaagtgagaaccccatgccttatttaattgaagagtttctcccccttcacctcctaaagaggaatagtagagagtttccacccatatgtaaagaagtggtgtcagtggaatatcatggtacaggagcaatattttgaaatgtcttgttgctggttaaatacagggaacgccaatacaaggaagcaagcttcgacttccaggatatttatcagggaaaggcttccactctggggaggacagtggcttgataacaactgcagctgccagagtccgaacacagtttgctggtgagtgtggtgcctttcttttttcaatggcttttgcagcatggtcatctgaggattaaagtcccttttcctcctcattggggaagaaattacaaattgaccctgaggtagtcttaaaatgatatgtagccccagtcctccaaaagttggggataaagtgagtcatgggtgcaagtgtctaaaagtgtccaagaaagatgaaagaattactgtacaacagaggaaaatatacagtggtattctaccccttcaagctgaaagattttggctcttctgccagctcagcgattgcacagggccctgttttggggtggttggaagaacccagccacactgagcctcacaccagtgtagctcacattgcttcgcaaaataatgaacctactaatctctgggttctgagctcagcaagcaagaagcctctttaaagtttccaatctcatctgttgaattcctacattcttggagttacctattcttgggcaagacttaaacctgtcttgtttgttctatgtttgcatcacacgcatccctggaggcataatttaaactttagaaagcacaatcttaaaggataggtatattccttatgtctgtttgcaataaatggaatcctgttttaagtaggggaagccgaaacttaccttgtagttggaaatctagccttttctatattatgtctacttagagtaagcctgcatacccttgtgtaatagagaaaggctgtgaatccacaactgttttctgagtgcctactacacaccaggaaaaaaagttaagattaaaggtggcatcgggtttcaaaaattagttgcagatggacccaataataagggtgagctgtctctaccttctttcctcagattccaagaagactcccagccgaccaggaagtcgagctggaagcaaagctggcagcagggccagcagccgccgaggcagtgatgcatcagactttgacatttcagaaatccagtccgtgtgctcagatgtggaaactgtcccccagacacacagacctacaccccgagcaggttctcggccatccacagcgaagccttcaaaaatccccacgccccagaggaaatcacctgccagcaaattggacaagtcctcaaagagatagtgcaattggttctaccaaggcccttccttgagcatttattatttaagtttgaacgatgtaaaatatggtgtagaaattcttgtgaaatattgcaagaggcgagtttaaaattctgcagatggccttatttgtgtatttgtctttttattttatctgtataattttttttgtcagatattctggggttaaagtcacatcatatgtgaggaggaaaagtttaacatgaactaacatttctgcactgtaacgtgccgggcacacactaaactcagttactgtacctacaggtaagtctacatcctctctgacagccacagcactacatcaatccctgacgttagggatacctcatgacattttcctgtttttatggaaactctgagaagctgaatgatacatgcaggggatattttttgagatgatttaaatgtaaaccaaaagatggaagacaaaaagacaaacacacccacacgcagtctttgcagtatctgacagagaactcacaggaagttacttcaagcacttgccagtactatgatattcaagtaccttgcagcatttctctgccattgctttcaatgaggccagaggcatcctggatattagacctattatactgtaagaatataagtataaagtgcgttcatatacatgtgaggttttcttttgcttgagtggacagtagcacctgtatcattgaactcattttgtatcagagcaattttgcttgcagaaagctatgaaataaaacacgtcccttaactgcattgctatggaattaattttttttccccagggaaaactagtgtatttttttatgagcaatatcaatttggagtgaccaaaagatacttaaaaatgggtttattttgatttctcatctgaaataatcatgttctggtattatatctatctatatttaataaatatatacattttaatttattatgtgtactcacatactatagaaagatattagtatgcatttaataaaacatattcacttgaatatatggaa

SEQ ID NO: 604 - DNA, 128427 bp, Homo sapiens
atttagccaaacaacctttaattcattgagctcaaagcttagcagcttcaatgttgttgttaggcataaacagcttgcaaatttcaattttttttctctcctcacttttgaactagatttgggcaatggaggtgatgacagcattttagaagacagaacaggaattctaggtgtttaggcacgttgaagagaaacttgctagaggtgatgaagtggaaagaaaaagacaattcactatagggatcaacattattgcagttctgcaaaggtaagtgtcatttaaaaatctgtctgttgttgcgtcttaatgcacttcatgaactatggatattagccacagacaatggatatgatttgaggtccgatcctcatgtaacttttcaatatgctttgctcatatctctgaagaaatgtagaaatcaaccttggttatgacatcttcaggtttttacaataaatattttaaaaagttgtttcttgacaataactttacaaactttcttcagtttcattattatcaggggtttagatagtataaataatttcattgatgatcacctttaaaaatatatttttgatatttgtctgcttgtctgcccttttcaaattgctgattaataatccacctataatttatttgatgaataatagtttagaatacttttaataaataggccttcaagcagaaatggacaattgtataaaagttatatataaaatttaaattttgtataaaattaagcaaagataacaaattttaatacaggttttttgtcttgaacattcatttttcagaaaatggagaatcttctagaaccacaaaaaacagcactgaatagtttccagtgatagaaagtgttcatagtagttatgtagatttaaattattatttccaaacattcgttcattatgttttgagtaccttgaaaaatgtcactgggtttggaaatggtaaggttgaaaggaaatggattaaatccaagaacagttgatgttgcccacaaaaacttggaaagctactagggacattccaaattcttttaacattctttgccattaaacaagcacatttgtttaaatgatgcaccatatttgcatccgctgctgataataaccacatttgtgtcttggagtaacttgattaatgttaccacaatgactaacagaggaatacggttctggtggattattgaaaaggaagagcagaaggaaatgtgtggctgttatttcttttgccctatccctgtttgagattgggatgtttagaatctgtcccaagaagatagcaaagctggaagccagaaaagcagaaccagctagaaccggcacaggaggccaggactcggctcaggctcagtgtggatcccactggccgtcttctttcctgggagaatttaagggttattttttactgattagaaaattataattccatggaaactgttagaaagtataatatgtttgaatagaaagatcatgatttcttagctgaacttaagtggttaaaaaaaaaaagagagggaaatgaaattaatctgaataaatatgatagatctgaagaaacaaacaaacaaaccctcagcatttattttcaggacattccagtgctgcaaagtcagttctgagtccactttagatcttccacagagtggactctaaggtgacttaattaattgccacgccacatggctctaattacagcaatgttgcttacagcaattctgatttctgatcatgttgaactcatttcccttagagtttcaaaacaacgttcacatttgacacattcacatgtttacattatgagaatgaaaatgttttaactgtatgtaaggtttaagaaagataaaattatgagttagatgtattatttcaagaatatattttttcacttgtaaaaggctcattgctggtcattggtttccagatgaccatagatttataaatgtattcatggggccaggcgtggtggctcacgcctgtaatcccagcactttgggagaccgaggcgggtggatcacctgaggttgggagtttgagatcagcctagctaacagggtgaaaccccgtctctactaaatatacaaaattagctgggcgtggtggcacatgcctgtaatccttgctacttgggaggctgaggcagaagaatcgcttgaacccaggaggtggaggttgcagtgagccgggatcgcgccactgccctccagcctgggcaatggagtgagactccatcgccaaaaaaaaaaaaaaaaaattgtattcatgaaatgccaggtatttaaaatacagttcttagaaattgcttaatagttctacggtagttctacagattgttttatgtatctacaagttgctgagaacattttaagttagagttagctaattttgaaaaaaattatcaattttttagctttttaattaattacatagaaatgtattgccttatttccagagtaactcctacaatcaccatgtgtttacagtttacataataatagagccaaccctggccttcacatttaaatacaagtaaaatcaggttactgaagagaccatatgaagcagcaagaaatttagatgtcaccaaatacaatgtacaacttgggggatgtgttgaagagggatgtgggagaagcatgccaaggtcttcttcttcagactggaaactacacccacctgccatctggcctgacgctgggtggggtagaggggtattgcacgatgattcttgtgtatttacaggcaccttaaattcagacaattggcttttggagacttttctcctactgtctcatcctgtattacaggtctacaagcagcaccacaccatgaacacctatttattaagttttctaacttacaatataatctctatccttgaaaaactcaatgttaagttgaaaaaagggaagtatacaggacacaaagcatcctgtatgtggagccaaattaatgacgtagataatgagtgccacctaaggaagacctgatccagacgggcttcatggaggcctgaggctgagttgggtcttggtaagcgggaggagagctgatggatgagggagatgaggacatctatgataagaatggagctgtgagcatgagcagagacaggaatggccttcctgcgcccaaggaatagggctgtcagatgaaatacaggatgcccagttcaatgtgaatttcagataaacaacaaacacttttttagtctaagtgtgccctactgcatgactgtgtatgagacttagtgcatgggacctacttatacgaaaatagtatttgctgtttatcagaaactcacacttagctgggggccctgtattctgatttcccaaatctggcaactcttcaagggaactgagagtcagccagcttgacagcagcagagggaatgagcctatggagcaggaaagaagtgcctggaggaggctgggttcagaaggtggtgggactttaatggtgaactaaggagtcaagaatttaaagacacctggggccgatgagaagttctgaaaagggaaatggcgtgcataagatctgccggttggaggcagaacttgctgggggagagatcagggcaccgaggcctgggttctgatgaagacagagagaaagaagcccaatggagacacatctgagaacaaactgacgcgttttgcaaactaattgggtatggttataggaggagagaatgtgttcaagaggatgttatgttttatggctccattcaaagaaatggccaaagagacagcagcaggtcagggagttagtgagagggatggggattttggtttcaaacacaggaaatttgagggaatgatggaatagtcagatagaaatagtaagcgaacagctgagaatggaaaacagcttaggagggaggtgagaactggaaataaaaacgacaacatttattaagcacttactcgatgtcaagccttttatctccattatctccttctgcctctgcaaccatctatcggcaggttccattgccagccacattttgtagttgagaaaagtgaggtcagagagattaagtaacatgtccatgatcacatcattaatgagaggcagatggaaaatggaaccaccatgtgtaggggccaaagccctcacaactgagactcatatacagaatgttgagcctctggctctagattcactttctccatctgcaaagagctaagggcgccagttgctcatgctagaacccagtttttagccaggttccaggtcttctattgttcgtaactttgatggccctcgtagaattctccatcttttggttactctctctgagaaaatggaaatcatttatacccagaggttttccttatttattaacctccagaatcgtttttccccttagtggctcattttaaattttcccttggtcatctggtgaaataaagattatgatgaagaatctataatctcatatagttactttttttgtatgacatgtgtggctaaaacatacttattttacaaaaatcccgaatacaatacaattttattaaatttcatcttgaggttggacattagatctccaaacttgtttttttttctttcttcttcaagacaaggtccccctctatcacccaggctggaatgcagtggcacaagctcggcttgctgcagcctccacctccagggctcaagtgatccttgtgcctcggcctcccaaatagctaggactgcaggaacacgccactgcacccactaatttttgtattttttagtagaaacagggtttcaccatgttgccaagttggtcttgaactcctgacctcaaatgatcctcctgcctcggcctcctgaagtgctgcgattacaggcgtgagccacggcacccagcctccaaacttgttctttagtgtctgctattttgtatcctttgacctatatgtccccatttccctttcccccctcctcccacccttagtggccactgtttcattctgtatctctgtgttttagggtttaaaaaatattccacatataaattagatcgtgcaatttttagaaaaaggttatgctgaagagaaaagaccaagggtgtcaacctcctctccttgtccctggctgctctctagtggcaataccagaaaacaacgctcagcccagagacagcagagccaggcactagaagcaagctctttaggaatctctaaatagcaaattcaagaaggctagttgtgctaggaaattctggaagaagactccatggaattacatacacccttacagcttgttggcctgaaaggcattttgaatagaacagttttagatttatcttaaactttctaatcattaaaaatacttcacctgtttaccattttaggcaggcacatatgtttggctactaaactttcaatgcacatacgtgcctttttattaagatttcctagatctttgattctaaatatttacttcaaaatacacaatatattttttagtaaaaagcaaaaagtctatcttttagggatctattcttaaaaacatcataaattgagacaataatgcgtgtgtaaaagactattcataacagatacattttgtaactaacctaaatatacagggaattgttaaataacattccacaatatgaaattttatacagacattaaattacattataatatttaatgacattggaaactattcatagtaaatgttaagtgaacatttacacttacattcagtgaatgtaagaagtctacaaaattatgtatatagtgtgaccccatttgcttaaaaaatatatatgtacatatgaaaaaagaagtaagagctaaaaagtcatacaccaactgttaacaatagaaatttcttagcctggccaatatggtgaaactccatctctactaaaaatacaaaacttagccaggcgtgatggcatgcgcctgtagtcccagctactcaggaggctaagccaggagaattgcttgaacccaagaggcggaggttgcagtgagccaagatcgcgccgctgcactccagcctgggtgacagagcgagactacgtctcgaaaaaaaatttctggttggtgggataatggtgattttgattttctactttgtctccaggataaataagcatgtactacttttataatcaggaacaaaacccagtatgttttcaaaatgtacagagctaagtctctgttctgatttcttgctgtcatggctgacaatatgttcatgctaattcattgccattgacggcctctcctccaagtaaagggctatatcctgtttgtgacagcataatccattgtaatggaaaagattatgatgcactggcctgttctatgacttcactgcattcatcagcagcaggaaacaaagacatgcacttttttcataattgttttagtaataattgacaattggaggaaatgaatggcagaaaacaattatgggcagacaagatggtcagcaaatcaaactgggaaatgcaggggagcccgtctcagctttattcatgtagcgatttcagaacattacaaagatattattgttttgttctcctacagaaatcactattgttttttttttttttcttttttaccagcagttacacaattctttgctggcagcaatgacttccaatgtgtttttaattcagtaatccggtaatcccacaacagggatttgctgctgaactttttatgtttattaatattcagggtcagtgtgaacgcctccctgtgcacatagctagtaaaatgcacagcgatattgctgtgacttttcttgcctctgaataactccctgttgcccagacatagaatcttaaaagtgtttctttctattacatttataaatagcaaattcatgtttctattttttaaattgtccctagtcttcattttaatagcaatgggcaggagaataaaacaacaaaaactcaaaacaagtgaattaatgattcaatatctagtttccatgccatgaaatgggcacatcccttagatgaaaatgagggatgggttatcaattaggaaacagttaagtaaggcaggtattatgctgtggtaacatttatttatttctcttagcggcctgtgttcatagttgtcttgctgggtattactagaattctttggatggggaaactaaacatgtgtgggctgttacatcactccaagtcatactcttctctggttagcctgatatggagtaaaattcggcagcagctctgacttccagttttaaagactacttactgctcttactatttattatggaacaccctacagcacagtcctgtagaaatacatacctgtaatcccaacaatttgggtggcagaggctggaagatcacttgaacccaggtgaccagcctgggcaacatagtgagatcctgtctctaaaaaaaaaaaaaaaaaaaaaaatagctgggcatggtggtacgtgcttatagtcctagatattcaggaggctgagttggcaacattgtttgagcccagttgttcaagtctacagtgagctatgatcacaccactgcactccagccagggcaacaaagtgagatcctgtctcaaaaaaattaaaaaaataaaatataaataaaatgtgagccactaatgtgacctacatagttcattttacatttcctagtgaccacatttcaaaaaataaaaagaaacagataaaatgaattttaatatcatagtttaaggagtgggggatagtgccttacacctgtaatcccagtgttttgggaggcaaaggtgggaggattgcttgaggtcaggatttcaagaacagcctgggcagcatggcaagaccctgtctctacaaaaacaattttaaacattagctgggcatggtggtgcatgcctgtagtcctagctactcaggggactgaggtgagaggattgcttgagcccagtatttcgaggatgcagtgaactatgattgcaccactcactgcactccagcatgggcaacagcaagaccctttctaaaataataataataatatagttgatttaaccaaatatatccaagataacatttcaacatgcacccaatataaaaaaccactaataaaaactttatattccctttttgtaataagtctttgaaacccagtgtgtattttatccttactgcatgtctcaactcagactagcctcatttcaagttgatagcttcaggtgcctagtggctactgtataagacagtgcaaatctaaacagaagagctacggtgccacccacagctcataaataatgtgaaatttagactatgagatattgctaccttttctgtactcacagtcatctccattctgaaacatttgagctgaacattctatatcaagtaagattgaatagttgaatagcaagccaaggactggcagttttggagatttggcttattagaatgattcagctcttcacctgggctgggtaactatggattcctcagttgagaattagggcaatagaagtttttttaataaacattatccaaatttgaaatctggatgatatgcttgtaaaagactttatcataatgttttgaagtgaattttaggtataggaatagattcaattacacagcctaaaatcgagttccaaaaaccattatagacattatgctcctaatagtgcctacaacttagtacaaagaaataaatctttagcaatggaaacacacacaagtgcacatgcacacacgcacatacttccaacattgtgaccacttgctgatgtcttttctgcattttgcattgtcttatttgaaggataggaagtatgctataataatcttctataactactatgccttggggactctcatgccagtcagctggtgtgataaagatagcttctgtgtgctaaatacggagatacaaaaatagaactggtggaagtggataaaatcagaagacactgtaggttcttatggccccaccaatggcagagacctggaaacataggtctctgaaatcctggcaatgagttgcagccaactggaatgatcacatttttggttcttgtcttattccatgagggtttggttatgaaactagagtttaaccagtcagaaaattctgaaatcaaaataaaagttaaagacatatataaataatgaccattcattgcatgatttacaaattggtaatggtccaaaagtttgtttttaataattttcttggccctctgaattcactttacattttccccatagaaacaaagttataaatagtgactgcatactgcacctaaaatgccacgtatctacaacgaaattattacaatgtatttataatatattatttattctaaacatgtatgcatttgaaattattcaatgaaatctaactattgatgtactatttctacattaatacattatatcatatattaatatgctaataattatatcacattaatatattaataatatgttaattaaccaaacagaaaaagtatatactggatcaacaaaaccaccttgaattcaaagcaacaaacactagtaaagaatccaggaagtgccaggtgctatactagagtcagggacaagcgtaagagataaatcatatttatcttgtttcttaatattggaggaaaagcaaatttaccaacgaaaaatgaggaagtaaatggaattcttttttttaaaggggactgccttatctaagtgacccttaggtagagagaccttttttaggcttttatgtctaattttactgttaaactttgtgcttgccttttcctgaaggacaaagtacgactagttctgctgttaatgtgtagccattcttttttgttggttcccaaatagggtaattttgttcgtttgtttgtttgttttgtttttgagacggagtctcgctctgtcgcccaggctggagtgcagtggtgcaatctttggctcactgcaagctccgccccttgggttcacgtttctcctgcctcaacctccctagtagctgggactacaggcacccgccaccacgccgggctaatttttttgtatttttagtggagatggggtttcaccatgttagccaggatggtctcgatctcctgacctcatgatccacccgcctcggcctcccaaagtgctgggattacaggcgtgagccacccacacccggcccaagtagggcaattttttttggaaattttttggatttttttttttttggttcccaaatagggtgagatttctgtgaagtaacacttggctaagaagtagaagagaggaaagtgaagagaatggttagaattaaatatgcaggcacatgagaattgtgcatgattgtccagttctccttggagaaagggtgaggaagactagagactgagcctcaagaaatgatcctcaacagcctctagggtggggaaaaggaagggagggaatgtgtgcaatttcacattcaaattgcacatacaaatttccgagtcagttaaagaaaaatctcttggtgagtgccattaactgttggatcctgcagagactaccattaaaaaaatatatcaatagaaaatgaggaaggactgggccgggtgcggtggctcactcctgtaatcccagcactttgggaggccgaggcgggtgcattacgaggtcaggagatggaaaccatcctggctaacgcggtgaaaccccgtctctgctaaaaatacaaaaaattagccaggtgttggtggcgggtgcctgtagtcacagctactcgggaggctgaggcaggagaatggcgtgaacctacactccagcctgggtgacagagcgagactccgtctcaaaaaaaaaaaaaaaaaaagagggggaagcagtgaccaagtcaggcatgaatgggccttcagggaaggtcaagaaatctgggttgagtggtcccactggttgatttcacaaaacagtgagaatcagggacctacaaatgagttgagattatgtatgtagcccaaggaacaggaggctgggccagggggacagactgttctggaacactctcttatttcttctgctgggaactagggctgtttctctggtaatggaggccctctgacaaagacaaaacatagggtaattgtgccacatgctactcaaagaggtgccccaaccttggagtgtgcacatttttttttttttgagacagagtttcacttggtcacccaggctggagtgcagtggtccgatcttggctcactgcaaccttcgcctcctgaattcaagtcattctcctgcctcagcctcctgagtacctgtgattacaggcgtgcaccaccatgcctggctaattttttgtgttagtagagacgaggtttcaccatattggccttgaactcctgatatcaagtgattcgaccgccttggcctctcaaagtcctgggattacaggcgtgagccaccgcacccggcccatgtctgtgttttctatctgaaactgtctcctcaccttctggtcaatgaatgcatccttcttcaatgtcttctctcaatttcttttgtttctaggatattttcttttaaaacatccatatctcttctttgccatggaaactacacccaatctacctgaacctgcggcacccctctgatgacccatttggattctctgatttcactgccaagattctcagtgagtattccatcacataccacctttattttctcaagtctctttcagattttaaacacataaaatctgatcacatgttttcaaccccactgaaactgtgatgtcagaaactttgtaaattatgaagtgaacaacatttttgttcttcctcatttgatgatgaagctgtcaccagtcttgagtgaatttgccctcttcagaaatgctataacatttatatactgtaatactatataaatactttcttatatatttaatcccatgtctggtggtgtttctttaatttattcaactactatttgcctctgtggttaattttccaagagtttcttctctcaacaacctaattataaattccttcatgtctaggccttattttgtgctttaaaaaaaactctctgtggtacactaatgttcatagcagcattatttataatagctgaaaggcagacacaaccagacacaacccacatgtctatcaacagatgaagagataaacaaaatgtggcatagacatgcaatgggaaattattcagccataaaaaggaatgaagttctcatatatgctaaaatatgaatgtaccttgaaaacatcatgctaagtgaaataatccagacacaaaagaacaaatattatatgattccacttatgtgaaatatctacaatatgcagattcatagaaacagaaagtagattagaggtggctgggggtggggggaaagggagaatagagagttatttcttaatagttgtaaagtttctgtttggtgtgataaaaaagttttgcaaatagtggtgatgattgcacaacattgtgaatgtaattaataccactgaatagtacacgtaaaaatggtcaaaatagcaaatttatgttatatatatttattacaatttaaaaattaactatataatatagcaaaacgcagtgaattgtatggtatgtgaattatgtttcaataaacctattttaaagaaatccctctgggaaccagatataaccttacatatagtaaatgtttaagtaatattttgtatcatttgttgtaatgagattcattaggacacaaatttacatgtggtagagattagacatgtttttcaaattatgcataccaggtataacatgattactctctgtttggggctttaggtaggtttagacaaaagccaagtgctgtgcaagtgtgattgagaccttaaacaatgtcttcatcatttctacctctcccagattaccagacataagatcaggtgcatgacacataccaacttcctaatcttaaatttggtgaatgaatgaaagtattaacaaagtatgcagagttaccttgcatatatatgcatatatgttttttctcaaccaacctttcgtcattgcaattgagacattactttttcagacatctacttttaagacataatacgttatactatgtagatagcatagaatattgtgcaggaatctagaaaaaaccatgtttgatgacatacaacagaatatttcatgacattggaatatttaataatatttaggccgggcgcggtggctcacgcctgtaatcccagcactttgggaggccgaggggggcagaccatgaggtcaggagattgagaccattgtggccaacatggtgaaacctcatctctactaaaaatacaaaaattagctgggcatggtagtgcatgcctgtagtcccactcctagggaggctgaggcaggagaattgcttgaacctgagaggcagaggttgcagtgagccgagattacaccactgcactccagcctggtgatagtacgagactccatctccaaaaaaaaaaggaatatttattacagtgaaaatatttatgatatatagcaaatacaaaatgcaaacttttgtatatttgaccattatgcattttagtaaagataagaaaggtattttattacttatttctgtgtaacaaatcattccaaaactaagtgcctttaaacaactgtaagcatttattacctcacatgatttctttgggccagaaattcaggagaaggtcagattaaggagtttcatttgtgaggttgcagtcagttgtcacttgggactagagtcttcggaagactcaatagggactagagatttacttttcttatcgttatttccagcccccaagctttattaagatattgacaaactaaaattgtatatatttatgatgtaaaacatgatgttttgatatatgtatacattacaaaaagatcaaatcacctatttaacatacttatcacctcatataccaatcattatttttgtggtgagaacatttaagatatatcctcttagcaattttcaagtatacaatacaatattaactgtagtcattatgctgtacaacagaacttatacatcttgtcaaactgaaattttgtaccctttgatcaaaacctcctcattctcacctcttcccagccccttgcaatcctcattctactctctgttactgagttcaacttttttagatttcacaaaaaatgagatcctgcagaacttgtctttctgtgtctggcttatttcacttagcataatagtctccaggtttatccatgttgttgcaaattacagaattttcttattctttaaggctaaatagcactccattgtatataccgcattttctttatccattcaactgtcaatggatgcttaggctgattccacatcttggctattataaataatgccacaatgaacatggagtgtaggtatctctttgacatgctgatttcattttctttggataaatactcagaagtgggattgctgaagtatatgatagttctattttaaatgtttttttcttttttcttttctttctttttctctttctttctttctttttttttttttttttttttttttttttttttgagacagagtcttgctcattcgcccaggctggagtgtagtggcatgatctcggctcactgcaaactccacctcccaggttcacagcattctcctgcctcagcctcctgagtagctgggactacaggtgcctgccaccacgcctggctaattttgtttttgtatttttagtagagacagggcttcaccgtattagccaggatggtctcgatctcctgaccaggatggtctccaactcctgacctcgtgatctgcccgcctcagcctcccaaagtgctgggattacaggtgtgagccaccgtgcccagctgagcattttttcatatacctattggccatttgtatttcttcttttgagaaatacctcttcaggtcctttatccattttaaaatttgaattatttgttttattgctattgagttgctttgagttccttacatattttggatattggtcccttatcagatataatacatagttttcaaatattttctaccatcccacaggctgtctctacagtctgttgattatttgctgtgcagaagcatttttgtctgatgcaatctcaactctctgtgtttacttttgttgcctgtgcttttggagtcatatctaagaaatcattgccgagaccaatgacaagaagatattcccctatcttttcttgtagtagttttatagttttcaggtgttaagtttaagtttttaatctattttgagtttaagttttaatctattttgagttcatttttgtatgtaacgtaagggttcgatttcatttactgctgctttcaaagttttttctttgtcttttgagaatttgattgtaatgtgtcttggtgaagatctctgtatttaatctgcttggggctatttgggcttcatagatctggatgctcatttgcctctccagatttgggaagtttcttatcattatttctttacctaagcattctgctcttttttctttctttgctacttttgtgaatcccctaatgtatatattggattgcttgatattgtttcataaatcctataggcttttttcattcttacttcttctttgttgttgttgttgtttctctggctgaatatttcaaatgatctgtctttgagctcactgattcttttttctgcttgattgaggctactgttgaagctctctatggaattttcagttccatcactatgttctttagatccagaatttctgccttgttcttttttatggtttctataccctcatcgaatcccctattttgctttcatattgttttcatgatttgatttagttatctgtattctcttatagctcactgagctctgttaagatgattattttgaattctctgacaggcagttcatagatctccatttatttagggtcagttacttaattttgttgtttggtggtggtgtttcccttattattcactatctttgtggctatatattgatgtctatgcatatgaagaagtaagcacctgttctaccttttacatattggctttggaaagctctcaccagtctatctagagattctgggtgggttgtttggtggaatctgagggcagacttgctcctgtattctcaggcaagttgccttggtgcctgagtcagcaggcaggaaggcctggagcttgcatctcctggggtgggcctcgattctgggttcatgggagtgaatctggaccctgtgtttgcaggggctggcctgaagtctaggttcatgggggccatcctgtccatgagatggaccttgagcctgagttcatagaggcccactttgttctaggatgggcctggagcctgagtccacacaagggctagcctggttactgggacttgcctaaagcctgtgtctgcaggggttggcctagaggttgagctgctgtggcagacatgcctctgggtgtagagcctagtgctgttgtattggtgtggtgcttgaatggagctgcagcctgatgctatagaggcctgcttgcagcctggggccataggggctggcccagcattagggtagccctggatgcccttatccacaggtgctagcctagagcctgggatcatgagggctgctctggcactggatttcactgaagtgggcccgatgctgtggtccatagcaaagtagggtgttcagttcactctccttcccccacagggaaggtatctttctctgtgctgtgcaccccttgggggagggatgatatcagtaatatgacactctttctcgccctcttcaatgtgccttttcttatttctgtactggggtaggcatggcagtatttgtgccccaagggccagagacatcaaaatggattaagaatattttaaaaagcaatgagtgtattataaagattttgagcttccagctgaagacgggcttaacacacacattatctacctttgtttccttttgaaaccccattaagatgagatcaaagggtttttgatctcaactgggattctttagttcttgagaaggtacattcatgcatggatagttgttcaaattggtgtttctgtaaggggatatgtgctggaaaatactattgcaccatcttgctgaggtctgcttttgaggtggctcacttatatggctggcatgttggtgctggctgttagctgagacttcagttcctttcttcgtggacttctccatgggtcttattggatacccttataaggtggcatctgactggcttctttcagagtgagagattcaagaaaccaagatgaaagatgcaaggttttttatgaccttgccttggaagtcatacgtcatcacttttcatgtatcctattggtcactcagggtcagtcctgattcagcatgagcaaggactacatgaggatatgtaaggatcttgggaggccatctgcagattatcacatgtatatgccaaaataatgttataaaagatgtaattaaaattgatcttatttttctcctttgtacttttctatactttaaaagttttttatgataaacatatatgatttttgaaattacacacatacaaatcaataaaagtgggggtttttttgggttaaacaagagaaatttatttttcactatcctggaggctgaagctcaaaatcaaggtgtcagcaggtttggtttctcttgaagttgtctctgtggattgagatggctgtgtttttcacagtcatcttcttcttttaagtaaaagttatttttttaaaagccatacatagtccagagaggagtgagtcaattcttgttactttgatttaacactgatgtcaagttcaagatcaaggtgtcagcaggtttggtttcttttgaagttgtctctgtggattgaaatggctgtattttcactgtcttcttcttctactttttaagtaaagttattttttaaaaagccatacatagtccagagaggagtgagtcaattcctgttactttgatatgacacatcaatgcatctatacttttctctgtttgatgtaaccctgtaactaaggaaaggagaatttttatgggaggagggatggttttaaatatagagcataagactggaaagatgtgaccaaggtagagggtctggggtaggcatggcagtatttgggccccaagggccagagacatcaaaatggattaagaatattataaaaagcaatgagtgtattataaagattttgagcttccagctgaagacgggcttaacacacacattatctacctttgtttccttttgaaaccccattaagaagagatcaaagggtttttgcccaagtgggagatcacccatctctcatcatagcagaaggctggaagtttattctctcaacagggtaaaatatagggtgtttaggctgggggaccctggtctctggaccagggccacctaaaggcagacatattacacttgaaactggaatattaactgaaaagttctccctcagaaaatataactgctaataggttgtaagttttataccttgtatatttgccacagaaaaaggattttctggttctatgtcctaaaaatttggggaagggagtcatttgattagggaatcatccacctcaatcacatgcttattcctggaatactcaaatgtggccaaaaaaagagagggatcatgattggctcagtttgagttacatgctcatctgggccaaggtagggggggcataaggggtggttgaatgtggtgatggaggagagtgggaatgtcaggaaaacagtgtcatagatgtcaactatagcttctcaccctcttctataggagatgatgtcatgtaggcaaagatccatgaaagcttaaaacagtcttatggatgtaagaaaaaagtccactttaccatatattatggtttttcaaagaagatttttctatattatttcaattcttcttaagaaattcatgaaacaaatattgccattctcatcttgttgcttgatcattgaggtgaactcatagtagtaatgttctggactcagttactgtcccttgagtggattaagtcagggatgtataagaagccacatcttttgattcttagtcctgtgcaatttttattttatcatcccagtgatcaggatgggatcacaaatttgtagataactgggctgggaatgatatctggagagatgctgcttacaggcaatgaacttcattaatgtccatagtttcctagtatctcacctacaattccctcaacatcagtcccaacacgtgtaaaatcgatggagactgggaaagtgctgccaaaggcagaccgcccgaggagccatgtggcctacttttggaataagactgaaggattaacttctgggaaggactttccatctgttttcccgataagattgattaaaaccatctaaccaagttttgcagactctatgaaagaacgaatgaattgtatcgtctggcctggtttagttcaaattccttaaaggagttctagctccactattcaggaaaggaatcttcaccatgacacctcctggggggaggaagagcagctaggaggtcccagaggtttgccccaccctgccccgagtgtctcattttaggtagcaagtgatacatcattttcaataaaccagctggatatcagttagacaatttcacgtgcatttaatttacccttctgctgaaattatggcatggaaacattatttttctttgccagttctctttgtcccctttccatttctcccaccctctcctcttcccaccaaagttactttcctttgttatttttggtataaagaattttccttcaattaatttcaagccttcagaaaagcagttaaaagaagttgagttggggagaggtatttgatcctcttactacacacatatagccctacacctgtggaattgaactgagtaaaaatggatctgtcttttcgtttgttatttaatgatagtctttacattttaatggtgagtttagaccatctacactgtgattattgagatattaatgttatttttaattttcgatttatcattctttctttcctgacttcttttggatatttcaaattttctttattccaatttttcctctcaattgcttacataatccatatcttttgttttagtggtggtacttgcaactttaaaatacatacttgatttaacaaagtctaatattaatatattcagtcttctgaatagcataaagaccttaggaactttaaattctgatctcagtcttccatcttattcctgttgaaaattttagttccactctgttttaaacaagtttgttaatgtataattgacatatgataatccacacatatttaaagtacacagtttgaggtcttgacatatttatatacccatgagagaatcaccacaatttttaaaaaattcatttttctaaaaataattaatccaattcacacacaggcataactggttgcatgttaccaaggtctgctagttttttgtaaacttgttttacttaaagagttctgtagcttctacacaaaagtaactatgataatcaccattcgtcaaagtctaccaggcattgtgctaagtgctttctatttttttttttttttttgagatggagtctggctctgtcacctaggctgaagtgcagtggcctatcttagctcactgcagcctctgcctcccaggttcaagtgattcttgtgcctcagcctcccaagtagctgagattacaggtgtggatagagatggggtttccttatgttgaccaggctggtctcaaactcctggcctcaagtgttccacccgcttcagcctcccaaagtactggggttacaggtgcgagccgccatgccggaccgctaagtgctttcttcacgctaattatttcccattgttttcttcattgttttaaatttttaattatagacataatccaagtttgttataaatgaatatactcaactaaaattagtcatatttttttaaaaaaacctggaaccctctttttttcttcaaagtggatatatgtttatggtttgttgtcactgcagatattttatgtgcatttgaaaacatgctttattgtaataaaaatggggctaaatgcatagtgtttttttcagcccactttttaaacttactgcatcaagaccatctttccattacatctttttcatggctacatgatgtatacagctttgaatgaatgcattaagattgttttgatgaatcgcctcttttttttaggttccttccttcctttttttttgatattacaaatgtcacgtcatttttataagataaaatcctgatgcggaatgcattatttgcaaccctcactgccaccctttgagttgggtattatcatttccctttcacaaatgaggaattttattcttaaaggcttaagtgacttacttggctcttacgtgactgattggggaacgagaatcctggtttcctgttcctggtgggcagtgttcttaaccctcaccacactacctctcctactacttcagaaaatggttaaaaaaagttttaaagtatatttatagtgaaattgtcaggaggattactgagaattttcagcaaatagtcacctatggaattagaatgcagaggacatatttcaggcaatttatattttcacctggcccttcaactgaggactctgacgtgagtgctgaggagctatttatagcaggtgacttttgcgcaccctggggaggttgtgaaatagctgtctatcacaggcagctaggaactgcttgcccacttttttttgttctgaaagaaaggatacagaccatctgggccagtaagttgggtccaaaatcggacttatgtttattttacttaataaatgtgttcttgaatcgtatgagttgaattttggttggttgaatgccatttttagtgcaccaggggtgcacacatttcttgtaatcctttaatgagtagctttctaaaacaaagaatgctttggcaatgtgaataattttcccttaatttatattgaatataatttatgattttttttctgtgcagcagggaaacttgtgctcagttgtttgtgttttagagcgtgttggctggtgtagccatatcagttaacagtaacatggaatatatatgctattaaaaatatagacagatatattgcaacctctcactacaaagccccagatcaaactctgtggtgaagccgtgtaattcagaagaggtgggtataggtaaaattccataccaggaggagtatagctgtagacactgggtgccccttgtccctgtttagatagtggaccctattcctgcctcagatggtatgtggaagagcgggctcttcagttaccaaggccacagtgcagaaaatagggtagaaacaagtgagaaggtaactgaccctttttccaccagcaccattgcatgctgtgaaagtataataaagtatttttagtccaaccttaacatttttgtccttaatagcacatcagttcacatttgctcattaaaataaattgtttttacccactcggcagttgattccatggcctcagtgatctttagagttgatcgaaattgtggtatgtgcagataataaggactaactgggggcaaatagactctaacttttaactttgacaaattttaatcagttagatttaagatatattttttaaaaaattatgattctacatgaaaaaatctaacatttttaacataaatgatttcataaatatgcctggtgggatataatgctgaaataaattttaatgcctctcatattacaatcttgatcctcaaagtggacatttctcggacttttttttttgagatggagtctcgctctgtcgctctgttgcccaggctggagtgcagtggcgcagtcttggctcactgcaagctctgcctcccgggttcaagccattctcctgcctcagcctcccgagtagctgggactacaggcgcccgccaccacgccctgctaattttttgtatttttagtagagacagggtttcactgtgttaaccaggatggtctcgatctcctgacttcatgatccgcctgcctcagcctcccaaagtgctgggattacaggcgtgagccactgcacccagccaagactttttaagtctataactttgcattgcttttagttcatttttggaaaaataactggaaatatagagcattaaaggtaaacaaagccaaacactaattaaagtggtaaggacagattttaatcagttttaactattataatagggaaaacagtctagtgtgaactgagctcaactttgatttgtacagaagtgactgggcatttttaagggagaataagggagtggtgaggggacaaggagggcttcagtagagtcaggaaagtgaaaaattacaaagggttgatcagtataaatgcaatgaagccagctgtgtctgctcgctgaaagttgctgaagttaggattctgtctttccagagagactgggggacagaggccttatcctctggtgttgactggaacaagcaataaatttttttggcagccttgagttctctccagttctctctaaactccatattagaatttgttcaagcctctataggacaggattgaggcctagttgagaagagagctcagaggagcctggctagagttcggtcaaggaaagaatgtttgtcaattgtaaatgaataactttgcaatcccaatactcccaattttggaactttatacaatggaaataaaagcattagcaactaaagatacatgtaccaggatgtttagtgcaacactgttcatagaagtaaaaactgggaacatttcaaatattcagataatgaataaactatgatataactatactgtggagtagaatgcaactattaaaaagaataaatcaaatctatatgattgactttggagccaatatcaatggccatgatacattattaagggaaaaatcaatttacagagtaatggggttttgaaagttgcatttgaaaatagaaccccatacatatatatgtaggagatacctttttctatcctatattggattttgatacaggatagagaaagatgtgtgttatctcagtgaaatgagaatggataggaaagagggttattacatttttccttatgtatatgtctgtactattcaacttgctacagtgggcatgtattgttttttagatataattttttttttttttttgagacagagtcttgctctgtcacccaggctggagtgcaatggcgcgatctcggctcactgcaactttcacctcccgtgttcaagcaattctcctacctcagcctcctgagtagctgggactacaggcacaagccgccatgcccggctaattttttgtattataatagagacagagtttcaccttgttgcctaggctggtcttgaacccctgagctcaggcaatcagcctgcctcagcctccccaagtgctaggattatggacgtgagccaccgcacccagccagatttaagtattttataacataaatcacacacacaggagtcctgctcatcttattttataaaaggaaacaagactatgtgataatgtgagtattctggccattagtttgtaagtctaaaaggatttacaggaattcaaatacctatcaaacttcactgcttaggttgatagttttcgagtgttgcaatccatgctcctctgcattgatttctcactgccacgcgtttatttccatcaaccaagaagatttattgagctttataccactgatggtctgtattaaggaatcaacacccatccctcacttccaatcccttgcctctcaatttgagaagttttaccccaacctaaacttatctattactttttattcatgagactggcaatcacaaagatgagctttgagaagactccttttttaaattaaaacgttagggaaaactggaaatttctctaccactattttattttattttattttttgagacagtctttctctgtcacctaggctggagtgcagtggcacgatctctatttactgcagcctccatctcccgggttcaagtcattctcctgcctcagcctcctgagtagctggaattacaggtgccgtcacgacactcagctaatttttgtatttttagtagaggcggggtttcgccatgttggccaggctggtcttgaactcccaagctcaagtgatccacctgccttggcctcccaaagtgctgggattgcaggcgtgagccaatgtgcccagctcctgccactttttaaaatgcgtttctgaaagtgctttcttagtttatgccttatgatctacaaataagaaatcttgtagcaataatgttagatcctcattcctcagcagattcttactctgctatggattcccaggaagccgtaagaatattttatccaaaagttttctacacacaaagttataagtaataccgagactacagtcaaaagattgagcaaatacagtgtaagtaaatcatggtgctatttaagaaatgtatgacaaagggagtgatactccagaaaaggcgtggaataatggaaatgaggttaaaagcccaggcctcacgaggttataaccaagaggctgtgatggttgaattaaaacttgagcaaggggtttggcactaaggctggaaaacaggacttgcagttagctagctgggtttggataacctggtaattaaagtgaagagcaaaagcgattaactggaacattgacattgtttagaattatgtacaatgttgagcagatggatttggtatcaaattaacatggctattttataattacagccatgatgtaaaaattcattcatttggaaagaggaaaaaaaaacaaatgaagaaagaaagtgagcatcattctccagccagtgctagtgagctgccatgtgaacccagaacagcttagtggactcaaaaggaggcctgtgttgattgttgatttagagtgaggctgtgatgcaaagatgagaagaggcagaagaagcctagagtttgcatttgagaacaagaggatgtagaggttttttttttttgtttttctttttttttttttaagacagagtctcgctctgttggccaggctggagtacagtggtgcgatcggcacactgcaacctacacctcccgggttcaagagattctcctgcctcagcctcccaagtagctggaattacatgcagccgccaccatagcccggctagatttgtatttttagtagagatggggtttcaccatattggtcaggctggtttcaaactcctgacctcaggtgattcacccgcctcagcctcccaaagtactgggattacaggcgtgagccactgcgccggccagatgtagagtttctaactgcacttttcctgtgattctcacgaagatcaaattgcgcccccacctcatgcattaagctatcacacatttcaagaaaaagaatttaaatatttactttgtgtcatttatccctgaatcagctttgtagttctgctttgaaatagcaaactatactaatgcttgaatagaaaggaaatcataattctgaaaattctccttatagtattctctgcacactaaaatgattctcagaagaaatgcagaggttgcctcaggatttttatttatttatttatttaactataagaaactcttttcaagaatgaaaagaatcctagaatcaacagtggcatttcagaagatctagattcagattaactttaccactcatctgcgtttataggagtgagagcctcaaaaatgaatgaaacttgctgtcaaatcaaatagttttggaataaaaataattgggggagaaagctgtgtgtaagtaattatgctaaacaaggtgttttgtggcatgaacgctaaattttccttctcaggttttactgaatccagcttcagctagaaatctaggctagtttatagaagatgattagatggacagagaatgttaagagagaaacactgccataaaggtaaattcaagtgaattataataagtaaatgcatttatgctaaagctagtatgttttaaaaagtgaatgaagtttaataaaaagaaagaaaagagaagagataaaagacagggaaaagaaagagaactgaaaggggaagatgattgttaatctggaccaatttgtctggaaatttgggagtttctccaggatgctgaagaaagggggcccacagaggctggggtgtagaggcctccagcagccctcctctggtagaagctgtctgctccttcactcttttttttttttttttttttttttgagacagagtctcgcactatcgcccgggctagagtacaatggcgcaatcttggctcactgcaacctctgcctcccaggttcaagcgattctcctgcctcagcctcccaagtaagctgggattacaggtgcctgccgccacacctggctattttttttgtatttttagtagaaatgtggtttcaccatgttggccaggctggtcttgaactcctgacctcgtgatccgcctgcctcggcctcccgaagtgctgggattataggcatgagccaccgtgcccagccctttcattctttttatttgtacatgtgcatacctcattttaccatgctgtgctctattacacttcacagatactatgtttttttacaaattgaaagtttaaggcaaccctgcatcaagcaagtctactaggaccatttttccattagcatgtgttcacttcatttctcattttagtaattcttgcaatattcaaacttaataataataataattattattattattattattattattagatggagttttgctctgttgtccaggctggagtgcagtggcgctatcttggctcactgcaacctccgcctcctgggttcaagtggttctcctgtctcagactcccaagtagctgggattatagggacatgccaccacacctggctaatttttttgtattttagtagagtcggggtcttaccatgttgcccaggctggtcttgaactcctgagctcaggcaatctacccacctcagcctcccaaagcgctgggattacaggtgtgaaccaccgtgcctggtcttaaattattattatattttatatctattttggtgatctgtgatcagtgatctttttttaaaaaaaaaaaaaaagatagggtcttgctctgtcgcccaggctggagtgcagtggccaatcacagctcactgcagccttgacttcccctgctcaagtggtcctcccaccttagctacccgaatagctgggattacaggcacatgccgccacaccaagctgatttcttttcttacattttgaagagatggggtttcactatgttgcccaggttagtctcaaactcttgggccccagcaattgtcctacctaggcctctgcaagtattaaatgtgtgagccaccatacccagcctgtgatctgtgatctttgatgttactattgtaagtgttttggggcattccaaagcacacccatattggctggcaaacttaatcaataaatgctatgcatattctgactgctctacaaactggccatttccccacctctcttcctctcctcaggccttcctattccctgagacacaacagtattaaaattaggccagttaataatcttaaaatggcttctaagtgttcaagtgagagaaagagtcacaattttcttactttagatcaaaagctagacatgataaagcctagtgaggaaggtgtgctgaaagccaagcctcttgtgccaaacagccaaattgtgactacaaaggaaaagttctttaaggaaattaaaagtgctactccaatgaatacatgaatgacaagaaagcaaaacagccttattgctgatatgaagaaagttttagtggtctggacagcagatcaaaccagccacaatattcccttcagccaaagcttaatctagagcaaagtcctaattctcttcaattctcggaaggctgagagaggggaggaagccacagatgaaaaatttaaagctagcagaggtttgttgataaggcttaaggaataacactatctccataacataaaagtacaaggtggaaggccgaagagggaggatcgcttgaacccaagagtttgaggctacagtgagctatgatgacaccactgcactccagcctgggcaacagagcaagaccctgtgtcaaaaataaataaatgaacatgttattaagtaaagtacaaaatgaaatcttaagtgctgatggagaaactgcagcaagttatccacaagtgctagctaagatcattgatgaaggtagctacattatacaacagattttccacgtagttgaaccagccttaaattggaagaagatgtcatctaggactttcatagctagaaagaagtccatgtctggcttcaaagcatgaaaggacaggctgactcttgttaggggctaatgcagctggtgactttaagttgaagccaatgctcatttgccaatctgataatcctagggcccttaagaatcatgctaaatctattttgctttttctctataaatggaacaacaaagcctggataacagcacatttgtttatagcctggtatactgaatattttaaccccactgttgagacttactgctcaaaaaaaaaaaaaaaaaggaaggattccttcttactgctcattgacattgtagctggtcacccaagagctctagtgtagatgtacaaagagatgaatgttgtttttatgcctgctaacacaacatccattctgcagctcatggatcaagaagtaattccaactttcaagtcttattatttaagagacacattttgtaaggctatagctaccatagatagtgattcatctgatggatgtgaccagagtaaattgaaaggagcagaataaattgaaatccttctggaaaggattcactattctaggtgccattaggaacattcgtgattcatgggaggaggtccgattattgacattaataggagtttgaaagaagtttaccccaaccctcatggacgactttgaggggtttaagatttcagcggagggggctgggcatggtggctcaggcctgtaatcccagcaccttgggaggccgaggcggacagatcacctgaggtcaggaattcgagaccagcctgaccaacatggtgaaaccctgtctctactaaaaatacaaaaattggccgggcatggtggtgggtgcctgtagtcccagctactcaggaggctgaggcaggagaatcacttgaacctgggaggtggaggttgcaatcagctgagactgtgccattgcgctgccgtgtgggcaacaagagggaaactctgtatcaaaaaaaaaaaaaagatttcagcggaggaggtaactgcagatgcaggggaaacagacataacgctattgcacacttaacagactacagtatactataaacataagttaaaaaattttccgtgacccaggtttaattagaagaggatgagcaagtctaggaaaacttctatggctgctaagtcattctggggaggtaaatgctcagggtttgaagtcagacagacctgggtttacatccctctttgctgctcactcgttgtgggcaggctagtcaacctcacgaaaagtcatctaggggtaataatagcatctccttagatcattaccatgaggattaaatgagtgttttgcacaggtgttagcttattatatattagtaacatactaactatatatatattaataaattctacttggtattatatataataattatgattacttctatatgcctttctacatgttcctcttttctcccagagagatttcaggtactttgatgaattcctaaaggcaatgcacattgaacaccggcactatatttttttcagttattgatattggtttgtttgattcaggagctttagaggttgcaaagtctactctctgatgctttcaaaaatttttctttctttttatttgttacaggcatgtagctagcacaactcttataatgaactgactgtgactgggtgcttaccctggcccacacatagttcaaagggaagaacaagaagggtagagaaatctcccatgatttttagacaagtgttgtaagaaaaaaagagaaggtatcaaaaaagtgtatgtgtctgaaaaagagattgcacaagatagaatttactgagctggaggaatatgagagaatgttgcatacaaagtctcctaaaaggaaaggaaggcagagatgggatgagatgtggtatgtgttagtgcttcaaattaacagcaggttttgcgtcccaacttgacgcagcttgtgtggaatttggtgtagggcaaatggacccacagcttcaggagggagctgctagcaggggaagttgtactatctgacagtgcctatatgagattggtaccttttgggaatttctacctaaggcggtggctcagataggcacaaaggcccattgggacctccctgagaaacagaataagaggtgctcaggcaagaccacacttccgccctcttcctgtatccttgaaacctttcagagatttgctgtcaaatattgaccagaaagttaaagaagcaagacttgggaaaaagtgactggtttttctaatggatggtgaggctttttctttctttctttctttctttctttctttctttctttctttctttctttctttctttctttctctcttagtgtacatgatttgtttttttctctttgtgtagatgattgaagtacttaagtgtctttgtaagtccagtatctcttttcttattttaaaaagatctcattaaaaaatgaactaataaatatttattatagaaacagtagataaatgctgatgagcataaaggaggaggaaatatatgtgacccccaactcccagaaataatcactattaaaaatttgatatataatgtttcagatttttaatatattcacatattttcttagaaaaatgggattgtactgaataaacttttgtaacttttatatctcacttaatcgatgctgaatatttttccatgttactaatatgcttcaacatttttttttttttgagacggagtctcgctctgttgcccaggctggagtgcagtggcatgatctcggctcactgcaacctctgcttccgaggttcaagcgattctcctgcctcagcctcctgagtagctgggactacaggtgcacaccaccatgccgggataatttttgtatttttagtacagacagggtttcaccatgtgggccaggatggtcttgatctcctgacctcgtgatccacctgcctcggcctcccaaagtgctgggattacaggtgtgaaccactgtacccagccacttcaacattattttataattgcatagtgccatatcttatgaatatgttctaatttattcaactacttttggcacctagatgtttttctaatattttcttagtataagtaatgctgcgtgaaatatccttatacatatgcaatccatattcttttcttaggatatatttctagaacaggaactgctgagttaaagggtattcacattttaaaaagcttttgacatacattacaaaattatcttcctcctatgttgtacgatttatattctttctggtagagtatgaaggtgccattttccaaacctcctgccaacactgagaattttcgttttttcatctttgtcaagtttatagataataaattgtatcttatcgttgtttaatgtatactccttttttagggaagctgactttttcatgtgtagattggtcatttatgtttcttcccttgtgaactatttattaatatccagttgttaattgtaaatgctatttatatgttaagaccattaaccctttaccatacgtatttcacttttgaatctcattttattatttgtaggttaattttgattaccgttggattatattttacatatatgttttatattttatggtttaaatcgtgaacttttatctttatagctccttctgttgtgactgtgattgaaacgttttcaggacaaaagtatttaatcatgattaaaacaattttaagattataaaaccaatcatgtgattctcttcaagtttgtatgtgattttttttttttttttgacatggagtctcattctgttacccaggctgagtgcagtggcgcgatcttgactcactgcaacctccacctcctgggctcaagtgattctcctgcctcagcctccctagtagctgagactacagatatgggccaccatgcccagctaattttttatatttttggtagagaaggggtttcaccatgttgcccaggctggtctcaaactcctgaccttagatgatctgcccacctcggcctcccaaagtgctgggtttacaggcatgagccaccgtgctgctgtacagcgtttttatgtttaactctttagtctaacatgcttttactttgtgtatggcatgaagtaatgattgcatcttaatttttccgaatagttaatgatttaacctgtttttgaatagtttattcttttcccactgggtttaaaaaccatattgaacaaatacaataaacattttactgtagttcttctatgtgtatttctgggcttttggctctgttccattgctctagttcttttggcactagtaccaaactttaaattcacgttatttttagcctatttagtacctaatatctcccttgtggttcttttctaaaattttctttaccattctcagttttttattctttaaaataaacttgaggatttttgacctgtttgaaaaatttatttgggattttaagcaaaatttgattatatttataaattaatttgagggagaattaatatatttacaatgttaagttttccagtacagaaaaactttccaatacagaaatgtatcaaactgtttttaattttctcagtaaagttacatttttaaataggttattcactttttttattcctagaaatgttattgttgttgttgctattataaataatactataactaagaatttttttttttttttttgagatggagtctcactctgttgcccaggctggagtgcagtggcgcgatctcagctcactgcaagctccgcctgacgggttcacgccattttcctgcctcagcctcccgagtagctgggactacaggcgcccgccaccatgcccggctaattttttgtatttttagtagagacagggtttcaccgtgttagccaggatagtctcgatctcctgaccttgtgatccaccctcctcggcctcccaaagtgctgggattatgggtgtgagccaccacgcccggccaagaattattttctattatgttttctaagtttttgtgggttatatggaaaatttcatatatttctgtataattgttccgtggccagaacaattaattttgtatacttattttgtatatttatttgtaactgttcacctcactttttaattatttagaagcaaattttagtttgttctattgagaaaatgaatattactcaatctgcaggttgaatacttttgtctccatttttctcataaaattcttctttagtttctttttcttgcctggttgcagtggctcaaatgtctagaacagtgttaaatggatggtagtgataatgagcatgcttttcttgtttctgattttaacattaatacttccagtattttaccattaagtatgatgcctatgtttgatttgagatttgaattaacatgagtatcatgttaagaatcagtcttttaattttgttttattaattaaaaaattgatattgaattttatcaaatgatttttcaagattattgtggcaatccaaaagtttttctctgttgcccagtctggagtgcagtggtgtgatcataccttactgcagctttgatcccctaggctcaagtgatcctcctgcctcatcctcccaggttggtaggactataggcatctgccatcacactgggctatttttttttttttttttttttgtagagatggagtctcgctatgttgcccctgctgatctcaaactcctggcttcaggtgatcctgccaccttggcctcccaaagcactggggttacaggggtgagccactattcccagccttattttttacatctttagggcaacctatgtttacgtatgaagttagtctgtggttttctttattatgctttatcagtttttttttttaagacagggtattatgttagctttctgttacttttgtccacttgaacacttcatataccatgggagttaattctgcttgaagctcagttagaacttgattgtgtaagtaatctgaactaagagctttttttggaaataattccttattaacttttacatttttccatggttactgatctgttgttttttgacttcttcctgggtcagtttgcttctaattattattttggctatgtctcccaatatttgatatgtggtattctcatcactgaaaccttctaagcattcattctgtaattgtgtttttaatttattctccaatcaatgatttttttttttaagaactctaaagtttccccaagagcgtggggtctttttgacttacacttttgtaattaatgtatagttttattacagtgtgatcacagaatatggccaatttcttttggaaagaaattacttacaatttttttttggtagcctaatataaaatcaagttttgcaaacttttcttatatttttttcttaatgggctagacagaagatccttctctttaattattcatttattcatcgaggattgtttccaccatgtgtctcatacatgccaggcattgtattaggcattgcaggatataaaataagtcataagctttgtcttagattggtaaagtttggatggaacacagacacatgtagacctaattataatacagaaagaaatgcaaccgcagcgaaatgtacaaaagcagcaggcagctagagtgggagtgaagccctgaaggttctgggaatacaaagttgcctacgatggcccggaggggctttcagtcctagcgtgtaaaacatacattgagatcagagacaggctttttggaggcaaggtgattaattaggaaatcaccgcagaccttcagtaataaatcagaacatatgaggggcggtaagagtgcaagatgagaagagaggattttcacacctaaggggcagatagcggaagagaagcccagacctgaggatgaaggaggtagtagtaaaattttatagacgccatgggagagcttttcaaggggtggttggtcagttgggacaaatagagccaaaaggtcaagtaagatggctcacgcctgtaatcccagcactttgggaggctgaggcgggcagatcacgaggtcaggtgttcgggaccatcctggccaacatggtgaaaccccgtctctactaaaaacatgaaaattgccgggcgcggtgggtcacgcctataatcccagcactttggtgacagagcaagactccgtctcaaaaaaaaaaaaaaaaaagcaaaaagtgtcggttgcctttggtctttggggacttggaaagagcagtttcagtgaagtgagggaaaaaaagccaagccacaagtaggttgagagtaaatgggatgtgagatggtgaagacaagtattttttcaggagtttagttgtggagggaatgcaggagttagggcagtaattaaaagagcaagtctggctgggggcagtggctcacgcctgtaatcccagcactttgggaggccaaggtgggcagatcatgaggtcaggagatggagaccatcctggctaacatggtgaaaccccatgttactactaaaaatacatgtctctactaaaaatacaaaaaattagctgggcgtggtggcgggtgcctatagtcccagctactcaggaggctgaggcaggagaatggcttgaacctgggagacggagcttgcagtgagccgagatcgcgccaccacactccagcctgggcaacacagtgagactccgtctcaaaaaaaaaagcaaaaaatcagaaagactgttgttaggatataaagacaatgtgagaacgtgagcatgtttagctaatgagcgcacgctgagagcaagagaaggcgtggttgttgtcgagagtcctaagcaggtgggagacacagggtgagacacaaagccgaggtaggaggtggcctcttgacaggaagagggcacctcttcttgagtcgaagacaatgcttggaactggtagggagtgtgggcagaaagatgggatctcccccatttctttgcaaggctgtgttattgtagaacctttagtcacactcctggactctgactgaaagggtcctgggtcttggcctctgtgttaacagtttgcttcatagggaggattgaggatccatcccttcctctcctggctatagaactagaaaagaacctctacaccagtggtccctaatgtatttggcaccagggaccagtttcatggaagacaatttttccatggaccgggaatgaggggatggagatgatttcaggatgaaactgttccacctcagatcatcaggcattagactctcataaggagcatgcagtgtagatccctcgcgtgcacagttcacaatagtgttcatgctcctatgggaatctaatgccacagctgatctgacaggaggcagagctcagatggtcatgctcccttgactgctgctcacctcctgctgtgcagcctggcctctaacagaccatggacaggtacctgtccatggcatgggggctggggactcctgctttacacttatgatgtagtttggatgttgtgcccacccaaatctcatgttgagatgtaatttccagtgttggaggtggagcctggtgggaagtgattggatcttaggggcagatttctcattaatggtttggtaccatcctgttagtgctgttctcatgatagtgagtgagttcttttatttatttgtttattttaagacagagtctcactctgttgcccaggctggagtgcagtgcagtggtgcggtcttgatcttggctcactgcaacctctgcctcccaggttcaagcacaccaccacgcccggctaatttttgtatttttagtagagacagggttttgccatgttggccaggctggtctcaaactcctgacctcaggtgattcaccctcctcagcctcccaaagtgctgggattataggcatgagccacaacacccagctgatagtgagttctggcaagcgctggtcatttagaagtgccccctgtctgtcttgctgctgctctggccatgtgactcatctgctcccactttgccttccaccatgattgtaagtttcacgaggcctccccagaagccgaacagatgccagtatcatgcttcctccatagcctgcagaaccatgaaccaattaaacctcttttctttataaattacccagtctcaagtatttatagcaatgcaagaatggactaatacaacttaactttcctgaggctgttgtcgctgttgggcattgaagagtttctagaagtccctgtttctttatgtggcatgcaatggatcatcagaataattaacccagtcaatggtaaacaaagtgatggatggatgccatcagatcacaaaagtttctattactgtaaatacaagggggtaagtaaatcaaaataatgtttcaaatcctcagtaggcctctttttctgtttctaattgaagattgtcacatcaacacataaacaaaaatgcctgtgagggaaatgtgtattttatgcattgcatttttatatctgaagtttatttctattactaacttgaaatgctgaggaagggatttgttttggtgcttacaaaattctcccatttgctcttcggactctcacaagttgacaacaaattactgccctgatagtatggtgagactgagggttttttgtctttttctcttattctagaaaacactgtatcctctatatggagggaaatttctggtttgattaacactgtaaataattatgagacaaagcctaaatataaaagattactcacacaggctcttacactgagtaagatattatgtgttaaaaatcagggttaatagtttaacaggcacattatggttcagaaatcccctgggggacttcaaccatcttttctggatgttcactttgccaaataggctgcctctatgtcatatctctacctgaagggcaggctcagacactgattcggggaagtgtcacccttactataccaagaagtcagacatccaaggtcagacactacgtaaagtcagatacttcaagggctttccttggaagggaggatgaaaagggaagggtgggaacatcagctcaggtgagacatatgaattcaacaaaacatcagggatggtttgccacgtttgcgagcagcacagaaaacggcagtttgctccaagttcccagcacaccaaagggggcagtagtgcgtctgtaaagcgcgttgtcaacttggtgataatttctgtttgcattcacactcgccggctgataatctcagctgctcgatgcaattcaacagataacaatgcggaagtttggtctaaagctacctgaaatcacttccaagagctcttcagataaagctgcctttgatagtcttcattaacccctcccatatttgcccctcagcgtcccttggcttagcagccccggcctttgaagtccaacctaagcattcttagatggtgagtgagggtctgccttccccagcaccagccacctagtcaggcttgtggctcgtctaacaaactggagcctgagattctgagaaaacgaaaccaaacagttgtactccggggttaacacagagcaacttccacctgctgtgcgagttggtgatcctctctcttgccgttcgagagccccagtgaaacttgagtgagatgagagagcatggagcctgccagtctccccctctgcgcacacacacacgcaaacacatttaactttccacttgcagtgacctgcccttcagtgtgacttatcagctgtttggcttttgtcactaaaggaaaacaaattgtggaatatcccgctctgcatgctcatgagatggctgagccaactcaggggttatgaggtggtttgcgagtgaggagaagaatgatcttcagtttctgacctcctggcacggtggcgggcggtatttatcaggaggtacatgtgactggttaagactcagagccccagcttgaaggaaacagctgctctcggcgtgctccggcacttggcagctggacaggcagagtgctgatgtgaaaaataccacgacaaaaccaccctagtaagtaactggagaactttcctctctctctctctctttcattccctctccgtgtgtgtgtgtgtgtgtgtgtgtgtgtgtgtgtgtgttgcaagccaccaacaacttttgattttgattttggtttccctctggcacgatagaaggagatattttatttgtacctgttaacagccattggtgttttcacagcccttttttagaacctgttattttcggcaacgtgtcttgtaactttgaggatgaatggggcatatggcttcattcctgtctaggaaacagaaagtttgtttcccagtgttcaagatttttctagtccatggtgtttaggttcaaagtcaagttcaggttatgaagtagagacttcattgaagtgagttgatgactagatttgattttaatctgtttctaccactgaaacctgaaaacgtagttgtttaaagtaacttgtgaatttattgtatggctgatttgatttttcctattcaatttttgagaatatctcatttaactgtgtagaactgtctgcaatatagaagactgacaaaataatatttagattcacattagaaatcatatttagatttcttgcatggtttccaactaattgaaagctgtattttatagcgactttttttccccccaacaagctaattcaccttcattactttaaaatgttcagttgcccctggtcttccttcaccttcattactttaaaatgttcggttgccgctggtcttccttattttagtgttttcgtgatactcaggctgttttttccttgtttatgacctgactgggaaagtgctgcctgcagctgatgattaactctgggaggcctggcatccaaattacggagagaaccggctccttctcaggttcattcagcagtaatggtgcttgcgcttgggcgagcagcaaagcaggcaccatgctggaactgagctgttgttcggtgacttttgtccttccttggtagtcaccagacagaatgcttcagaggaaaggcaaaaggggaaaagagagagggcagagctctaaactgatgacgtaaagctctgaaagtgacaggtctttgaatcagaggctgcagggagataaccaaacaggttcctgtttctggagatcgcgtggatcttgaggagggtgggcagagaggggctgtttttatttgaagtctcaccaaatagttgttttgcttgtgataagcctaggacaacctggagtgcgcttgtttcctcgtgtgacaaatggattctcatacaggctcaagctatacggttttctttcgccctctgccccctgccatgagggaacactgttctctccccacccttaccatcctttgttgtttgtggagaatggattaaaaatgacccagggcacggcacttctgcgatcgagtttccctcagcacagtgggtcttgagtaccgcaccaaccaatgttctctgatggaagcagtttcggatgccctgtctaaacaaatggctagtctgacattgagaagttctccaccttcttttccttcaaatgtagaagaatccacaaaatgtagagtggccaatgaggaaaaatagtcccaacttctctgttcctcggtatggcatttgtgtgaggtccttgggtcagcccgcggccatgtggtctgtgacttccctgtctgactgctgggggagggggttcctcctgagtcattctttagggagtttgttcctggtatagtttcagattttccacaggttgatagtggaagagaaccctctggtgaaattgtgtctccggaatcatcgagcctcccataataaaatggaatgtctaaatgggagcagttgaattatccaactgctgtatttttgagagccaacaggctcctttgaaaaacccatgccttttcaaaatattaatagcaaaataataaaaaataatgattttacttgcagatagtacatccattgactcaaagactttttgacctggataggaatgatagaatgtgcgatttaactctttcgtatcaaagatgaggaaactgtagcaaatttatcggagttacggtgcagagccagaagagagagctcaaggcttccatcataatttcaacgctaataacaatcccttacttttattgtgcacttactctgccaaatgatgcgctaaacaagtgtatttattttcatagtctcctcacaataactctatgtgttacatattattattccagttctatagataggaaactgaggttcttgaccatacgtaacacagacaggagggacacccttagttacttgaccatatgtaacacagacaggagggacacctggatctgactgtagaacctgtatacattaaaaaataaaagtggaatcccacacatttaaatgtaaaaactcacaacatgcaaatgagagtatttccagcacaatatgattacacacacaatgtgtgttatgcccttttcgagctctccatgacaggaagggctaggtttccccctgtgacagtccaagcccaagctctctctataggatcgctggctggtggcatgtttttctctttgaaaatagttcagtgacggtcttgatgttggtaagaacagcaaccgggaactttgttattaacctccagcacacggctcccatgccccttctggcctttccctccagttttcctgtcactcctttcctttggaggacagccactccacccatgccccaccccaaatagctggcttagtgttgataaagctattatcagacccatcccctttgctcagcctggaaggttggttgtccgagtaggttgttgatgaatagaaaccatgcactctgccactctgcgctgtttttttgagctgtgggtgtaaggggtgggtcacggggcaggggactagctggcagtggtgagggaggagaggtatgcttttcttcactgcctgcacctgccatttaccctgagtcctacttctccacacaccagttgcatatctaaagctctgactgtctcacgggtgggccataaacctgtggattttctgggtcatcagacttgcagagcccttaagaaacctgcctcctgaatccttttaaaaatgtcatttggctgtccacattcctccactttaggttaagtgtcaaaattagggttggagataatgggaaagagcaccaggtagtatgtaatcaacagggaaccttttattaatcaggaggaaaatcaagcaagtatgccatgtgtggatgtttctgaggaagttatcagtgtttctgcaaggtcgttctggcaagattacacattttgaagatcaagctatttatagcatgaaagaggaattttttttttttttttttttgagacagtctcgctctgtcgcccaggctggagtgcagtggtgagatctcggctcactgcaagctccgcctccaggattcacaccattctcctgcctcagcctcctgagtagctgggactacaggcgcccgccaccatgcccggctaatttttttgtatttttagtagagacggggtttcactgtgttagccaggatgctctcgatctcctgacctggtgatccacccgcctcggcctcccaaagtgctgggattacaggcgtgagccactgcgcccagcccgcatgaaagaagaatttttaatctttaattccacctgcctgctgcctctaaaactaagcccaactcagtagtagtcagtgatgtggtttgctagaccaaaaccactgggaattgcctccaatccttgctaggaattgctcacttctgtagaaattggctttgtacagggggtgttatatgggtacacgtgaagtggactcagaatcacgacagagtccacaagtcatactctggagctgatttgaaagaaaataaaatgcttgattcgttttggggtccttttacaataaggaaacacattctgggatacaatgcctattttgtttctttgtttttgcccaattgtgtgtttcaaagacatctgcttccaaaaagttaactttcctggatcctcctttcccttggtattgattgctcacttatagtccctggagttaacagctcctgtgtcatgtttccactgctctatgggatttgaagtctttggatttttttgctgtttcaagtgattattatagcttcagagtctgtggtgtgcagagtcgctgtgctttgatctttgagctcatctttggtattgagaagtcgaacccctgcatttatatatgccggcataaggcactttcttgtaccttgccataatcccatgaaagagggagggtatcatcaccattgttttcaaagaggaaatagaggacgagagaaaatgagtgacttgtctatggtcatgggaaaagtaactgtcagagctcaactatatctcttgtctactgactccaagtgccaggctttttctgttggttatgctatctttcttttgttttgtttttgtttttcagatggagtttcactctgtcgcccaggctggagtgcagtggcacgatctcggctcactgcaagctccgcctcccgggttcacaccattcttctgcctcagcctcccgagtagctgggactacaggtgcccaccaccacgcctggctaatttttttgtatttttaatagagacggggtttcatcatgttagcaggatggtctcgatctcctgacctggtgatccacccacctcggcctcccaaagtgctgggattacaggcatgagccactgcgcctggcctagttatgctatctttcaaagaaagaccaatttcaactatttcatgaccatgcacttacacaatctgtggaattatctttggtgataaaaagttgtgtaatttgtattctcttcagataggcaaagagtgactggataaccgatttgcgacatgccactcatgatatttccaaagcctatggacatttgactttggaaacagggtcagcttagtcttcagacaccgtatttgcttaggataattttgtttgtttgttttttcagacagagtcccactctgtcacccaagctggagtgcagtggcacaatcttggctcactgcaacctctgcctcccaggttcaagcgattctcttgcctcagcctcctgagtagctgggactacaggcgtgcaccaccacacccagctaatttttgtgtttttagtagagatgggttttcaccatgttggccaggctggtctcgaactcctgacctcaggtgatccacccaccttggcttcccaaagtgctgggattataggcatgagccactgtgcctggctagcttagggtaatattttttttttttttgagatggagtctcgctttgtcgcccaggctggagtgcagtggcacaatctcggctcactgcaagctccgcctcccaggttcatgccattctcctgcctcagcctcccgagtagctgggactataggcgcccgccaccatgccgggctaatttttttgtatttttagtagagacagggtttcactgtgttagccaggatggtctcgatttcctgacctcgtgatctgcccgcctgggcctcccaaagtgcttggattagaggcgtgagccaccgtgccgggccgcagcttagggtaatgtttttaaaggaacttagtgatcatttttctgtcttgaagactcatatagtcaagttggagttataccaactatggcatgatgtaacgttaccttttagagacaatttggttgtttcctgaggtatgaaaactgcagtctgctcttcagtgtgcacgctccttgcccaacaaaaccatcggcattcttgaaagttctgcctgagtatagcacctttattcctgtggaggtatagtgcattctaactaccatgaatagtgtccactgtgatcatttccctctgcacgattatctgcccacaactgagagagtcttaacttgctagaataatggggacgcttcactatctgtcagtttcccaatatggcaattcagttcattgtatgacagcatcatcagaatgttgccaagatcataaaaatagcagtgcatgttgcctgatgattttacagtgcatattgtcatggccagggcttagaggtaggggaaaaacatgtggacagctttgtgacaagagtctctcttatagtgtttctttctaaagtaactttttctgagtatgaatgtgaaaggtagccttctttgaattaaaaaatattctgaaaaatgtttaatgtctgagctgacttgagcatttttctttagtgattactgtaataatcagaaatttcttcacctttcaagaggacaaaagggaacaactataattaaaaaaaaaaaagaatatgaaatagtaagttaaaagtataccttcctggattatggtctatagaatgtagggtaatagaaaccttgatgcccctattgtaaatggagaattcaactcaatgtataaatgatttctgtgcttgtagatatcccatcttttaagtttctatttgaatagattggtaattttatttcctgaagtcttctctatttgtcaaatgctgccttatctttgttggttcaggtggatcgatctccaccccacaataggttctaagccccttggaaagatcattatgccgttgatttgctaaagtattataagtgttctcagagtttcaactcttagtatgttccaggtgcaactttgacagagaactagtaacatagggaaaaaatatggaaaaaaattaaattcatatctaatcccagaggcatgttttagccactattttttttttttttttttttgagacggattctcactttgtcacccaggctggagtgcagtggcacaatcttagctcactgccacctccatctcccgggttcaagtgattctcctgcctcagcctcctgagtagctgcgactataggcacctgccaccatgcctggctaatttttgtatttttaggagagacggggttttgccatgttgatcaggctggtcttgaattcctgaccttaagtgatccgcctgcctcggcctcccaaagtgctgggattacaggtgtgagccactgcgcccggcctagtcactacttttctgttgttgaattgtttcaaaatcacagacaaataaccacatttgagtgtatgtatgcagttttaattgcttgtccttttcccatctggggtgtttgtactatgctagagaccttaatagttaatgaattgaccaaaaggaggagcgacaagctatggaagaactcagacagagaggtgatcaatctgtgatggaatcagactccattaaaaaaaaaattggcttagtcacttctctgttttgttttgagaaagtaaaaatttcccctccatccagcaattcaaatttggctgaaccaagtttccttggagtcttttacctaaattaactttgggaagataccaggaggaattctttcctaggaatgtgcacacatgggttgcttttcagaactccctagacctggaatgaaaggagtaaagaagaaatgtccttttctggccacactctaacaacttgcttgtgactatcagggatgaatctcttcaagtctcaagttaatatagatttctggagctcataaactactcaagaattttaaacagttttaaataagaattgggtataatctccatatttggttctggaaaactcataccatgagttcaatttgactgaactttgaattctgctcagctttcagttctgttttttaaaagtagaaagtattccacttatgcatggaatgcttgccgttcaaaatcatatgagttgacacgatgctttagagatcattttttttttttatggtaaggacagcacccagtctgaatggtggtgctggagatttctctgtaatccatttctctccccagtcactcttgattctgaaattaatccatctctttctactttccttctcttctaggcatttaaattgtgtctgctattgagagaggaaataaaataacgcttattttcacatcactcagaggtagacagattagcactcttgcagaagagaaaaataaattttagagaagtcatataccttgtagaaggtcacaagccagtgagtaagagtctagtcctagtctgcctggaaacaaagtaggtgcctttttcatccaatcacactgtctctcactatgtctgtgttaaaactgatgcccttggccgggtgcagtggctcacacctgtaatcccagcactttgggaggctgaggcaggtggatcacctgaggtcgggagtttgagaacagcctgaccaacaaggagaaacccagtctctactaaaaatacaaaattagccaagtgtggtggtgcatgcctataatcccaactacttggaaggctgaggcaggaaaatcacttgaacccaggaggcagaggttgcgatgagcctagattgcgccattgcactccagcctgggcaacaagagtgaaactctgtctcaaaacaacaacaaaactctatgaaaagggaagccattctgtggaggtgagattctgctgtccttgtcatgcaattgacattatgtcattgtcatgcctaatacatacccatttctattagaaggatgctgtaggacaaagaaatatccctggactctggatttgtgattgcaccctgcagtcttcttttagcttctacccagaacacactcagtttttattattgaggtgttctctcaactgtgctgccctgcatctttggcagggtgctactgcagagctaagcctttggcaacacccaaaaatcattatgctatctcagatggtgacaggtatgaaaaagatcttgactgttggactagctgattaactagcagtgacagtttgctttaaaatatatttggtttttataagaagtgacataatattggcaccaagagggacaatcatattcattcccatgaaatgtttcttggggccatgattacagatagataaaagggccaagcagaccttgaagcagaaccagtgtaaaatatctcgtgctattttaattctttatgtttttagaaggaatattgctttcaacctctctttggaatttgcgggaactttggttgacttaagccaatgatggtggatttattatgtaagaattgaaggtttgtctttttcagctacaaagatggctgagacatgtgtcatgcataaaattctgcaactatttggaacaccatctcacatctaacttgtggaagagaggctaatatatttggaaaattgttttgagctttaatcgccagttttagaaatttttctcaaccaaaacttcaggaagtacagtctagtagaatacaggatttccatgtaggtaacaaaagtaagggacaacatccagaacatattttcatacaagatgattcacttggtatttcttttcttttcttttctttctttcttttatttattttttttttttttgagagagagagagtctcactctgtcacctagtctggggtatagtggcacaatcttggctcactgctacctctgtctcctagttcaagcgattctcctgcctcagcctcctgagtaactgggattacaggtgcccaccaccaaacccagctaatttttgtattttgttttagtagagatggggttttgccatattggccaggctggtcttgaactcctgacctcaagtgatctgcccacctcggcctcccaaagtgttgggattacagctgtgagccactgctcctggcctcacttggtatttctaaacatatgctttgtgctgcttattgcacaaacatgaagaatatagaatttatcccataggattttactgtttagttaaatagaccaatatttttaaaaggttacaataatcatcttacaatacataaatgtatattctgtaaaagagaatgtttccaaaatattctgtgggaattcagagaaaggagataactaactatatcaggatgaaccagggatgattcccttgggttggtgacatttaagctgggtataaaaggataaaaagtcattgttcaagaagaaaaagactatatttgaaacagtgcattccaggactaatgtgtaacttgatagagctgaatcatagattacatgttggaagagggacgggagaaaaggagcaaagataaggtggttctgggtggttaacagtagtgtttgcccttctgaagcatgtcggtatttttgagaaccgatttatatatggcaaatttcaaccatatataaaaatagacaaaataaatgataattaacccccatttattatctaactttaacaattttcaattcatggtcattcttatttaatttatatatccctaccgatgttctccccttcccatattagctttgaagtaaatcccagatatttcatcattccatccgtaaatattttagtatgtgtttctaaaagataagttctcttaaaaagttcacaacgtcattcagacatgcaaaataattaataataattcttaactattattgtagtttgtcaagtagagggatgacatgaatacatttgcattctggaaaaaaatttctgaaggcaataaggacgacagatcagagaaagaaaaataccaaataccaaaagaagacttcaaagataggtttgaacaaagacaatgataatagagagggtggaagaattttcaaaatgtttaaaaggtaaagttgatagttcttgagattaattgtatttgggtgtgcaggaaaggagggagttaaagaagttttggaggttttaatttgaataatcagcatatgaatatgccattaacctatatagggaaaggattccttgaaaagcagttagcctggttcagcattatacagagactacaggaaacaaatcaaaaaatatcttcctattaccctcaaacaaaagtttgagatttccacctgtagtcctagctacttggaaggctgaggcaggaggattgctggagtccagaagtttgaagccagtttgggcaacatagtgagacctcatctccagaaaacaacaaaactttgagactcagagcatttggaataattctgattgctgcaccttaagaaagccattaatgccagccatggtggctcatgcttgtaattctagcgctttgagaggctgaagcaggaggatcacttgagctcgggaattctgagaccagcctgggcaacatagttgcagacagcagtacacttcattcctaaacatttcatcacgtatatatgtatattaccaactagagttagttattgcagaatttatatttcacacaagagagattaaacttatacatttattttctcaatgggaaaagccgtgattcaagaaagattaacacaattcatggctgattcttactcgattatttatgaaagcaagaaactgagaacctcttgattttcaaaagttgttgccatacagagcagccacatcctactacaaaacagcctttgagtaactatcaagtattgtcctggcaaagcacgtttctctcaataagtgttaattgaatttgaatgtaaagaaactgacacctagaaatgcaagctttttgccagtaactgacagagctggtactagaacaaattacttctaatagtttctcactgagcatcactccttacctctaacaactctgaatagtaataatggaacacagaagatgctttattagtaaaaaggtaatgctttctatatcaagtcattgtgagattgctcaaggctcaatgggaccaagtagctgggccgtaggaaaggaggtaaaatgctctcacaaaaaaagaactctccatacacaatggaaaaaaaatgcctgtgttcatatttatcctctgacttcctccagaagaggattaaagcagctgatgacaaaaagcaaaaataaaacacaactgaaaatgattaacacaggaataaaacaagggccaaaatccaccagttagtcaggcggggaatacatttggacctagaaagctttaaaatgttctcaattatgtcaaattctgacatgttaaatcttgctgattggttcaagaattaaaaatcaagttgagatgatgtctaaaagacatgttcattcaaatgttttttgttgatgaagatatcgagtattcatttggaaactgaaaaactcagtcaaatagccaggcatttgcctacacaagaaacagacattctgatactagaaaagattttaggggtttgaccgattttttttttttctggtttccattttgatgttatggcatcagtctatatcagtggttctcaactgagagtgattttgccttccgaaggacatttggcaatgtctggggacatttttggtagtctctactgggagtggcagtggagtattactggcatctagttagtagagaccaacgatgctgctaaacatcccaaaatgctcacgacagccctgcatgacaatcaattatccaaccaaatatgtcaatagtaccaaggttgagaaatcctgatctatgtgaaacaattaaaaatctcacgcaaacatgccttcaaagacactttagatgagttacatgcaacatttttgcttgtctgctgctgagcagtaagtgatgatggcctaatacacttgcagaaatactgctgcatcggcgtcagggtggagatgagatgtcaaatggccagtccttcagaatgaaaagccaagttgaatggttcacaacacaggctgacagcactctttggtgtccaaaagatcaaatgttggcaggcaaggatactgatatttagtcagcagaaaatattcaaagcaatgagggacacattgttgtttcttttgtgggttttatttttattttttatttttttggcaagatctggctctattgcccaggctggagtgcagtggtggaatctcagctcactgtgacctctctgcctcccaagttgctgggactataggcaggcaccaccacacccaactaatttttgtatcatttgtagagaagggggtttcaccatgttggccagactggtcttgaacttgtgagctcaagcactcctcctgcctcagcctccccatgtgctgggattacaggtgtgagccactgctcccagttgacagattgttgatgaggacagaacaagggatctttaggtcataagtcatgggacagttgatcctgggacttgggaagttcatttctctgtttctggcttttttcatcttcaaaaactcaggaaaagagaactgagggcatcagagcaggctgatttgatacactcttgctgccaacctgatgactgtatatctctatgatttatgtgattctttctcatgttccctttactaattataactattatccatgtttgtaaccatgttcttcttccttctttcatattataactggaacccattctcttccctttggttatcttctcttccttctgagttttcagcttcctctactatgttctcctcatcagtgcatcggtctgcttcagtaactctcatcttttaaaaatatcctttgcttgccacaacctctgccaacttctcttcactgcaattctaaacaaacttgttgagctcatattctacacacgttttctttgtttctttacctctcatttactcttgcactcacaccaaactagcctctgcccacagttctgtaaaactacctttgtcaaggtcaccagtgacctccttgtgttaaattctaaaaaagcagatcatttctctttctcctcttatttaactttgcagtagcattcaacatgattgacagcttcagcttccattctatccctggcctcatggcacagcgtgcttttaagttttccttctctttctctgacaggagctcctcaagatgctttgctgctcctcctcccctctctgacctctagatgttggaaagcccaaggcttaagagtgggtcctcttgtccttcctctttatactttcttccagagcgatctgagccattgccatggcgctaaatgctgcttacctggtgataaatcccaattgtaaattgcatctcagatctttccctggagctccaaattgtatatgtaactgcaactcaagatccacacatagagtttctcatctggcctgtttagttcactgccggatacccaggccctggcataatgtctggaaggtagagacgtatttgttgagccagtaaagaatgatttggatactgggcctaaaacagatacatttttttctgtgacaaggtaagagttagctgcttttgttgtcagagttacacttttattagattaaaagataacatttagagcaggcacggtggttcatgcctgtaatcccagcactttgggaggccgaggcaggcggattgcttgaggccgggagtttgagaccagcctggccaacatagggaaacctcgtctctactaaaaatacaaaaattagctggtgtggtggtgcattgcctattgtcccagctatttggggggctgaggcaggagactcacttgaacctgggaggcagaggttgcagtgagccgagatcgtgccactacactccagcctggggcaacagagtgagactgtgtctcaaaaaaattaaaaataaaaaaagtaaaacttaattgtcacccagaaaaaaaaaagaaacaagatactgtttaataactgcttactggttgatggatagattgattaatcaattggaaatgtattaatacttaatctttttgtattccaacttatttatttataacatagaaataatgctattatttgccaaatcattttaaaggacaaaggtaattgctttttaatatcctgtggagaaagacattaactacatacaaaattgcacacaagatggtgtagagattgcatgtattatcagtttccttagtctggagactgcattgcgtttgcatctgaactcttgtggtttgtgagccaacaaaatatcatcagtcctcattgttataagttttatttgaaagctaccattggatagtgtttttgtgatgtggctagaattatataattgtctatgcagcctcgcagccatctctcagctgccctgcactgagaggtgccaggtgaggctggtggacagcacagcacagcagcccgtggctgaggcttaggctagggcacaatggactttctggcatctggccaaggtgctgaagggtaacgggggtgaacaaagtggagtaggaagcaacttcatgggcaggagtcaggagtagtagttctagacctggacaggatcataggtacttctgcaaaagagaaaacctgttttcagaattgaatgttcagcctgaggttgctcatggaatcttgggaggagatgaaaatttcagtatcttaaatttttgtgactccaaacaactgatggtgagaatcaggaggtgaagttatttttcctctccttttgcattgggcaagtccatttgctttaaggtaataaaaaatgacatcgagtggtagaaactcaggaattttgatttccctttgtcttcttcagaaatcctctggggcaattgacctttgtgtgtttgagtaaaggttatgaaacttttattacagacctgcttcgagcccccaaggaaggctatgggcctttatcctagaaagaagcccatggacacaaatacacaaaattctgtgtgtgatttcaggattgtatagatctccagtccttggttgagagcctagatgtggactgaattttgtaccccccagcatccatatgttgaagctctaacccccaatatgactgtgtttgaagatagagcctataaggaggtaattacggttaaacaaggtcacaagagtggggctgtaatttctgatagggctggtgtccttataagaggaagggacaccaggcttctctttctgtgccatgtgagaacacaggaagaaggtggccatctgcaagccagaaagagagtcctcacagggacttctcagcctccagagctgtgagaaataaatttctgttatttaagccatccagtctgtggtgttttgttataccagcttgttaagacaggcctctaccctggaagctgccctggcccgtaatgtagctgtgctcatgcttaccgatccatggaggcatcaggatggggaggggaacattctagtgagcaaatgttctggggacatgtatgggagccttggtgcaccgaagtaggtcagccagtagtaccacgcctggctcgctctgcccaggcttcatgagtctgcagtgacagggtgaagtataaaggtcatccagaagaatgatgtgccatcatgctgagtgtgtacctcttctttaggtgttcatttcactgggcaggttgtctaccagaaccaaggggcctctttgaattttctttcaagctattaataagaggcatgcatcctcctagacacaatcatccatttagtaaaataggtaagtatctccccatggctaaaattggagctacctgagccctaaacaactgacaatgtgggaagcatttgctccagacgaatccacttatcccatccctatccttcttgagaaagctgccattgtctgatgtgggtagaatctggggacaacaacagtgagaggtgcggtatgcagactagctggtccaacacctgggagagcaggggcagagtccctagtggtgctgtcagagtgagtctggactgggcagaggagtacttgaaagtcttttctggaagagttaaaaagagaagccaaggtttgagtggctaaaagaaaccagcaaaatctgtgggattcaatgtgacaggagtaaatgaacagtgtcaggacccaagtgttggagccagagaaccaatggtttgtgccaagacccatttagagttcccagctccaccttctcaagcttacctccaccaagtcaccttcacccatctcacagacatccagacctgcttgagatgcccggcacccaacagccagggattagagctttttattgaaatccctgctatcattttagaccaagttcctgaatgaataaaaaaaaaaatcttttgacaaggagagatgatcagattgaaataatctttacaaaattaaaaaaaataggtgccctcaaaatcagaccagtgagaagaaattccatgactggtgatagcatatagctgtttcatttctccgtatcaaaatggccaaagggtggcttcgtgtcagaagacccagatgtttttaaagcaaatgcattagttcaaaatcagcctactgcctcatatactttttatgtcttagagaccccagtatgagtctggattctatagaagctcactatgatggaatattttcctttcttttactaactcactatttacaacttaggcaaatcaccttatcattttggccttggggctctcctttatagaatgaggtagttaaactggcaactaagtaaaaaaatccccttgaaaagtggacatattctgtgtcgcctactagcacaacctctttctctgttggagctacggttttctctgagtagactaaaaacactatcagaagacgtgaatgaccaagatgatgaaaccaggtgcttagagaccaaggctcgcagctgcactgatcagtaaataacgcttccctggtttctggttttcctttttagagtaataaacaacaacaaaagtagagtaccggttcaacttgtgtagtcactaattatacaagtgactcattctaagggctagaaattatcctacaggaaattatcccaaagggtctaccgtgatgaatatctgtgatttccttgagtctgacatggaaaagtaagctgtgactcgtagtcaacaaatccaaaccaacctagagaggaagtgggagagagtgaaactatatactcactatagtgtgtggaatctgaaaatgtttgcctctaagcacgaataggtacatatttttttctcaggtagcccaacgtacattctagtttctctaaatctttacaaagtaaagtattgagggggcattggcacccagtcccatgctctttagaaatcattaatgactattttgctgattttgagaactttttctattaatataaaagaataaaccagaaatctgaggaaactctaaaacttgaaggcaatctagacatttagaggatattacaagtggaaataaatactaatgtcttagactaaccaagcttgacaaatgctgcagaaatctccaaatttactttcttgttcaggcaagaggtgaaatttgtcttgcaatttgaaattacgtttagagtaaacatgtgtcagaaggcttaagtaagcatagtaactgtcttgtcattcttccttgtccactccacaaacagtaacattccaaagatctgcactttgaaagatcctccttagcttttgcatctgtggtgtcagtaggtagcccagtgagtctgaggtagggcttgtaagtgcagatgtctacagcagcaatccctaacacttttggcacaagggacagatttcgtggaagactgtttttccacagacagggcaggggctgggggttgggaagatggtttggggatgaaactgttccacctcagatcatcaggcagtaattcgattttcataaggagcatataacttagattcattgtttgtgtagttcacaatagggtttgtggtcctgtgagaatctaacgccgcagctcatctgacaggagggagagctcaggcagtaatgttccctcacccgcattcacctcctgccgggcagcttggttcctaacaggccatggaccaggccatggcccaggggttggggacccctggtttacaggaccaggaagatattataatgatgtaatgagtgaaatgaattaggaataagaaaaattctggacgaggcatggtgcctcatgcttgtaatcccagcactctgggaggctgaggcagaaggactgcttgagcccaggaatctgagaccagtcagggaaacataatgagacttcatctcttaaaataaaaaaagaacaattctttctccgtttggaacaagtgatagttcactttcctcttaaatctactgaaagagaaaaggcacatagtgggatggtaaatggtaatgtcacttggtctcaacttggggagacagccgaaggtaggagggactttggggaactgggagtcagtcagttgctgctcagctccatccaaatgttgcctcatggggatgcagccctaaaatgagcagaaccaatttttccacaagaatctagaaaactggatttttaaagtaaaggttcagatttgtacatttgcacaattaattcaaaatttttgaaactttgtaagagccaatcctgtatggccctaacaaaaaatatacatctaggggctaaatctgtttataacctgtagttgctgagtgaggtagaacttattagcttgcaccatcttcgatttggagaaaggacaaagattcatggttcattatttgtatgtctttaaataggctttatcagataaagagaaaaaagtttaaaaagcaaggcatttgaggacaagatttatagtgtgtggacaggaactctgctcttgcatttcattcctataacatcagagccagagttcttgggttaatacagaatgcgtgattttattttaggatccacagcacaatgaagtaagatattgctgatgtcaggcttatggcatctatagtcatcttgctgtgaatatggtccttaataaagaattcattagaatgtttcagatagggcctatgttacaacaaagatatggagatctggatatatctagatgacatgaggaattttctagttgtcaaaaaataaatgtttgggctgggcacagtggctcacacctgtaatcccagcactttgggaggctgaggtgggtggatcacttgaggttaggagttcaagaccagcctgggcaacatagtgaaatcctgtctctaccaaaaaatacaaaaattagcaaggtgtggcggcgcatgcctgtagtcccaactactcagaaggctgagatgggagaatcacttgaatccaggaggcagaggttgcagtgagccaagattgcaccacttcactccagcctgggtgacagagtgagaacttatcttaaaaagaaaacaaaacaaaccaacaaaaaaaacaaacccctactcccatcacattgctttagatgcatgaaagcaatacgttttgggtcttgagtatttcttgacatttcaagtgtaaatacagctttagatacttcagcatttttttcctactcattgattaatggtagctttttttctttttctcccaattcaagtacgtagtaataagttaatgtgagatttgtacattttaatttgtatttttctgttttaataatataataaaatattttgtgttgcatttagtagtaaagaagtatctttttacctaaatgcttggtgaatactttcaagttttgtatgattaatagttaaagggtgctaagataaataaatatatacatgctctgtttcctgaactggagattagaaacaaagtttgaaaagaagccagtagacatgagatattgtggtgagataaagattggcaagggtctaaaactgtgaacttgcagacttgtgaaatccccacaaattaccacagaagctgatgaggttctctttttaattttagtcccagcttggtttcagttactatttcaactcttcagcatccttattatgactagtagatctgttagcaaaactgctggtggaaaagtttttgtgtaatatccactcccccaaattgttttagggacattaatcacctgacatgcatttattttcattctacagaagaataaatgcaatgtccagacttggatcccattcaagattcattggtctattactgacatttctaaatgtatctactgaaatctcctgctctttaacctctttgcaggaagatatgtgtctttgtattcccttgagtactttcggtatgtgtttaataaatacttcttaaaaattagattgtaaattgatcaataaagatatcattgaatggtttgggtggtatgcccagagacagctagttttaatctaccaaaataatgaataatacagagtaagaagcatattatagaattttcatttaagaaaatatggactaagtcatagaagaaatgggatttaaactagttctcatttcatgatacagatttctggcctacactgcctttttcccctccctttctccagcccttctttcctttctccagcccttctttcctttctcccttctctctttctttcctttctttgcaaaatgggtatatgtaggtaaaatgtatgtggcttatgaatttgagaggagtgacagaaataggaatcattgcatccctcagtagagggcactttttggtcccttaccaagaaaataataacagcagctaacactcattgagggcatactatgtggcagttaataagcactttacctgttattaacttacttagttctcataacaaccctacaacacagacattattattattctatcatacagttaaagatacagacacacagtaaattaaataacttacccccaaaccacacagttagaaagttcaagagttgaatttgatcccagtggtctggctctagagtccatgctctttaccattacattgtacttagaaaagaactcagtaaagaacgagtaaaatgtgtaaggccagcaaggaaggactgtgttgggttatgtcacatgggctttcacagaagctttcattatgatgttcagaacatgatagtccctctctccccttcaaaatggttttgagtgaaagaatgaacaaatatatactttaatcccaacttgaagacctcaccatcctctgagcattcctgattttccatgcctccctgccttcttcagtgccattttctctgtgtgcagcattctccttcttctctctgcccagtgcatccctgcttgtgcggctaggcacagctcggttctatgagtcaccttgtttttacctctctcacaacactttcgtaatgcccctgatcataacttctgtccatgtgtgccccctctctagatcctcaagcctccgagatcacaatctgtgcctgacatatgcttgtacctccaccatggtgttaatcatagtgtctggcacagaaataagtgtttattcaacagacaagaaagtgactggagaagtattcactgtaattttatcctctttaacaatctgtaatactaaaaattgggaagcatatcttgaaattccactatgagcctgttaatataaaagaaataaatgtattcaataatcaaaagagaaacatcaagacaagaataaggttagactcatccccaaccccctcccatttctgacctctgttcctctcctaagattcaccccatccctggtcctagcccaatcctggacagtgagtccctccctaaggtgaaccacctgtctccctggctttgtccagacacctaatcctcactctatacagtgattgaaaccccagtttttggccaggtgcggtggcttaatctcagcactttgggagaccgaggtgggtggatcgcctgagctcaggagttcgagaccagcctgggcaacatggtgaaacccccatatctaccaaaaatacaaaaattagctgggtgtggtggtgcgcacatgtggtcccagctactcgaaaggtgaggtgggagaattgcctgaacccaggaggtggaggttgcagtgtgccaagatcacgccactgcactccagcctgggcaacggagtgagacccgcatctcaaaacaaaacaaaaccaaaaccagtttttggtatctcaatgcacaatgttaattaagtagcaaaatctcggcatttaaaaaatctgaaatatttacataaatgatttgacccaaatcacttgtaagggtcaactgatttggatcaaatcacctgtgtcttgagctatactcagagaattacatgccccattaaaatatcaaatccaaaaaaaaaaagagaggataagattagagaagaaaattaaagaagaaaccaatttgaagtgtacagaccatgtcaaaagaatatgatggcagagaaaagtagtcatataaagatatcaggcacacttctgggctaggggatagaaaaaatacagttttgttcttaagccattggagagaccgacagaaccattcagtaacataaattttacaaagctaaaggaagtcagtacactgagtgccaaaatccacctggaagggtgaggaaggaagaggagaattctggaaaagggagtaggggattgccaagcgtaagtattgggagaggagagacattcaaaaaaataaagaaacaatgtgtgcaaagcatggggtctgtgaaaccagagttccctttcacagcagtatcacatgtgctggagtaaagagaggaaaaaggagggagggaatgcagggggcaggctttgtatgccatggaaaggactttctatttatgtaagaccacagggaactgtggaagaattttggagacaggagttccgcaatcaatctgataatttggaaagattgatttgggcccaggagagaggggagataaacaggaactgagaaccaatatagaagtctgagaagtgagccattgcggtgggccaggggatacgggatgacagcttgaacccaggagaggcggtggagatgaagggcagtgggcgaggagaagaaacaactgggaagtaggtgatcagacttgggcatgagggatggcaaaagagagtgctaggaaatctagggtgagtcccaagtttctggcatggaatactgggaggcaggttgagccatagaccaaggaaggaaatatgggagatatagcaggttaaaaaaatgagaaggaggtgggtgcggtggcccacgcctgtaatcccagcactttgggaggccgaggcaggcggatcacaaggtcaggagtttgagaccagcctggccaacatggtgaaaccccatctctaataaaaatacaaaaagtagccggacatggtggcgcgcacctgtaatcccagctactcaggtggctgaggcaggagaatcgcttgaacctgggaggcggaggttgcagtgagccaagatcgcaccactgcactccagcctggcaacggagcaagactccgtctcaaaaaaataaataaataaaataaagtgcacagttcaatggtatttagtgtattcacaaggttcttcaacaactagcactatcaaattggacagcaattttatcactccaaaaagaaacggtgaacccactgcagtcaattcccattcctgccttccctcagtgcctggcaaccactaatctcctttctgtcgctatagatttgcctattctacatattttctataaatggagttgcacaatatgtggccttctatgtctggcctctttcacttagtataacattttcaaggtttatctatattgcagcatgtatcagtaccttgttcctttttatcattaaataatattccattgtatggagatatacttcattttgtttatccatttgtcgattgatagacatttgggttgttttcactttggggaaattatgaataatactgctatgaacatttttcaattctcttgggtatgtacctaggaatgaatttgctagatcatatgataactctatgtttaagtttttgaggagctacctaactcatttccaaagtgactgtaccattttacatttccactagcgatggatgagggtgagatacgaaaactcacccaaatgttaagtaaaacttgtccaaagtcacatgctagtaagtagaagagctaggttgcaatcccaagtccacctgtctccaaaccctactcccttcctctgcagtttgcgtgtagcttgtctctgtttggtttggagtcatcaacgtagaggtggtagctgaagccacttctgtggatgagttcagcatggagacatgagaaccgttggcagtttagaggccagcagtaggaaaggagtctgcagatgagacgatgaggtatgaccagaggcagaaaaaccagggaagagatgttgccaggaaaaccaaccaaaaggagaatttaagggagggtgtggtcaagaagtactacactgcggctaagccttagcataagaagacaatgaagagagcttagcgggtgtaatgacttttgccagagtagtttgaatagagtatgagggcaggaagtagaaggggagttagacagagcttgatttgggtggtctgaagagaggatcaaatagaaccagcaaattctacttggctgtgagggatgggagagatggccagtagagggttgctaaattttgtttgtttgttagtgtttggttttggccagaagacacctcacgtttatctatgtagaggaaatacaaggggagttacaagctagaggaaggagaagtggtaagacgcatgaactctagacagttacaccaaggaactggtgaagagagaagaaaggcatggtgctgtttctgtgtgtggaggtgggtgggggttggggggtgtagataccttcacatggtaggtcaagggaaattagttcactctgggcttcccttcatttgtcttaatttgctcacactttagtaaattacaattgattaattcctccttttacaacctaccaacaacatccttattcctattccttggtctcttttaactgtctctttctttttttctttcttttttttttttttgagatggaatttctctctgctgcccttttgcctaggctggagtgcagtggcagaatctcggctcactgctcactacaacctccgcctcccgggttcaagggattctcctgcctcagcctcccaagtagctgagactacaggcacgcaccaccacacccagctaatttttttgtatttttattagagacagcgtttcaccatattgttcaggctgatcccgaactcctgacctcaggtgatgcactcgccttggcctcccaaagtgctgggattacaggtgtgagccaccatgcccagccttcctctaactctttaacctttactttatgaaaagctagcttcttctccctctttctttctcattctctgtctctctagatccactaatgagtccaaaatacacatcagaaaccctagtttctcagagttgtggcatttctgaaagctaatctggcatggtagcaaaccagtctatcaacctctaaaattcttaagaactcccaaagttctcttttagcattttgacagactgtttcccatatgtaaatctgttattaatccatttgtaatattgttctaatggaaaatatatattctaaatttcaaccactttacaaatttagttgggaacatttcacaattttaggacttccttttttctcactgtgatttatgctcttaaaacatttttgaaatgaattttttttgttctgataaggagggcagagtcgtagtatttatctcatgtcagagatgatgaaagtgagcctcagagaagttaaatgggacctaagatactacataaattttctagtcagttatattttctttttttgtaggtatggactgtgatttcatttcaggagtaaggtgaaattagttgatgtcttagatgggaggaagacatatcgttggctcttgagatttgtttttcttttagagaaaagaaggaccatttgctgcaggaaaaacatctgaaacaaaagggaatgacaaagttattaagtggagccttctaattatgggcctcaagctgtgtaactttatttgagagcacagaaataattttaaacacacttttttttttggttcctgtactttaccgttaattgattccaataaaaagtctagctccaaatccctgatttcagaagtaatttcaaactgagacattaccatcccataaaagagtactataaacacatgggtttctaaataggagcaaaatgttttcacttagatgataacatagtacagtttctcttagaaaagagaaattcatattacatcttcagtatctatatatacaaagttagcgtctaaatggtaaaggaaatctatttattaaagcttatcactgtcaatagtgaaactggataataaaattaataataaaaataaagcagcattgtgcaacccctatgctttttgcaatcctttcatttatttgtgcctttaaaaaaatccaaaggtggttcagaactcaatatatccctacctgaccccaatcattttctctgtcatcagcttttaatctaaatattgttgtctcatgtgtattcctattcatttttcacgtagtgataaatttctggattgcaaattgcatatgtctatcctatgcctaattctggaatcatgttcagatatttccaaccaccttactgtctgacactattggacttagcctgtattttctattgtaattttgtgacccataaagcttagtatctttcctgtcaagaaggcctcctagatctccttgggtggaatttggtcccatttctgtgctcccgcaatgccctgggcatctgtctctgtcaccagacttaatggactcattggtttataataactgatttatattatgtctcccgcatgggattgtatgctgttgagaatgggctctctacacctccagcctattgctataaacattgtgcttaatgctaaatagacaataaacattggcttttgtgcccagccaaactaatgcctttctctgaaaacctggaggtccatttaaagacagtctttcattatgttagtgcttcttgctgcattcctgtggagcaacttaaaattcttgttttcaaatcctttcccttgtttttagcgacagtcagcttccactcccagcctagagtgatggtagtttaggagagattttgtagtccaggctgtgccttctgttcacattctcttgctttttagaggctttccatgcaatgtcttcattcccttggagcctcttttgtgtagattctgtccttggagattgtcatctggatgcagtgggaagacccctaagaattttacttatgcagttgttaaaaatgccttcctgttcctagtgagcacatgaggctgagcacgttggtattggcaccaagtactaaacagaagtcaataaccagctcagagctcatctcacaagacctcattgcattttttggtgagaattaagtaaaaagcaagatttagccacattttagttattgctggattgtttgggaggagcctggcctcccagagtttgttggggaaaaatatcaacactgtgaccaacatgaagagcacctaaatgattcctcctcttcctcctcctccatatcatcaccatcatcatcatcatcatcaccaccaccaccaccaccaccaccattattatcagcatcaaatccactcagaattaagtggaacaacaaaggagtaagggaatgtgactttatttcagggaatttgagaccaggtacttccagagcattaggaccgcagacaggattttttttttttttttctttgagatggagttttgctcttgttacccaggctggagtgcaatggcgcgatcttggctcaccacaacctctgcctcccgggctcaagtgattctcctgcctcagcctcctgagtagctgggattactggcatgagccaccactcccggctaattttgtatttttagtagagacggggtttctccatgttggtcaggctggtctcgaactcctgacctcaggtgatccgcccacagcctcttaaagtgctgggattacaggcgtgagccaccatgccagcaggattcttcggaatacaatattggtatttttgagagaagaaaatattgatctttaaaaaaatgattttcccgaagtttaaaattttaacttctgaggctcaagtttcctagttctgggtcttaactttgaggcattatttggaaagtgaacactcgagttgccatagtaggtcataatccttcaatgtggctgaatgtgtccatctggaagccatccaactgcaggtgtctagcatgtatatatatcatttccctgctatgttcggctgcagccaaatgctaggagaatacccccttggtgggactttggaatttcatggtatttattactaaagcttctctaagattctcatttcttgttcaacttatgtcaggtagctgtaaatatgttggtttggttgccaatattcaataccagtaaccaagaaaacataaataaaatgcagttaagctttgttacttgttagcagaaaatgcaacaaggccttgtgagatgagctctgagctggttattgacttctgttcagtacttggtaccagtgattccctgagttgccaagcttgctgtaatagtgaacgttattcattttcagacaatagggccagtgatagaatgcttaccagccaaacacagagaataacaaacctttgttctggacaatgtctagaaactgatctaatgggcaggccttaacaacagctaaaatttttgtgggtagtagaaaaacataaatttttggagttggacttggctttgcaacttaactagtaacatgatactggacaagtaatttaacttctttaggcctcaatttccttatccatgaaatggagataataagaccttagctttcggggtgttaaaagattgaaagataacataggcaattttcccaacattatatctgtcacattacgttgcgaccaacaaatggtatttttagatgctgttattacttcattttctaaaatccaggacaatgttgattattaattccccattaacttagtgaaatctcttttcaggataaaacagacaacaaaaatttttaaatctaggaaaatcctattatcacattaaataaacacatccaatgcaagaaggacaaaaaatttcttttagagttgaaaattacagtattaagtgtggctccttcctactgtcattgttaaataacctttggagatactgcctcaccatccataaatatgggggattttagtcttcgtgtcatcagttgtggtccatttacaatgaatgaactttgccataagcaccaggcccatttcttatattcatactatcccagtaggtttgtgatagaaacaagtttgacagtgatgacagtatgactttggtggagcacactgggaagaacacctgattgaagaaaataaaatagaaagaaaaattcaaagaacagaatagtgaacttaaaaggaatgagaaggaaaatttaaacagaaacaagaccaatgcagaaataaacaaataatttcaaatatagtcaactgaggccaggcacagtggctcacacatgtaattccagcactttgggaggccaaggtgggcagatcacttgagatcaggaattcagaccatcctggccaacatggtgaaaccccatctctactaaaaatacaaaaattagctgggcatgatggtgcgtgcctgtaatcccaggtactcggaaggctgaggtaggagaattgcttgaaagtggggggcagaggttgaagtgagccaagatcacaccactgcactccagcctgggtgacagagcaagactcggttaatgagagcactggagagtgtgagtggtggggcagagatgcagaaagcctagtggggaaggtggggatcataggaaaggtggctctggtggtagttaccagaatgtaatattttggatcaagtcaaaggatgggagagaaatgattttcttgagactgagtctctctatgttgcccaggcaggagtgcagtagcaggatctcgactccctgcaacctccacctcccaggttcaggcgattctcctgcctcagcctcccaagcagctgggattacaggcatgtgccaccacgcctggctacttcttgtatttttattagagatggggtttcaccatgttggccaggctggtctcgaactcctgacctcaagtgatccacccgccacagcctcccaaagtgctgggattacaggcgtgagccaccgtgcctggcccatatctggatttttaaaagattctttcagctgcagaatggagaatagattgtagtaaagacctatactgtggatggggaaaccagttagtaattggttaaaatcattcaggcaagagatgatggttgtctaaaccagcatgtgtccatggagaagggaaagaagtggttggtggcagaatttcttttgaaaatagattcagaaagatttactgatccattgtctatggggaatgatcagaatcaaggataattcccagatttctagctagatatttggttggctgatggtgccattcccctgcgattgagaaattgagagtggaggggaggagaaacaagtttgtgggaggaaaatgatgagttcactttggcagtattgatttagagatgcctgagattccaaggagaaattttgttttaaatgatttcccttgatcatatcaaggggaaattttgagttaacttctagatatccattacggacttctgagttaagacctgggcatctttaagtgctaagaattagcaggaaaaaaaatattggaggaagaggcagaagagtgagaagttaattcacgtaacgtggtccctgggaggacaagagtaagggatccatgcacaggtggagggattgaccttggataaagaagagggccacttctttcaatgcaatagcaggagagaccccccaaaaagggcatccatgtgggtaaatttctcatttttatggaaggaaatcaaggaagtttctgtctggcaacttccatttactctaaaaaggagacacggtcatctgccagaaggtatgatggataccattctgacgtttatcgagaggagaaaatgtacaaaagccattgtgaaaagagaagaaaggaaccagaattatcaggattatttctgtcaagagtagaaggctgatgtttttcttctcctggaggtatttgtttgttttttattgttgttgtttttgagaggaagtttagtgttccttgctttttgggctattgtatcatctacccatgtcatgtttctaaaattacttcagataacttctggaacaatgtttgtggcaaatctcccctgcattcaagaagcaattatgagtttctattgttatggtctagttacactttccataagtctgagcctcagaactaaagcaaggctggcatttgttaggtggtgtcctcacaagggcacagatcctagctcccatttcacctaggtttgcttgatatggtgaagaggacgttaagataccattggaaatgaaataataagaaaatcaggcagggtgtggtggctcatgcgtgtaatcccagcacttggggaggctgaggtgggtggatcacttgacgtcaggagttcgagaccagcctggccgacatggggaaatgtccgtttctactaaaaatacaaaaattagccaggtgtggtggcacatgcttgtaatcacagctacttgggaggctgaggtgggagaatcacttgagcctgggaggcggaggttgcagtgagctgagatcatgccactgcactccagcctgggcaacagagcaagaccatctcaaaaaaaaaaaatccagatatgatcatgccattctcctttcaaacaatggcttcccgttgccctttggataaaggatatactccttactaaagcttacaatactgtcatgagctacttccactgacgttttagtctcatctcttgccataacactttagtcattgtaaatgtcttttcgatttctcataattgaaaagacttcatcttcattactaagctaaaactcctcaggcttctagactaaattagtgcccctccctacctgctctgtgctccataagatattttattgtcattgttcctttaattctttgctagactatagaggcaaggattgtatctgtcttgcttatccatttatccttcacttccccgacaccaaccccttctaccagccactctagtattctgttcggtgtctggtgtctagtagatcctcagtaagtatttatcaaataaattaattgtctttcagagtttttattatttcatttactaacctcaatcttaattctcctatggagtatcaggtaatataatcacagcactttaaaaaaaaatctcatgtctgtggtgataaagagaaattaagtttgcatatttccagaacaatgaatgctgacatctttggcattaatctttaagacttcaaggtttgtaacaattaacacttgtattcatgaaggattagtcatttagagaaacctctttgtctccatatggaggtcatatgaatgtaaagatatttatgtagtcatttatgcataaagataataactgccattggcagggaaggatcttcaagaaattcttttatcttggaatagagacaatgtgatagacaagacaattgttgaaagttctaatatggccaacatcatttcaaaacgatttgttgaatacttactagttacaatatttcaccttataaatcctacaattctagagccaagagaaagcttccctgtcattttggcatacttcctagataccgtctgggaatttagtctacaacatctctgacagtcatgacctaactttggcttgagaacctttgagaattggagtcccttgctggtgaggctgcttggccccctaataggtgctccagtgtcatcgtattttttcttcgaatatcttttctcttctctaaatgaacacctctctccctttcgcttctacaaattggtcctctacttcaggcctcaacttaaaagacttttaatatgggaggggaagaagtagtgcaggtaaaaggagaccctttccctgagcactcagcgttctgcaggctccgtgatggattcactttatgtgacctcactaactccttaaacagtctagtaaagtacgcagcattatggaattttactcagagataagtcagactttccccattcagttacctaatgttgaaacccgattttttttaatggagaggttctgagtcaagagcctggtatgctcatttatatctgttaatgaacagttacatggaattggctaccttttattatttctaaaattgggagcactgttcttagtgtcctaggcaacctcagaaggatgttttttgacaatagaggcttcacaagtcatgttaatgaacgtccttttgctacaagaacatattgtagcctttgaaatcacacccaacaaaactctattgccctttaaaaataacacttttcttttagaaataattcaaaccctgggagaaatttggcttattgtgtccctttcagacttgggagaaaatgtatatgctggagaacaataattttcatggccgccagagagtacctatcaacaccacagcaagtcctaaacaaacagcaagttcttaaggccccattgggagactaaacaacctgctctaaaataacattgacattcatgttgagacaatcagtagtgatttagggtcagagtttagtgatcatgaccacagactgttttaaggatttactaacatttcaaagtcaatgtttggaaattcttaatgagtaatccactgatatatttgcatgaaacagtagtttatactatgtgtatagaacttggttttgttgcatatgtgggtttttaataggctgcaaaaagcttacttgatttaaaaaaaaattgtcttaccaaataactattttgaatatttgcccttgttaattgatgttgtgggtgaagtttagacaaaatctcaaataccacctataactcaaagtttttgaaaatgctttaacacaatgtggattctttggggttatcatgatctaattctatatgggggtttctttctgttcttttgtcaggttctccaaaatacttatcattcaggttgaataaaccagttctacagactgcttcttccatgcatttcccaatgatgctagctgcccttaaaattctttcagatttggaactgtatctgtatggaaacaacaggtaagtatttctttaaattgtcataaattatgtaagaattctaataaaaattaaatatgcctagagaaactaaaagaaacgtgctatgatgttaataggagttatctttgtatgatgagattagggataactttttccttaatgtcctgttttaaataataagtgtatattgcttttgtgataaagaagccttattctgaaaaaggtagttgtagacacaataatgtccacacataggaaatgagatctcaggtaaatgtgcaggtgacagaaggtggagcagagactcagacacatctactgattgcagaaacagattgtaacctgatagcccggcccacctggcccgtcgtgtgccagtttctttgcagatcagaaatataaccctaaacgtggtgatgagtctttggttccaggttatctctaaccccttatggggatgtgaacaccttccccagacagctcagctgagtaattttggttttgaattgagaaaccagtttagtctaggcctatttgttctaagtaatatgtctactcttccgtgagtaacaggctaaaaaaaaatgtctgtatacacatgaaggtaatcaaacttgttaattgttcaatcttgacttttaagggtactgatagagtttacattagaggaatcagagaagttctgccccagaatgtcttggaaaaggcaagttctaatgatgaatataggcagattctattaagtttagaaaactggcagaaatttttgtcccagtgatgtttacttaaagctgatttagtaaacaaacttcaaaaagtctcttaaaaatgtatggtatctatacacactcacataaatatactcatattcaatgacaaacctctgacaagtttcatgatattcatttcctcacccattaatccactcgtttattaatttagtgaataatttttgagtatcttttatgtgagaagcaaaaccttaggtgttaaggtgtataccagagaacaaacacaaaaatccctacaatcttggagcttatgtttatgacactatagagatttaaaaacaaataaacaagtaaaatatatagtttgtcagatggtgttaagtgtaatgaagaaaaataaatccaggaaaggcagtaggacatgccaagtgagaggtgggtgagagctgagaggtgcgttgttttaaataggtcaggaaaggccttacagataaggtaactttgttaaaagatataaaaaagttagttccagatgactttaataatctgctttcacaaatcatttcagcagcagaattgggaaagcgtttgatccagcgtttctgctgtttttattgaacacttgaaataaccctttattttatgttctaagagtggtaccttcagcacaagaatctggttctttcacagaattaatagagggcaaacattttttccccagagttatgtgcctggtgaacagactcattccaatgtcactccagtggtctcactgaactaatacaaccatacatatggacattaggtattttttcctattcattcacatgtttgttttctgaagttgactatgagcctgttgaaggtaagaatgggacaatgatttgttcatcttggcagcctcaatgcctaaccaagttcctggcataggtcaggtgctcaatgattgccagttgaataaataaagttcaagagtaaaatagacattgactttaaacagctcacgagatgaatcctcaatggctgcatttacctactaaaatgtctaaagtggataaatgtcttacaacatgacagcctccctcctgctccaagtcctatggggacctggcatcaaggacctgctctgtaaaataaagtgataatgtctatccagcagcgatgcttttgagtataagcaactataagaggctattgccaatcacgttttccccatgacagtgctggcaagtgggatagctctcatcctcacattttccttctgtctctgtaacagataatctgtcttacatcttctttctgagatgatgtggaggagtgataccctttacactagattagcaggcaaaactatgatggtttgtgatatccatgcttgtagaagtaataagaagaaagggaacacagaagctttattttatagtggagtcctgactctaggccttaataattgcatggttttgggtaagttgctaaatcactgtgaatcccatcacctcatctgtaaactgggaataataattactaccttacagcattgttgtgaaggtcaagttcaataatatatgcaaagcattcggaatggtgcatagtacataatgtgggtgttcaataaattaacagtagtatttttaccactgcagagaataatcttactctcaggcaagtagaatctgttacagttgttgaatatttatgtaatcattgaggatgtttataaatatatttgcttctaaaaattttttccttacatattcttttattaatattaaaccaagtaacatttataatattcttgaatatcttatcacttaagaacatgaggaaaggtggccgggcacagtggctcacacctgtagtcctagcactttgaaaggctgaggtaggtagattgcttgaactcaggagtttgagaccagcctgggcaacatggtaaaaccccatctctacaaaaaaaaaaaaaaaaaaaaaacccaaaaaatagccaggagtggtggtgtgtgtctgtagtcccagctacttgggggtcagaagtgggagaattgcttgaacccgggaggtcgaggctgctgtgagccgagatcgcactactgcactcctgtactccagcctgggtgacaaagtgagactctgtctcaaaaacaagaacaaaaacaatcaaaaaaaaggatataaggaaagtataaaacattgcattaaaaaatttcagcagtgaagtgggatggtatataacagggaacatttccatggtctccaagcagcatccatccccgagaacagcttagcaggtattttggcatcataaaaggttgatgtaatctcagtcactatgatacttttcttgtacaaagatacagtctatggaagtcattatcttttcaggtaggaaagtgatgctctagtggggtctgaactctagtctaataactttctctcttttttctttttttttagagttttcttgaagtacaactaaggacaggtcaccactaggcactaacatcgctgacttgcatgattatggagatggtctatctgatgctgaaaatgtctctagttttttgacaacggctaaataaccatgggatcaagtggccttgggaaagcagcaacattagatgaactgctgtgcacttgcattgagatgtttggtacgagccttttctcctttcatctcttttggatctctcgatgctctcactttcctctattcagaggcaagttgcttgtagaacagagttcagtctctgtaccttggtatttaaggcctttcggatggacccgggtctgtctctccagtttcactgccctccatatttctttccctttactgcccacagctcataccccagtcaaactgtctacttaatgtttctggaacattctctgcacctttctaccaccatccattggtcatattcccttcactgaaattctgcttcagggccctctcagatgttcatagtaccattcctagtcttcttggtcaggaatgctgcttgcctcttcccccatcccatatcccattgtaattccttatagcacatggcatatgcctctgtaattgtttcttggtcttttgactcagtcttttgactcagacgaatgtgagtagcacaattgactacattctacattcatacacgtcatatctgctactagattatacacttttcagctgtatgctccttgtgttgttgttttcatatccacctcagcattttgggttatccgttgcacaaagaaagtcaacccacatgggagtagttatttattaaattgattactatagaaaccagagttaaaccagtgcagggttgccagataaaatacaggatgaccagttacatttgaatttctgacaatcatttttagtgttagtatgacctaaataatgcctgggacatacttacaatacagaaatttatcattgtttctcttaaattcaaatttaactgattgtcctgaattttactaaaactgtcaactgtagaccagaggaagggtaagacccacccacctttacttgcaaggaaatactagccgaagtaggaggtaaaagatcactggtcggccaggcgcagtggctcacgcctgtaatcccagcactttgggaggctgaggtgggcggatcatgaggtcaggagttcaagaccagcctgaccaatatggtgaaaccccgtctctactaaaaatagaaaaatttgccaggcgtggtggcaggcgcctgtagtcccagctactcaggaggctgaagcaggaaaatgtttgaacccgggaggtggaggttgcagtgagccgagatcatgccagtgcactccagcctgggtgacagagcaagactccatcttaaaaagaaataaaataaaagatcatttgtctatgaaaagtttttgacatatgacactactgcgtctctactgatgttagaaaaagtaaagaatagcactattatctcctcacttcttgttttatttttctaacagatgacaatggagagctggataatagttatttgccaagaatagttctactgatgcaccgatggtatttatcttccactgaattggcagaaaaacttctctgcatatatcttttcaactactgtgtaatttttacaatcataaatcaagctctgtatttagatagagtgtctatccaaagccagtaaattaagatgaataaatagtctttggttatccagctgttttgtgaatatatatagatgtctagacaaaacacatctggatgatagaccagatagttgactctccatctggatgttttggctgtacttgaaaataatcactaagatgtaaaatgaagcaggaactgtaggctggatgtttctaacttgtcttaaacatttctgttattagaacaatgagagaatatttaacaatgattcaagaccaaatttgtttcttctgggatggcaaaatggtgggcatagaggacgcagcttaatcatatggaaatacagccaaaataatatgctcttacttgggcacaaacatcaatttagttttcacatctccccttgctgccaagacacaatgaacattctagcagacttattataatttgttgactgatactaattttagattttcttctgaaatgaaaacaaaaaaatcccacatggttagaaacaccattccgtaatgaaggcttttagcagtctaccagttctctacataatgcagtccagaaaagtggttgaaagccaaatgactgaaaatgcagtctcccatttgtaaaaggttctattccctgagagccaatgcttttattatacaatctctaatgtcagtgcctgcagtctctgccttcttcaagcccatgaggccctggagatgagtgagaacccctacagggagggggagccttagagagagaggcacagccttagagggagaggcaccatcaagtgttattagggcctgccaaggcttctggagccagtagggtgtccacctgttcagttcaagcttcctccactttctacttcttctcttcatcctcctcacaacctcagagcagaaaaggatattagacagtctataaggtctgtggaagtgagcaagatcctagctcccagtggtccaagggtcatatgactccactgttgaggtgtagaaaataggtaaggatggagggcattgactcagtctggccatattcctgacaacctagacattgtccaaagaatgtacccaccaacagcattctcacccttagcatggccaccaatgcatgaaacacaaataaaaagggatatttaggcatagtaacgtttaatgtggaaagttgaagactgcctgtgaatcgacatttctataaactttcctccctttggattccttgctcatgctatatccacagtgcctggcatatacacaagctcaataaatatttgttaaaaagaatatgaataaatacgcttacaagtaaataacacaacttgagtattaatatacctgaaaatgacattttcaaatattaaagaagaaattagagtacccatacagttacacataacataacgacggggatacattctaagaaattcatcattcgatgatttcatgattgtgcaaacatcatagagtgcactcacacaagcctagatgctgtagcctactacacacctaggctatatgatacagcctattggtcctggactacaaacctgtacagcatgtcgctgtactgaattctataggcaactgtaacacaatggtgggtatttgtgtatctaaacatagaaaaggtgcagtaaaaatatggtataaaagataaaaagtggtacacctgtatagggtgcttatcatgaatggagcttgcaagactggaagccgctcagggtgagtcagtgagtgagtggagagtgaatgtgaaggcctaggacattagtgtacaatattgtagactttatagacactatacacttaggctacaccaaattataaaaatatttttctttcctcaataataaattaaccttagcttactgtaacttttatactttataaacctttaaaaactttttagtccttttgtaatatacaccttaaaacacaaatatattgcactgctgtaaaaaatattttctttcttaatatctttattctacaaacttactctatttaaatttttttttttactttttaaacttttttcgttaaaagcaaagacagaaacacacgcattagcctaggtttaggtttacacaggctcaggatcatcaatatcactgtcttccacctctatctcttgttcccctggaaggtgtctgcaagagcagtaacaggcatggagctggtcatctcctatgataacaatcccttcttctggaataggtcctgaagaacctgctgaggctgttttacagttaactttttaattttttaagtaaaaggagtactctaaaattacaacaaaaataatatagtaaatacataaaccaataacagtcatttattctcaagtatcatatactatacataactgtgcacactagacttttatatgactcacacaacagcaggtttgtttacaccaccatcactacaaacacatgagtaatgcattgggttacaacattatgctggctaccatgtcaccaggcaataggaatttttcaatcccactataatcttattggaccactgtcacatatgcagtccttcattgactgaaacgttgttatgtggtgcataactgtataaggcattaatcctaaatacaaaatctttttggttaaaatagtgtttctcggccaggcgcggtggctcacacctgtaatcccagcactttgggaggccgaggtgggcggatcacaaggtcaggagatcaagaccatcctggctaacacggcgaaaccccgtctctactaaaaatacaaaaaattagccaggcatgttggcgggttcccactactagggaggctgaggcaggagagtggtgtgaacccgggaggcagagcttgcagtgaaccgagatcgtgccactgcactccagcctgggcaacagagcgagactccatctcaaaacaatgtagtgtttctctgtactaccaactttaattatgtatagttgccagactatttgtaattacagttggcagttattggttaataagtgtggaggaaggcaaaactaatcctgtaagtggcttcttcttcagaccaaaaaaatgcattccagagctataataaatcaagtttcaattgttcagtgtggaagtcatcagaggccacttctctccgtatttgagtgtctatataaccccagcatggtcctcttattaggaattggtatacattgagggcacagctgcaggggtgtgcaaaggaaaggaggtgcaaggattttttttctttaactggtttacgtatcgaaatgccactggagaaagctgcaatgaatttcgattaaagatctgctacttcatgaggtaaatatatttacaaatttaatttcttgtagtttctggttctggaatcgtggacaatttccttttccccaagctgcagacctagtttgacaacagactctactctgatacccctcccaccaactttgttaaaattggctctcctctgttgggtggggtggggggaactatcttttggactagagatcaagtagtagtaaatgtgattacggaatgaaactagctcttagaaagggtggatttattttcttctattccctcaccacacccattcccatctactcaccatgaattgaaggaagggtttcctctcaactgaaagagaggctatgagtgggagcggttttagattgaaggagggcagagagaggctccatgtgatggatggggttttggagacaggagatggctaatttgaagtgtggtcctggatggtcctggacttggtgttaaatgtagtctgtaaaacggtacaatcgtttccatagataaccaacttgcaatcttccagctgccaaaaatatttgatgcctttcaggtactggattctgaagtttcctgcagagtttaatttggatcttggtttgattcgtatgactgaggaatttcgggaagtagctagtcaactaggatatgaaaaacacgtcagcctcatcgacatatccagcatgtaagagtggcaccgacgtctttcacacccaataagtccaccacttaggggaggaagtagtgatcaccccacttgttctgagtccatcccactcctgaatccaggtttgcttctgtgaggaaagccttgctgcagtgagcgcaagccgtatgggacacagctcatctctccaagcttcagttttttttatttgtaaaatgtggacgatacctttctcatgagattattatgaacattcaataaggacacaagatagcacatgaaaggatttggcatgcaatagatgctcagtgttagttactgagtctgaatctacttaatgtctcttacaccttcactgattaaagtgtggtctgcagaccagcagcattggcgttacctgggagctcattaggaatgcagcctctaggccccaccttaaacctgaattggaatctgcactttaaagatccccaagtgattcacatgcaagcttgagaagctctgtaccatggtgctgctgaggttggcctcagaacaacagccttatggtggttgaccatagatgtgccaggagctggttagctcagttattaggtaaccggtgcaattaggccactttcatatcaactaggtaactttgcacagggaagactatttgatgatcctaaatatggctatccatcttgcaaatgtctgttcttgtgtgttacgtattcatagtctactctgttttccactgtcgattactattgaatacttcttcaatagtaatcaatagtgaatgatccaggaattataagggatgtttggtgaaaatacatattattcaggatcattcctaataagtcagaacctctggcagcgaggcccaggcctctgtctttataacaagcttttcagatagttcatgttatactaaagtatgagaaccacagcttctagtggtttccatgtgtcttaaatcaccacctatatcctgataaactcccaaatttatatactagccccgacctttcctgtatgatccagaccttgccggtcacaaagacactaagtaagaaattctggatggttcagtgcaaaacctaccctgtctggaaaaacaactgcaagtttatgttctgttggcaactggtcagtggttttctcttccaatatgaaagacagggcatgtattttgcacaagtccctggaagcaagccaagagttgcagagtcagtaggttaataacttccattgagtgaaatgggctttcaacacattgaccggactcactcttcttttatagtccttcctatgactggatgagaagagtcacacagaggaaaaaagtatccaagaagggaaaagcctgtctgctgtttgaccatctggagcccattgaattggctgagcacctcacttttctggagcataaatcttttagaaggatctcagtaagaaacttgacatttattcttccaaggataacaaccaccatgccaactttcccaagagctgcattttcatactctgaagtgttggcagcttctatcactgtgctctgctggagaagtgcccttaattcacaggaacaatcccttttaaccaaagataaatattatcctgtctttattttatggctcaggagctatatttctgtcgctattttcaatgtctcctttcataggattaaagcgtgatttttctaaacagtcagtggagatttaaccattcaaggttgatttagctccattgacttctcccaagtgaacatgttttgctaggcccttcgtttttgggaaaaaatatttagttaggttcggatttgtataaatggctaattatgggtataggttgaaaataggaattgtagactttaaggagaatctcaacatcaggttgtttctttcccagagatagagatcctgaattaaacttttctttcctactcatcttgatggagcctcattccttctctaactcccccttttctttctctggtctgtgatttcttagcctcctgctctctctcctcccgttatggtaaacattttccacactggttcacaatcagccagccactttgctttgtctcgccaagctgtggggaagtcgctcctcctccttttccaaggtgtcagagaatgaattacattattgcgtgcaaagaagactgtcttggttagaagcatgaatttctgaaagactgattctttcactaagtaatcctacttggagaggaccttaacaattccccacaggcaggccatgggagtcccctgcacagtttatatgatagaaagctcttatgtattttttgacatccatgctaacattctgaaaatgtgtttgccttgctaaagagcagccttacttcaattaattttttttcttctgtcttctttttcttgaaacaactttacaactgatgctaacttgaaataattatatttacgttcatttcctcgtctttattgtataccgttatatctttaacttgcctgattggaatcaccagcagtgtgttaaaaatggagattcttggccgggcgcgcctttaatcccagcactttgggaggccaaggtgggcagatcatgaggtcaagagatcgagaccttcctggccaacgtggtgaaaccccatctctactaaaaatactaaaaaatttagccaggtgtggcagcttgcacctgtagtcccagctactcaggaggctgaggcaggagaattgcttgaacctgggaggcggagattgcagtgagccgagatcgcgccactgcactccagcctggcaatagagcgacagtcggttaaaaaaaaaaaaaaaaggagattcttaggtttttcttctgaagatagtgatcatttacacctagagtgttcccaggaaccagcattttaccaagtgccacaggtgaatcttatcacctagtaaattttgaactcattggaatacaactttgaatcttgcctctttctcctcccaccaaagctgtgatgtgtagtagtgggtgtctttgcgtggggtgagtagtggggtttgaaaagcagcaaaataacattttaaagacacatgtatattcaaacttttaggatgccattgtaaatgtgaaataaaagaaattgtgttgttacgaaacaatatctcaccttttctatgcaatattctaatttttgattttacaaaggctctattataattcagagtctctgaatcttcctttcctagttcactgattaccaaagctatgtcatccatggctgcctggagaataatccaaccttggaaagatcgattgctttatttaatggaatctctaagtgggtccagttgatggttcttagcaaaccaaccccccagcaaagggcagaagtcatcacaaagtttatcaatgttgcaaaggtatgtctggtaatcagactgggttcttgagttctagatgttcgttcactctgttgagaaaagtcattgaggaaatgtggcgttcacagtataagggcatcggacaactaaactactcgctgatatctaatgaacaaatcgtatttttgtcatgcaagaagattgctttcagaaagcaatgcttagaagcatttaatgtagctatttctctgtgaaataatagatatatttctctgattctatttgtgcttcattttaaattgatgtaatgttttccttagcttcttgttattaaaattgtgcataaatttacttgtaattcagaaagtttagaataatttgaaaatccttaaaaagcattgatgcatttttattgcagaagctccttcagctcaaaaattttaacaccctgatggcagtggtgggaggcctcagtcatagttccatttcacgcctcaaagagacccattctcatctttcttcagaagttacaaaggtatagtagacttgatcctaatcaaaagtaaaaaaatgcatttgtaaattgttcaggtttagtatacgcctaacaaatgtcactcagagtgggaaagttttcctcttaaaccagtggtaggttataaatggggacaaagtagaaagggaataaccacaccagctgagtccacctggaaaaacaggttggaggtggtggtaagtgtcctaggaagaatgctttgacataccattagaatactgtagtggtggccgggcacggtggctcacacctgtaatcccagtactttgggaggctgaggcgggcggatcacaaggtcaggagatctataccatcctggctaacgtggtgaaaccccgtctctactaaaaatacaaaaaaaattagccgggtgtggtggcaggcacctgtagtcccagttactggggaggctgaggcaggagaatggcatgaacctgggaggcagagcttgcagtgagccgagatcaccccactgcactccaacctgggcgatagagcgagactccatctcaaaaaaaaaaaaaccaaaaaaaaaaaaaaaaactcaacatattgtagtggtaaatattcaacaggtatctatttggtcctactatgtgataggcattgtgatacacaaggtaaataagacagaaatagttcctaccctacctcctgaaataaagtcattgaatgactattcataacactgtgttgggcacatcagaagatagaaaggggaagacataggccttgtatagaaatcctcagatttataactgaattgtcatgaatatatatatatatattagaaacagtgatcattttccaaactgagcgtttctgccacatttattttcatgacatgatagttgtttttcttcttgagcaaaaaggagcatttcatccttatgaaaagattctcatataagagtgcactttgctacttcaataaggacacttttagctgtgagtttaaaagaaaaagaaaaaaacttctacagcaattaaacaataagcaaatgtatcgtccatcaggcgtggtggctcacacctgtaatctcagcactttgggaggtggaggtgggaggattgcttgaagccaggagttcgacaccagcctgggtaacatagctagatcctgtctctacaaaaaaaaaaaaaaaaaaaaaaaaaaaactagccaggtgtggcagtgtgtgcctgtagtcccagctatttgggaggctgaggtggaatgatcacttgagcccaggagtttgaggctgcagtgagccaggatcataccactgcactccagcctgggggacatacctggaagtccagagacagagcaggcacggtctgatcagacctctgactcaggtgctccgcccgcctctgaatatcggagagttttgtttttttgtttgtttcatcaaactgtttctctcctaattgggctgtatgtagcaaccgaaaaattacgttcccttgttcatgaaagttgaagatagggaagactactcacttcaactcttcacccatagaattaaagaccttttgagccaactcaggtcttaggtccatccctggaccaataacagttgccagagtaatacaatgtactgattggcttaaccctgagttcctgaactaatcacaaactagaaggatgcaattactctgatgataaatcaaaacccattcctggttctggaaatggaaacagactctgtctgagtcacaagggctgctttggagagagcagactaatcaaaattggggtctactagaaaggtctggttgctgtgaagcaaccaacgataacttgtccatataaacaacaggaagtaagccacagaagtaccgttgtttgacctcaagctctgtactcattccaagtgtaatggaacttattaggtaataagtgtttcattttcttttagctttgtaccagatctcaagtaaaaagcaaaaacaaattttaaatgttgtgaagaataagaatctgatagaagtttatagaggcttggagaactaccagtgcatcttttaaaattatgtatcggaacttctcttacttacagagaaagaaactgaggcccaaaaaagtgaagtgacttgctcaaggtcacccttctagttaggcagaatatagaaccacagctatctcacaccgcattgcaactttctctaccccatactgtcccaaattaacctcgagtaatatctggaatgcaactttcttggaacaaataacaattttaatattcgacatgcttgaatttgcggacagtaatattttcataaatttccaaacacttaagtatacatgatgccatttaatatcccaacatccctagtaggtaggcagacatgtaggctatttccattttatagcaaaatggaacaggctgctcaatgcatagccaggcctagtactttttctaactttctttttcctgattcatatttccctgcagcaacattggtgcaagtgatacttttctcagtagctgaggaatttcctagccacacattgcagggcccgggggtgtgcaggagggaaagttgtttgaaaattctacttttccatctgttcccagaactggaatgaaatgacagagttggtctcctccaacggcaattactgcaattaccgcaaggcctttgccgactgcgatggcttcaaaatccccatccttggagtacacttgaaagacttgatagctgtccatgtcattttcccagactggacagaggagaacaaagtgaacattgtgaaaatgcaccagctctccgttaccctgagtgaactagtctccctgcagaatgcctctcaccacttagaacccaacatggatttgatcaacctgctcacggtgagttccaaggagccaagtttgggctcaataattcttctgcacctttctttccaggagacacaggaagatgtgtgccagcaattcattctgggggaaaattggtttcagagtcaatagatgagaggaaatctcatagaacaagggaaaaggagccctgattaatattttccataaccagcaaatcttggggcaaagaaatctacctttgttcggaggggcccagtctctgccatatgactccacttctggagttcttaggctcctccagactgtgcctcagccctcactctccttcaccacattcatccaacttatcacatccttctgtatgtcctccagtcatctgctcctctttatcctcactgcactgctttggctgaagcctggagtaatgcaaggaccttatctgtgatccccctgttcccattatgaacctcccaaacctccaggatgtagtttacagtctggcattcgaggttcttgaagactcagtctccaaccttctttgccatcaccctatcccacattttaccagcctttgagaaatattgaacttcttatactttccaccccatgaaatgctgtcttctgcttcctggcctttggacttgcttggagaatcccatcccaacccatccatgtggcaagttcaatttcaaaagcctgtctttctggagcattctctctccccctccatagcagtcatgcatctgtcacatcaccctggcactttatattttccttaactataggaggtatcactctttattcgatttttatctgtttatctgccttacatatcatatgcctagcacctctcacagttcctggcatatttgggaactcaataaatgaactgcatgctgtatttaggaatgatgtggcttagacaaaagaagttcacctaccactcatagttttttggcatttgtggcacacatgtttagctggtctctgcatcctagaacttttagacacaacggtgtatagaagagaacatttcccactggctgctgctttgtgggaagaagaggcataacaaaattcactcacccttccttaaacaaaagtagaggtgcaacttccctgtttgggtttataacactgtagcatctgaaactcagctgcaatactgaattaactgttttccttgtatggctgtggaaaatgaaaccaataactcctcttaatttctgagagcctaaatcccctaggtctgctgcattggaataggagtgtggtttctcgcccttctcacaaactgttcctagaccatgtaattgtttaccaaagaataaacccctaagtgtaggcaataatgcagctatacccttcaaataaagcagaagtggccaacacacagaaacacagatctcttaaagttgagtttttgtgacaaatagtaaatatacagactttctctactgggggcagggaacgcaactcacaataatccaagcacctgcatttattaatgatttgccatgtaaatctgtttccatgaataagtgatcagagttgcagccccagtcagactgcagacctacagccacaggtgatgtctgcagaccagtctccatgtggagcctaggcttccagtgtctgtgtccaagctgtccacgatgtcaagcataacttcagagagcaggtgcctacccttgggcaatttctcatagagctaaaagataataatggggtagggaaattaatttgagttataaatgaaacaagcaatgttatgacaaagaaatatttagaggaatattgaaggattttcaataaaatttcaggagtactggctgggcgtggtggctcaagcctgtaattccagcactttgggaggccaaggcgggcagatcacaaggtcaggagatcgagaccatcctggctaacacggtgaaacgccatctctactaaaaatacaaaaaaattagcttggcgtggtggcaggtgcctgtagtcccagctatttgggaggctgaggcagaagaatggcgtgaatccgggaggtggagcttgcagcgagccgagatggtgccactgcactgggcgacagagcgagactccatctcaaaaaaaaaaaaattcaggagtacaaatgaaaaaaatctgaactctagaaataaaggctaagaaaaaaattcctttttgctggggaggaatctttctctctctgtctcatattgaaggaaaacttagaagccatcaagcactgtatttagtaactgcagtgttgggtagcatagtgtagtggcaaaatcctagatgtgagaccttgctttcagccttccctcagcagttgcttggttttgtctccttgctaacagccttgactttggctttttttaaacaagggttttatgctcatttgtgaggtcttttccagctctaaacttctaggattctagatgtaagaaccagtggagccttaagaataaggaaccaagagtcaacttgattctgtagtaccagcccaatagctcatcacgatagcacaatcctgtgtatgagtcaccaaacttccagtcaagatcctttctctgtccccacagccaagaagaaagtttagtgcatagcagtatacattccttcttcctgactcctgaggattaatctcctcaacatgaggactgaggaggcttccatcttgtggtcactagagcccagcggccattttaggaagcacacacatatctggattagacccatatggctgaccacagctgccccaatgcatgcgaaggcatccacatgccagcattggaaggggtgattcattttgcctcaggactctaaattttctcctgaagtgattgttttcatctaaacatggctccagctgaggtcgcctgtatatgatggacagccctggaggacagaaaaagagaacccttatgttcatcaacaattatgaaatgcctactccgtgtggtaggctgtagggcagtgctttaactttctgtaatagttaattacagttttcacagcacttttcacatacgtttcctcagtaaattctcacacataccctgcaatgcagcctgggcagggctgtgagtgtaacatcacccctgccccttccttttttttttttttttttttttttaaactaaagaagaaactgagatttacaaaggacagggagcaaacttctgcatcccagcctgggccgggttcccctcaaatggacatttgctctctcatgtgggcacactgctgacatctcatttatttcacatctgtaaaaattaattaatactgctctctcctcctcttcatgatgtgcagtaaaggaagtaattacaggacaaaatctgtgagggtgggggctatgtttgtcatttttgtcattgtatccttggccccttgaatacggcaccaggcctgttgagggaaggaggaccacgccaccaaactgttgggatttgtattgttccttcctttcagggaatatctggagaggacatttgccttacatcccaattcacgtaaccaggagttttaaaagctgatgtttctgttgcgtggggtatgaaatagtttgaatcttttcatggtatttttagccctatcagttacttttaccattttgagtacatgcaaataactggaaagcccctgtatttttaattttagtctcatttttaaaaaagaagaagaagaataagaagagtttcaaaaatggtgagtagaggcagtctgatgtccaggtgtgttttattttatgataaacagtcaagccaatgtagatcctaatgaagactgaatctgcaaccaactttgctgaaaggataggttggtaaatgcaacaacttgaaacagtggataagaacatttgtcagaaaaaaacagccaggctcaaaatatgtttgacaagagcaaatgttcttgaaattccattgatgagcagcccatattataaaaacgttgtgcagaaagtagaacagatcaccctttgggcaggtccgtaaagcccagaggagatctgagagaggaagtagaatcgtgactgggaaagaagagatgctaggagtaaccccgagggcagctttacattcacggataagcacagtggcatttgactcgtgcattgactggaagccaaaccctgcatttgtgaccttctaaacaaaccttagtcagacacccattagctcatttcatcttcaccatcgttcttggaggcagctattatttatgattcccatttcacagatcaggagactgagactcaggaaggttaactgcatgcccaggctcacactactaataagcagagagtgagtatttggagactaccaaaacatttccatcgctgagccagttatccatttgacacatggaaatacccaagggtgttctggttctcttgagagagcatctccttgccttactgtgtggcttatttggattcttggttggctgtggtagtgcttctgtcatctcatctccagcagatgctggtgccagtcatcacaggacttggaagctgagtcaggaggaagggaacatgctcctccaagtctgcactaactcctgataacagggaattcagaaggaaggagtcacttggttttctctctttatttatgtaaccttcacagtgcgaggcttcaagctgggactcagggtacagaggtgcaaaagacagatgtgctgcccactttcatgaggcttagagcctggcacagttgtctgttgtgggaattacaaaatagtaggcaactgcccacggctgatgtattttatttggcccatacggaatcctaaacttttgtcgttgttagttcccagtgtttgaaaattgggatagtttatctaaaactccagatttctggcttctcttaacaaatcagaagacttggcaactcaaggtccaacgttaggctgacagcaatttgtcatcactgagcagtgatgttcatcacaaaccgcacctctccctgtgacttccctaacagagagtggtgtcaggtcccacttatcatcacacatttttttttattgtggcgctaaggggaaagatccctaaataaattacatctgcaaagactctgttttccaaataagacgtttctatcaaaatgtaccttttacgcatcctacttggctcttttatataatggtatggctcccaaaggcatttgtttgtgacatgcggatgtttcctttcctgtaaaaaggcagagcctgggaggtgggagtgattactgttcaggggaaggtgaatacgatgtctcttctttgtaagcaggattgtcatgatcttgaaatgatactggggagattttacagttaagtcggttttattttgtttagaaaaaaaactttgtgacaaagtgcaggtaaaagaaacgtgacctgattatgaagtccttaatttaaatgttatattcaagcagctgctagaacagtgactagaacaatccctgacacatagtagattactgataaatatttgttgaatgaatgatttgaaaatgaaattttatgacaccaacttcatttttaaaggaagtagaacaggaaaaggaatctttgaaaacatcttcgcctctgagttttctctggcttcctccttctttcttttcccccacactccacctcatacacatgttagataaaatatgttaaagaaaacttttcattcctacatggtcaaagaagggagcccgcactggttatgttcatggccagggaagtgatgtgattcattgagtgtcctagctttaaaggactaggtgagaatggttcaggtttattttaagcctcatgacttctgttttaggtgagtggaaacatgcactgtaaggctttacagagtttatccatgttctccagcctggatctgtgttgttgtccttgcctacaatgatcttcctctctcttttgtccaaattaagtcccaatcctcctggttaagtcccaattcacaaggacctccatgaatccatcctgatcatttctgtctccggggcccctatgcatagtaataatataactaataacaaatgcgataataacagtaacattaacactataaaataacacttcttgagattttattgtgtaccaggtcctgtgtgaaatactttacatgcattatttcatttggtcctgacacaaatccaactcagtagggacttttatgatcatttccattttccagatgcagaaactgagtgtcagagaggaaattacttgctaaaggttacagagctagccagtggcaggctgcatgcttgaacccagccctgcctgaccacacagcctctgccctcgtgtatttactatgctgcctccctgatttctgaccggttcctggagcacttaaagtggagcaactacttcacactcagcatgtgctgttttattgctacgaacacatctttttaggttcaggccctgtttattcaaataaattatcagggccttgagggcaagaaatgattttatatcagcttgcctcactaggacttagcacaatgctctcaaataataggagcctagttaactgctcctttatttcaacagttctttaatcaaacttcaaaggcagcatttattacatttacaagtcttattgtttgcatctgtccccacttccagcctggaaacatcacatatccctcatccgtgactcagcactgagcacctgggagctgctcagtaaatattgctgaggaattgagttgatggttctcgtcaatactgatgattaaccaggattaacgttttctcttttaaatttcattttccatctctgcgtgccgtctttttattgttctgcatttactcaaattattagacagtgaacttaaaacattcaacttgaaaaaaaattcagcaacgtaaataaataaataaatgtaatccgacatttttatcccttctaattttgttgtagctttccctggacctctatcacactgaagatgatatttacaaactgtcactggtgctggagcctagaaattctaaatcggtaggtattattttctctccaaggatcagtaccaatcactattttttgtcatgtacagtaattggctattacaatgctgctttatgttctaaaacggaagaattttaaaaattgacattattctttctttttcttttttcttttttgaggcggagtcttgcactgttgcctgggctggagtgcaatggtgcgatctcggctcactgaaacctccgcctcctgggttcatgtgattctcctgcttcagcctcccaagtagctagaattataggtgcacactgccacacccagcaattttttttttttttttttttgtatttttagtagagatggggatttcactatgttggccccggctggtctcgaactactgacttcatgatccgcttgccgtggccattacaggcttggattacaggcatgagtcaccacgcccggccattattcccattttatcaatgggacagcttagccctgtcagtttgagaattatgtcttcataccagaggctaataaagaggaagaacatcattctcattactctgttttataattgatcttctatttgttgtgttcctgctaagaactcattacacctaggaccaaaaagaaaggaaaggagtaataactcatcttaatgttaaagatcatttagactgtttcaggctttaaaaaagctccattcaacataaaattagatttaaaattttaaacatctcgatcataatttacaaatttctctactaaccattgattcaactcagaatttggatgtcacattggatggtgtctcacttaatagatggcagacgcttagtaaataaacattatataatgagattgaagaaattgcattattgaatatacaccactcattggttttagtggatggactatattttagatatgctttgcactaatacaaaatgcctggatgagtttaaaatttataatgaggttgaggcttgcatgttgaagataaaatgcctatgcttgcttcttataatcacatcttgagatcagttctcttataaagatctcatccttaccagctgaactctgtaacatattggcagtgactatgccccctaagtttattaatacctactgtgattctgaaccctcagaccgaaagagacagaatggcagtgagagccgtcctctggccctggcagggcatgcacttgagcctgagtcagctgacctggtagcatctgttcttaaaatagtgcatatgcttccatgagcatgttctccttcctgccagtccccagaggctcatctcctggaaatactgcagaacagagccacgtgggatgatatggcacatgcaatggtaggagtgaggacccagactctttaaagctagcaagagtaagaaagctagcaagaaagccaaagctattgaaaaccaaaaaggaatttgtaagcccctccctaattctgtagttttgtcatgacgaacctggccatggtgtattaagccctattgtatgtgtgcatacagaatttccacctcttgacaccaattaggcaccagaatcgcttccagttgttgaatgcctggcagagcatcatacacaggttatcttattaactccgttaagaaaactaggtctgggccaggcacagtggctcacacctgtaatcccagcactttgggaggccgaggcaggcagatcacttgaggtcaggagtttgagaccagcctggccaacatggagaaccttgtctctactaaaaatacaaaaattagccgggcatgctagcatgtgcctgtagttccagctacttaggaggctgaggcgggaggatcactcgaatccaggaggcagaggttgcagtgagctgagatcacgccactgcactccaggctgggcaacagagcaagactccatctcaaaaaaaaaaatttaaaaaagaaaaaaaaaaaaaaacgacagaaagaaaaaagaaagaaaactaggtctggtgagagtaggtatctcactcggatcaaacagctgctaagttggagagctgggattcagtgtcaggcctgtcttccatcccagtgatgtttctaccatccctcatctcagggacaacttaggaatagccattttaccacacttgcctgccttgtgtgcctttagttttactttagtttattttcaggatcttttttttttccaattttaggagatatttccatcaaacatagaaaagtctttttatttgttgtaagagtagaagcttttgaaagtcccttctaagtgctaaaatcctacgaatctaacacaagacatttcccagtctctttctgtctcttctctaagtggagtgtcagcctatttgacatgtcctgttgagatgggagagttccctggatcccttcactgagacttgcgacagaggtgtggccacattcaagccctttgctggaggggaacatacagacaagtgggtgccggcgtgggggccggggagagtgcttttgggctctggccccaagacagcatctaggggtgtgttacagttaatgctcttttagcagttgctgtccatggatggctaagtcttaaccagctcagtggagagtcagggtgacagccttttacaccctaccttcttggtacctgagtccttgtctggcatctaagaagaatcaggtcacatggacttgaaggatggtgaaggcagaggttttattgaatgacagaggtggctcttagcaggatggggagctggaaaggggatggagtgggaagataattgtattagggttctcttagagggacagaactaataggatatatatatatatatatctcaaaactcctgtgctgatcagtagtgagatggtgcctgtgaataaccactgcactccagcctgggcaacatagtgagaccctgtctctaaaatacacacacacacacaccgccccccccacacacacacacaagtatatatatctataaatgtaatttttttttttgaaacggagtcttgctgtgtctcccaggctggagtaccgtggcaatctcagctcactgcaacctccacctccctggctcaagcaattctcctgcctcagcctcccaagtagcttggactacaggcatgtgccaccacatccggctaatttttttctatttttagtagacagggagtttcaccatgttggccaggctggtctcaaactcctggcctcaggtgatccacctgcctcagcctcccaaagtgctgggattacaggtgtgagccactgtacccagcctctataaatataaattaaaaagaaaagatagaaaaaaatagatttgcatgtgtgcaccagcaaaaatgttgacattttatgaaggtttcagggagaggatataaagtgaacaccagtcttggctggtctcctgaaaggattgtgttctgtgcttgtgttatccaagcatgttatgcattgtgctaccatcttccccacaactttatatgcaaatgtcttgtaagaatgcagaaaaatctgtggagaaagaaagttcaccaaagagggccagagagacctaatgattggcagaacagtcagaagtgcttaagcgtattgagcaaggtgcagacgtaaggacataaacttggccacccactggtacccatttgctgcatgcaccataactgatcactaagtattagagaattagataactggtgtttttgtatcctgtattacacaaaaatccatgatggattgttatataaaagttttagtgatatttggagaactcggataggatttttggatggactgggagcgcattgcttttttcccatttaaaataatggaatttagtctggatgtggtgactcacacctgtaatcccagcactttgggaggccaaggcaggtggatcatctgaggtcaggagttcgagaccagcctggccaacatggtggaaacccgtctctactaaaattacaaaaattagctgggcttgatggtgggtatctgtaataccagctacttgggaggctgaggcacaagaatcgcttgaacttgggaggcagaggtttcagtgagccgagatcatgccactgcactccagcctgggtgacagagagagactctgtctcaaaataaataaataaataaataaataataaaaataaaataatagaatttaagttgctgttaaacaaaaggcagtatctaaacatgcatttagttacagattagattccattaacataagatgcttgttttataagcatttaatagctatataaatgtaagtttctactggtattatgaatatacaaaacttattcattcttctcagtgtccctggtcctagttgttcaaggccccagttaatgttgaaaaatatggccaggcgtggtagctcatgcctataatcccggcactttgggaggctgaggccggagaattgcttgagcccaggagttagagaccagcctgtgcaacatggtgaaaccccatttgtactaaatatacaaaaattagctgggcgtggtggcacacacctgtagtcctagatacttgggaggctgaggtggaaggatggcttgagcccaggaggcagaaattgtagtgagccgaaattacaccactgcactccagcctgggcgacagaaccagaccctgtctcaaaataataataataataaagttgaaaaatatgtggttttttttttgtttatcagcagcctacctcccctacgacgcccaacaagcctgtggtacccctggagtgggcattaggggtgatgccaaagccagaccccacggtcatcaacaagcacataaggaaattagtggaggtaagtggttgagggagaataaagagagggcactagaagaccctttctctttccagaatgttctgcgattgtccaggaatctgatggaacccctgaaaacaaccctctggcaggtaggaacaatttagcaggcacttagtcctaccaggcattgggtcctggggagagtcgatcagaaaggcccttttccctttgttgtctctcttgcccagatactctcagctacttccagctcctctctttcacaggcatttgccacctctgtcattgtcaacagctcaagggattggggattagaatcactcatgaaaaacccacataggtcccactaagatgcccaataaattgattacccaagggcaggaaagaaatcctgtaagttggatagtttctccttttgtatagttttggaattttatgacacagcagcccgatgttactgagattagaaaaatcacctaatgtaggacaaggctctgtcagagttttccgtgtagaaaaaagagtagggccgggcgcggtggctcacgcctgtaatcccagcacttgggaggccgaggcgggcggatcacgaggtcaggagatcgagaccacggtgaaaccctgtccctactaaaaatacaaaaaattagccgggcgcgatggcgggcgcctgcagtctcagctactcaggaggcagaggcaggagaatggagtgaacccgggaagcagagcttgcagtgaggtgagatcgcgccactgcactccagcctgggagacagagtgagactccgtctgaaaaaaaaaaaaagaaaagaaaagaaaagaaaaaagagtagaagtgccgatgggggaacacggaaacatctcgggtacaggaaactgcgatcctgaattaaatgtctactttaatggattggtaggtacatctgctggtgcaacagaattgagtctttgggatagaatgtgctttttgctgggagaagatatttaaagaaaaagaaagaatgtcttacatcttggataattcagaaaactaggaggtgctgaaagaaaaattttgcggagtgtgttaggcaggcaggaaaatggtggtgccaagaggaatattagtgagggaagggctgagaaggagataaggtccagtggagcccgtggtagtaacagacccagcttggagctggggaaggtgagaaaaggatccaggggtccccagggaatgcaaggactgagctgcagctcaggaatgtctgaagccaggaaatagaaggcagagctgttccctctcccagtctcattctacatactgacttcctcagtccacatgcggaatttctctctctctctctctctctgtgtgtgtgttttgtgtgtgtgtgtgtgtgtgtgtgtgtgtgtgtgtgtgtgtgtgtgtgtctggggaatttctctctctctctctctctctctctgtctcattctgtcttccttaccttttctctcttcccttttctccaaattccttaccattggttcagtcaaataaaagaccaggattttatgatgaattttactccgcaaaaaatcttctactcgtggtataaatatggatgttaaactataaatagtaggcattccaaaatagttaacttttaagctatttttattatggctaagtaatgatactggaattaaaaaaaaaaaggtaatgttttctgattttgcacaattctgttacctacaaaaaagcttgagatgggctcattttagtcacatttttaattaattcattcatttataccttacctacttcccaaaatacttgcaacacagggcaatagcgatagatagaatagacagaaactactgggaattaattaaaactggagattaattaaaactggaatcaaaatcaaatataaatttgtatacatgtgtttgcagaaagaacttacaaatctttttgaaaacctaattttgcagagggcaatgggaaactttttttattcttctctgattataaaggaagatagaatcatcaaaaatattaaagcattacataaattatagaaaataaaaagctttactttcaggtcttggtaattctattctccaaggataaccactgatcatttgtagattatctaatatgactttattctctatctctacatatgtataaacacacatatactacatacatatatacatgtgtatcttacgcaactttgttcgattatttctttaggacagattcctagaagtggaattgctgtgtcagagagtaggcacttaaaattcctgattgtcctccagaaatattgtggctatttacgtcactaacttgatacaagagtacctgttgtctcataccctagaagatgatcgattacagtattttaagattttatttaatctgagaggtgaaaaaaagcttcattaatgtttctgtaatgattagctgagctgaataactttccatggatgtattgaccatttgtatttttatttggtgattgcctgtttgacttttgtgtctttgctctcatatatgctgcaaataacttgctctgtttgacatttatcttaaaatttgttaattgagcttttttggttcaatttttttgcattttattaaataaaatatttttctttatggcttctgacattgatgtcatgccaagaaaggcctttttcacacaaagattatgaaacatgaaaaatattttcatctatttatctttggtacttttatagctttgggtttttttgcattaaactatataatacactagtgcagtggctcatgcctataatcccagcactttgggaggctgatgcaggaggatggagtttgattctaggagtttgaggctgcagtgagctatgatcatgccactgcactgtagcctgggcaacagagtgagatcctgtctctaaaaagaaaaataaataaataatatataatacatctagaatttagtttggaggtaatttattttgtaagattattagtcatttaactcaacagcagttattggataatccataatttatctgtggattttaaaagatactttttgataaattcctatacatacatgggtttgtttcaggactccactctctgtggtaatttgtatcatgttgttttgattaatgtagctgtgtagaatatttgatttctgaaagggcatgttccccctcattactcttcatttaaaataatttttagcctgttttcaacatgcccactttgatttgaactttataatcaatttgttcatttaaaataaatccctactgggattttgattggaattgcattaaatgtatgctttaatttttgagataacaccttaaaactttattttctattgtcatggtatttgaatttgtaaattcactaagccaatttctactcaaccctgaggtttcagtttaaaccttgcttttcccaggaaacctttcttaatccacctcctctttcccccccccaccaatatcactctattttatttatttgtttattgagacagagttttgctattgttgcccaggctggagtgcaatggcgccatcttggctcactgcaacctcctcctcccaggttcaagcgattctcgtgcctcagccccctgagtagctgggattgcaggcatatgccaccatgcccagctaatttcttattttattttatttttagtagcgatggggtttcatcatgttggtcagggtggtcttgaattcctgacctcaggtgatccacctgcttcagcctcctaaagtgctaggattgcaggcatgagccaccgcgcccagccgaagttttatttttaattttatttaaaatttattttttagagatgatgccttactcgtttgcccaggctacagtgcagcggtgtgatcttggctcattgtaacctcaaactcctgggctgagcaagtctcctgcctcagcctcacaagtggctgggactataggcatgcaccaccgtgcccagctaattaaaaatgtttttttgtagcaatgaggtctctctatattgctcaggctggtctcaaactcttgggctcaagtgatcttcccacctctgcctccaactcccaaagtgctgggattacaggtgtgagccaccacatccaaccattactctgtttttatcctcatcaaaccacttgtcttgttatattataaaggcttcttgacttagttatctttcactagattctaacctccttgatagaaaggatcatatgctagttatcgttgcttttgcaataacaagttcagagcctgccttatagtcattcaataaatacttatctttcctttgcagtctgtatttagaaactatgatcacgaccatgatgggtacatttcccaagaggactttgaaagtatagctgccaattttcccttcttggattccttctgtgttctggacaaagatcagtaagttttaattttgttttattttaatgcaactatcctaaagcagaaaattattatcagaggagagaagggaaacttgtaatttgcatcttgacagcttcaaccctggtgctttgatgagccaggtttaatttgtcactgattattttcttggtgtgtatgaacatgacctgaatggaatcacagggaagaccatgttgtcagtgttgaacacaagtgcacatttgtaaattatccaagcactccatttgctatattgcttctattgcttagctctcaacctcaaaaaatctccaccaaaaaagagtagaggagaaatattgttagatctaacctgggagagtcctcaaaattagtgcacctggaagcaatcttaaaattcatgaagattttaaaaaaattttggccaggcatggtgactcatgcctgtaatcccagcactttgggaggctgaggcaggcagatcacttgaggccaggagttaaagaccagcctggccaacatggtgaaactctgtctctactaaaaatacaaaaattcactgggcatggtggcacaggcctgtaatcccagctacttgggtggctgaggcgggagaattgcttgagcctgggaggcagaggttgcagtgagctgagatagcaccattgcaccccagtctgggtgactgagtgagactctgtctcaaaaaaaaaaaactcacttatagtcttcattaaagcagatgatagctgcagacagccaagaagcattcatgctttgttttctctttgattgatcaaaggttgtcttgataaagaaaaaatatattgctttttagcgtcaaatgattcctaaaaattaaatcgctttagatactaaaacccaactcattaaaagaaaataatgatctgaaaaaaaaaactgctgagaaatcctggcattaataatttgattaattgttaatagtacgagattagttcctaatttaaaaatcacctgtaaggaaatgctggattttgttttggtaaaatgggcaaattaaattacattaaaattctctaatatttttgctggtatgagaattcttaaaaaacgaaatctggagccggatgcgatacctcacacctgtaatgccagcactgtgggaggctgagatagtaggattatttgaagacaggagtttgagaccagcctgggcaacatagtgggaaccttgtctctaactatttttttttaattgaatttaaaaaataaaatctgtaattcaacacaccaagaaaagtcttgacacattaacataacttaaaatcttaaattcatcttcattatatacccagaacaaagaatacttttaaaataaatttaattagaaacattaacttcctttacaaagtaaaatttaaattgcctgctaactacccacttctttgcttagtttgttactattagtgacatgtaaataggacattgacttaaaataacttcctagtcttcatttcttttatctgttggttctagagacaaaattgagattgtcctagcaaatatttgtgtctatctctatctctatatcatccttatctctacttattgatatctatagaattgttttctatgaatgaaggtttggactattcatatcttgcttacatgacactaaagttttgagtggttaatactggaaagtctcaaaaagatgttttctctaaggtactgttttccaaacgatgttccacagaagtagctattaattagtacttttgaaaaaggaactaagtagtcacatgtgagaaacacagggttaaatctcattaaataggtgtctttactgtgtgacttcccaaagcttttaataggctggtgtattacgctgtgagtccctaggaggggagatgagctaatgcactgttacacaaatttatgtaccaaatgatgtaataaatttgtgggacaatgcattcataaattcatttatcatatatataataaagattgtttttggcctcttcattatgaaatctgtgcccattcctttgagtaggcaaaggacatgaatagacacttctgtaaagaagacatacatgtggacaataagcatatgaaaaaaagctcaatatcactgataattagagaaatgcaaatcaaaactacgatgagatatcacctcacaccagtcagaatggctattattattattattattacttttctttgagacagagtctcgttcttttgcccaagctggagtgcactggcacaatctcggcttattgcaacctctgcctcctgggttcaagtgattctcatgcctgagcctcctgagtagctggttataggcatgcaccaccacgccaggcaattttttttttctttttttttcagtagaaacgaggtttcatcatgttggccaggctgttcttgaactcctgaactcaggtgatccacctgccttggcctcccaaagttctgggattccaggcgtgagccaccgtgcccagccaagaatggctattactagaaagtctaaaaattggctgggcgctgtggcccacgcctgtaatcccagaactttgggaggctgaggtgggtggatcacgatgtcaggagatcaagaccatcctggctaacacggtgaaactctgtctctactaaaaatacaaaaaattagccaggcttggtggcgggcccctgtagtcccagctactcgggaggctgaggcaggagaatggcatgaacccgcgaggcggagcttgcagtgagccaagatcgcaccactgcactccagcctggacgacagagcaagactccgtctcaaaaaaaaaaaaaaaagaaagtcaaaaaataacagatgctagtgaagttgcagaggaaagggaacacttatacactgttgggagtataattcattcaaccattgtggaaagcagtatggcgattcctcaagcagctaaaaacagaactacacttcaacccagcaatcccattactgggtatatacccagaggaatagaaatcattctacagtaaagacacaggcatatgagtgttcattgcagcactattcaaatatcaaagtcatgtaatcaacctaaatgcccatcaataacagattggataaagaaaatgtggtacatatacatcatggactattatgcagccataaaaaagaacgagattgccaggcacggtggctcatgcctgtaatcccagcactttgggaggctgaggcaggcggaacacctgagtcgggagctcgagaccagtctgaccaacatggagaaaccccatctctactgaaaatacaaaaattagccgggcgtggtgacacatgtcggaggctgaggcaggagaatcacttgaacccaagagggagaggttgtggtgagccaagatcgcaccattgcactccagcctgggtaacaagagcgaatctctgtctcagggaaaaaaaaaaaaaaaaaaaaagagagagagaatgagatcatgtgttttgcaggaacgcggatggaagtggaggctatcatccctagcaaactaacgcaggaacagaaaaccaaataccacaggttctcacttctaagtgagagctaaatgatgagaactcaagaacacaaagaagggaataagagacgctggtgcctccttgatggcggacgtttggaggagcagaaaaaataactgttaggtgctaggctgtgccaaatttccccgcaagcttgagaatatagaatcctttttttttttttttttttttttttttttgcctcctacgcaaaataactttaataatacttataaagtacaaaaatcaaagttattttgcataggaggtaagaaagggatcttaagttctcaagcctgggggaaaattgtggcacagcaaacagtaatagggaagcctgggcagggagtacagggaagaaagagatgaagttggacttagatccgttgattgagacagagagtggatcatcaggaagagaggtctagcaagttgtcaaagatgcagtgcaaaaattcaggacaacagtcagggctggagatggagattaagtcttcagccccactgtaagctggagtctcgatcttgtgagcaaactctggtgggaactcttagagggaggtgagctcagggcctgaggaatgagccttcagggactcgcctcctacatgcaggcattgaaaggagtcagagggccctgcaggtgagctggagaagggggagctggagaggaaggaggagaagcggggtggcatgcaattccagggtgcctaaggggagagcgccaaaagaaggaaacatgtctccgtgttacctcctgccaatgagaaaaggccactgaggatgttcttggtgacagatttgtagggttagaaaaccaagtggcataaacagtacctggaggaaatgataaaagaacctaagggtttctctttttgaaaacttcgggagtaaaagaaggtagagagggctgggcgcggtggctcacgcctgtaatcccagcactttgggaggccgaggcgggcggatcacaaggtcaggagatcgagaccatcttggctaacacggtgaaaccccgtctctactaaaaatacaaaaaattagctgggcgcagtggcgggcgcctgtagtcccagctactcgggaggctgaggcaggagaatggcgtgaacctgggaggcggagcttgcagtgagccgagattgtgccactgcaatccggcctaggctaaagagcgggactccgtctcaaaaaaaaaaaaaaaaaaaaaaagaaggtagaaagaaaagacatctgttggagatggcagcaggactgaagaaggggatttttcaggtaggaaagtcctgagcgtatttgtgaacggaggaagaaacaggggaagagactgagcataacctggaaggaggagagtcccggggaggctggagagtgctggatggcacaactcttcctctgagagaggactcccaagagaggacataggaggtagaaaagaattctgaactggaaaggaaaggtgtgatcgccagcaaatgctaatggacaaagaagcaagatagagctcacctgtgtcaagtggatccaattattattattattattattttttgagacaagagtctcactctgttgcccaggctggagtgcagtggtgtgatctcggctcactgcaatctctgcctccgtgactcagcctcctgagtagctgggattataggcacacaccaccacgtccagctaatttttgtgtttttggtagagatggggtctcaccatgttggtcaggctggtcttgaactcctgacctcaagtgatccgcccaccttggcctcccaaagtgctaggattacaggcatgagccaccgcacctggccgatttgatcatttttgataaacaagaagtcagcgtatgtggtgagtaggggtaggaaggtgggaaggaccagaggtttgttctgtgtggagtagatctggaagaattgctcccagccagtcgcagtgaatgggctatgagccactaagatatgagtgaaaatatcaccaaggagcccggacagcatcaagctgaatgaatttgagaatggtcagcccagttattacagttctctgcctttctccatcatcctaattcttgcaaccttacagctaggcaaggactagaaagatgtccttcaggaagctgcttttcataataaagactttctgtgctgcggtgcacaggccacatgtgtgcttacatgaatatgctcctgcacacacacacacacacgcaggatgcacacatacacaattttctgcttactgaaaaaggctttgaacacctgaagatgccttttgaggtttgctccttctctgagatgtaatagagaagtgaatgtgcctcaactgcttttggccacaaaggtttgggaggtgggtgattaaagtgtggcaactacttagcaacctgttatttaaagattccctcccttctttgattctcttaacagggatggcctaattagtaaagatgaaatgatggcttacttcctgagagctaaatcccaactacactgtaaaatgggaccaggatttatccataattttcaggagatgacctatctcaagccaaccttctgcgaacactgtgcgggatttgtaagtctgttttccgttgttttcttatgtgtgtagttatttgtgtggcattctgaaaaagtaggaaaatgatacactaaataaagttcactgtctgctttgaatcagaagtaaaatgtgatggctccctgaaattgaagattaaacaccaaaggcaaggtttagttattttctaggaatgcagggctagcaaaaacagggaaggctggtgagggctgttaactcaagagagtggttttgtttattactccctgccagggaaaagtgtcagcccaatgagccctggcattcatcactaatattcataagtggttgcaattaagaggtgcatttatcttagcgagttccttccagttttcatttcatggggtattagtgaccagaaatccgtcatggcatggttcaataattcacaactcaaaaaggaagaaaaaatctttttggagagaagctggttataataataaataacatttactcaatgcttgacggtaacaaagtacttccatagacattatggtaactaatcctcatagcaagcccttgaagtgggtattttactttcaccatcttgcttatgaagatagaggttcaaagaggataacccaggttcccgaggattgcacagctaatcattaccagagcttggactccgacacaggtgtactgactgtcagccctgtgcttcacctacaccactgcaacaaattaagactgcatgcttccttcccccacctttgataattctttgggaaccaaggtcagtttttgatcctggccttaacagaaactcctgggccctgaatgtctccagttgataatccaagttaaataaaatgggaaatgtggtattccaggtgagggaggcccagcacccagaggagtatgacaatcgcccctttttctagatgccagagctcagtcgtgttagctttatttggcagccatgtcctcctgttgactcgttgacccatattgaatttgttgccgatattatacgctaccagaaattacatttttcccatcccatgctcaaagaactggctttcaggagcccaatgcaggagtctgtgttcaagcacacactcctctgagaatgggtaaataagaggcagccgtttcctcaaagacggccccaggtggtcatagcagctgatgtgacacaggggaaagccagtctaactagctctctttattcactgcagagaaggtgaagttcttctttagtatctccactgggattgcatgaccagaccattttatcataaaacaaatggttggccaggcgcggtggctcatgtgtgtaatcccagaaatttggaaggccaaggcaagcagatcacctgaggtcagaagtttgagaccaacctggccaacatggtgaaaacccgtctctaccaaaaatacaaaaattagcagggcatggtggcaggtgcctgtaatcctagcttctcaggaggctgaggcaggagaatcatttgaacctgggaggcagaggttgcactgggccaagatcatgccactgcactccagcctgggtgacagagcgagactcagtctcaaaacaaaacaaaatggtctcctttttcatgtttctctattctgatggaaatttttggaaatacctagacctgaaaattctgatgtgggatggggccgtgcataacacgctcctacagagtgggacccagtaaacaaaaggtcaggctgctgggccatggtatggctcagccaaaagtcaggatgatgcatctgtcttttggtgggctgtgagagtcagaagacccttatcaaatctcaaggtcccgggtgctgtggcatggacctgtagtcccaggtactcaggaggctgaggcaggggtatagcttgagcccaagagttcaactccagcctgggcaatataaagagacacctgccactgccatcgctaaatataataataacaataataaaaaactcggccaggcacggtggctcacgcctataatcccagcactttgggaggccaaggcgggtggatcatgagctcaggagatcgagaccatcctggctaacacggtgaaaccccgtctctactaaaaatacaaaaaattagcagggtgtggtggtgggcgcctgcagtcccagctactcaggaggctgaggcaggagaatggcgtgaacccgggaggcggagcttgcagcgagccaagatggcaccactgcactccagcctgggcgacagagcaagactccatctcaaaaacaaacaaacaaacaaacaaacaaacaaacagagaaacaaactcaagatcttatctccgctctctagtccttctgtcctgcccctcccttttacagaggccctgattctgtaggagcagcaaggtagactttcttggaagttccacacctgtctccctgactcattggagcagacctgctggtgctacattcttgatgcagctgtgatgaagtagaaagctctggacctggagtctggaaccctgggttaaagttttgcccttgctaactctatgtccttgaccaagttattcaccatctttgggtctatttctatctgtaaaagggagttaatacttacccaccatgttgttgcatgataaaatactattagacacgttgcacgtcacatggctcggagtacacattttttatgtattccttgatactttgagagtttaattgaaattaactcatttaaaatttttacagctgtttttgtttttaaaatatatttaattttattggtacgatttgatttgatctttactgacactcatgtcaaaaagcccattggttttcaaaggaatttataactatagctctatagatgtgtcattgaaaggaattgtgggagaatggttccagtgccggaaccatctgcttttaaaataaattccattttaagtttaaggaagacaaacagacttgctctgcagaagatttactttagaattagaattccagaactgaaagagtgttagtaattcccttattttgtagatgaagaaactgaggtctggagaagttaagtgacttcccccaaggtcacacagatcattagcagcaaaaccatgagtcacacccaggtctcctgactctcagtccagtgtgccttacaccacaattactccaaatatgacagcagccggtggtctcaaatcaaaggactgtgggaaatactcctgcatacccatccacatgagttcatcctctactgttcttggcaggcacactgacccagtgcctcttcctagctactgtttgttcctggctattaagtaagcattagcaaacctacctccccacccccacccccagcacccttgcttgactgtatctttttcagcagttcctgcagcaatgctaataatgtaacatatctggatattaggatgtctcttcttaaatcttatcctttcttgtcccacctcagtgcctttgctcacacaacagtatgcaggggcaatggcttcctgtctttccctcaagtgacacattcttctttccctcactagctatgagaccttgccaagggactttacctctctgtaggtcagtctcctcatctgtaaaaatgagaaaaatattattacctacaccataaggacatcatgagcaattaaataagctaatatgtataaagagcctaactgtgcctttcacatagcaagagttcaagaaatgttaactatcatcattattattgctattatcattaccaagggctccagagaaagaatttccaggttgtgggagattgcaaattatctaacttcctggatcatcacattcaccttttacaaaagagaagcaaactagattatcataaagatcaagctgtgatgatcctggccaccactgcccttttctggatcatgcccctctctcttccagccatccttgcttctacttagttgtcagataatccttcctgtccctaagacaaaatactgctctgtcctaggagacatttgcattttatttatttattattattattttttctttgagatagaatctctctctgtcgcctgcagtggcgcgatcttggctcactgcaacctctacctcctgggttcaagtgattctcctgcctcagtctcctgaatagctgggactataggcacacaccaccatgcccagctaatttttgtatttttagtagtgacggggtttcaccatgttggccaggatggtcttgatctcttgagctcatgatccgcccgcctcggcctccgaaagtgctgggattacaggcgtgagccaccgcgcccggctgacatttgcattttaatatgtattctgaaggaccaaatagctgttaaggctcaaaggaatccttgagttttctacttgtggaagttccttgtcaaaaagaagtaaggagcagtctttgtatactcttgagtcacttcacattggctgtgacttactcttctggaagagcgggccatgctgcccacatgtgggggcattgttcacttataatacattgtgaacattgtgaacggcacccccatcagtcccagtgggccctgctttttcaacattattttattaagtagataatagccacctaacccaaacacaaagaggttagcaatagttcttctccaacttgagctaagcccatttaattacccatactgtatgcctctggtgaatctgtcaccccatgcaagaggtgtggggaggcacagaagggcatggcaaggccctcttctttttttttgagatggactcttgctctgttgcccaggctggagtgcagtggtgcggtctcagctcactgcaagctccgcctcctgagttcatgccattctcctgcctcagcctcccaagtagctgggaccacaggcgcccaccatcatgaccagctaatttttttgtatttttagtagagacggggtttcaccatattagccaggatggtctcgatctcctgacctcgtgatctgctcttctcggcctccaaaagtgctgggattacaggtgtgagccaccgcgcctggccaggccctcttctttatggtgtttagaaggagtctgtctggagagcgaagacaccaccaccaggatgtccctgaaccccctgggcaaacgctccctcgtggaactgcaggccctcacatctcccctcagggatttgtcacttcctacttgttaaccacgaggatgtcacagactccttgcttggcagaatctgagctttttcgacatctcctacaaccctggcacaggccaaacatagagcaaatgtggagaatgaagacatgaataactaagatcatttcctcttctgtatttttccacgggacaaatactactcagaaaatagcctagcaaaatccaaatgctttcacatgaggtgcgcttcttccattgcttcatttcctgtagtgggcgctaagagcagctagtgtcattaaaaagagagagccaggggctcccaaagaccaagtggccatctcctctgtacattttgctgagagcgcatcaggccaaagtctggtgcatcaaactttagtagtttcccatcccggctcccagttggctctgagaaagaaaagggaaaggaaactcatgttatcaccacagctggaaggggccgggagagggttcttctatctggcaggaagggtgttaaaagtggctacatcctgtttgtgcctggccagtcctgaagcttcccaggacttccttttcagtggccttgttttccttccagatctatcctcagattccctgacattcctttgtcttttgttacagctctggggcataatcaagcaaggatacaaatgcaaaggtaaatcaatgttattttgttacaatttttaaaatgtgacattttgggtaagaatcaaatttgtctggttaaactacaaaagctcttgccattattcggaatttcagtcttttgggtcaacggcaactgagaatgattgcctctgaggaggagtttctggagttttggagagctaaaattggaattttatagcttgttacaaaccactcttatcaacacacataaatctagttctttggaatcagcagcatccagttaaggtgggaattctgagtgggacaagcctagctaaaatactgaatataagaacttcttccttcaaagaaaaacacctacacactatttctctaatgcacaggcacttcttcccactcacacttagctattcctttctctactaaatcacatagatggtgacaaaaaacgaggagaaaacttaaaacgtaattttgtccttttcaatgaatgctttcctctatctttcccatttaattaagtttataaacaattgaatcaaatatatttgacaaatgcaatatgcatgtatactaagcatttaggaatgtgttgctacttgtacatatatgatcaagtatacattactgttgtttaagaagttgctggacactttatgtggacagtttatatggttcttctaataatctttttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcctcttctaataatcttataaagcttttgaaaaaatataataaaactacaaaaagaaacatcttaatcacagaataccttcagatgaatgttgttccccagggatgccttttttctccagtcgttttccagtatttcgtcctcattttgcatgaacaaaaagcttcccaaatctcaatggaagccactgtttagtgctcagagggaccttcccattagtgcttctctatcacttgccttggtctaacttagatttttactttcaagcagcaaagatactgcaagatcttattgcccagcagtgagtcattagttttattctggtttctatcctcataccctaaaatacacacacacacacacacacacacacacacacacacacgcaattttataaagatgaaaatctattacacctttggattatctcttgtattttcttaatggcacataaagtgaaaaaaaaaatgaattgaaatagattgaatacatcattaagactatttgaaacaaggtcacttaggggaaaatgggtactggaaatagttagaaaggtcctccttgatggtaggagagaaatgatcatctctattcaatgattctcagtgaagtgcaggaccctcatcataggaaataattgtgaaccaccatctgaagtggccacatttttctaccccaagtagtaattaacattctactgtcttatctaaaacatcctaatgggcaattcacagactctgctgcacgctgtttcaaagccataagcaaatatagaacatatttactgagcatatgcccatcttgtgttctgttggaagcagaagatataatcactggccctgaaaggttttggaaaatgaagaagagtaaaaaaatccagacaaggccgggcacggtggctcacgcctgtaatcccagcactttgggaggctgaggtgggtggatcacgaggtcaggagatcgagaccatcctggctaacatggtgaaaccccgtctctactaaaaaatacaaaaaattagccaggtgtggtggcgggcacctgtagtcccagctactcgggaggctgaggcaggagaatggtgtgaacccgggaggcggagcttgcagtgagccgagatcccgccactgcactccagcctgggcaatagagcgagactccatctcgaaaaaaaaaaaaaaaatccagacaagtgctgagtggaggaacacctcacagtaaatgatcagaggcagttggcctgggagagactagaagctgaggcttcttgccctaatgctggcataggctctctttgtggggattccgtctaagcctgggaaagactctcaaccccatttgatttgcatttagttttgggcaaaggcaactgacctctcaggctggactctatttactccctaggcacaattgctcattaggtcctcaattgcatacagaaccaagctgagcaaatctaagagaattttcggaacctcaggaaggcaagtgcagaccaatggcctctttccagatcctagacacaccccatgggcctgagctcaactctgaaattcaacacagaaactggggtgggggaggggagggctgacaaatcaagtgccaccctggaaactgaatcaacatcagacacactaatcatctgcgacacccttggaatttttcagactgtggagccaattgtcacaaacagtgcaaagacctcctggttctggcctgcaggagatttgcccgggcgccctccttgagcagtggtcatgggtcactgcctggaagcccctcgctgcccccaggtaatgccctctgctttctttgctgccatggtctctttctgcttgcctcctcacacttggacctcatttaggttctgggtctaaacccggtcagtcactctaaacgctaaggccttctttagggtgagcagcagtagctaaacccttgaatcatccttgcttctctctgctttctagtctcaggaatatgtaacttgcctgcggctaattgagttctgtcccttgtcggttcctctagaatgttgcatgccagactcgtgctgtttgcactaaccttgatgctttgctgtcaagcagtcagatgtcaaataatcaccaccctttttcacttccagcgcaggatgaggtgtttgagttccctggagtcactgctggacacagggatttagacagcagagccatcacactggttacaggctcttctcgcaagatctctgtgaggctacagagggccaccaccagccaggccacccagactgaacctgtctggtcagaggctggctggggggactcggggtcccacaccttccctaaaatgaaatccaagttccatgacaaagcagcaaaggacaaaggctttgccaaatgggaaaatgagaagcccagggtgcatgctggtgtggatgttgtagaccggggcacggagtttgaacttgaccaggatgaaggagaagagaccagacaggatggtgaggtaagtgctaggtcaacccacaaagaaaaccagaagaaggaggctgaaagtgctgagatgagcgttacagagggtctggggggcagcctggtagttctgaaagcagaatggttgggaatgaagacatgtatcacttttagtcttgccactgcctagctatgtgaccctggacatatgtttcttctttatggatctcagtatcatgatttaaaaaaattgaacgagatcaagttctgaaacctattgaaggctgtcatgtgtgcgtactgaaatgatgccccagaaacccatgactatatatccaaaataccagtacacgatacagatcagcttggttttccaagctagaaccagggcccagactcaagaaaggcagtagaagcaaaagacttttagataaaggagaattggaaacttttcattctgctcaaaagaagcttttgacagcatcatggaaaagggggtggtgagaatcagagatacgaggcccttgaggatctctaaaccaggctctgcctccgcatgagcaaaatcatgcaaagcaaagtaggatgcagatggaatttgttagagtatgctgacacagaaattgattcaagatggagttagataaatttattagttaacagtctatagtgtattaagagaaaggatttgagaaaattggcatgatattcctaacatttaaagcaatgtcatggaggacagccattgccaccctgtcgaattgttctcataaacagaatattgggttaggcagagatcctactggatcaagccagtgctctttagtcttatgggtggtcctccacattccactcttcaggagacctaaacacacgtctccatacatttcccatgatgagaaaaactccagtgacctttagccagaaattcccctagttccttcctcactgaaggcagtgcataaggaggccacccattatctctggtcatacaaggtttattgtaagtttctgctgaaacactttttttgtttctataacatccacttttaaaaacagctttgagatgtaattcatatgccatgaaactgacccatttaaaagtatgcaatttagtatactttcagtatgcttttagtatactcacaaagttgtgcaaccatcactacaatctaattttagaacattttcattattccaaaaagaaatcctacacccacgagcagtcattctcccccaactcaccccagccaactaatttattttctgtctctatagatttgcaatgcccactttatttttaacatttcccccactgatcatcttgacaactgtatcagtcctatccccctacttcttttactggcctagcacagttcaagctgggaatataaacgagaataagagaaagatcatgattaggtgtcaacagctcttaacccgaggtctatttaatggctttagggtgttcatgacagtactttatactccgtgtaaaatatacatggacatatggtcacttctgggaagaggagtccatgcattaaacaaacagattctcctggggggtatgtgatccaaaaaagcaaagaatcattgtgcaagaagattttctggattccctgtctagtcaccccatacactaactcagcctgcagaggctgtttccgtgggtgctgtagctgcccctggaatgtcagaaaaagagcttctccaggtagatggtaggacgcctaccagagtgctcaggatggcgcccaccttgtgggcatctctgaattcagaggagaacctgcttttgtttaacaaatagtgaaattggccatgagctcattactattggcctctcacagttcaagttacttaaaaactgtgcttctgagttaggagaaattcacagcctgttgggtgtaagacaatcaaataggtaagatatcctgatcattaatctctataaggaaatataaacaagtatctgggtttttaaaaaaatttaattttgtttcctggaaattgaacttttatattcaaatgctctcttatcctttctgtgttcttatctcttttctttcttttttttttttctttgagacggagtctcactctgtcacccagggtggagtgcagtggcacaatcttagctcactgcaacctctgcctcccaggttcaagcgattctcctgcctcagcctcccaagtagctgggactgcaggcatgtgccaccatgcccggctgatttttgcattttcaatagagacagggtttcaccatgctggccaggctggtcccaaactcctgacctcaggtattctacctgcctcaaactcccaaagtgctaggattacagacgtaagccatcgcgcccagctgtgtttttatctcttaaagcacagggatggttcactgaccacgagtatttaatttcatctgtgctaattaatgaaggacgtatgctcttatatgaaatgcatatatatggtatacagttccagtaccattcaaatcagtaacaaatgagatgtttgctctgtttagggaataaggaagaagggaaaaaaaatgacaaaattatacccagcggttgaatatgtagacaaaggagtttgcaaatttaagattttttttttttctgccaggcaagaccaataaatggcattaggagcactgacctacacatttattatttagtatcagatgatgtttgtgagtcctgtagttaaagactttagaacacagaaaaggtacgtgtgtttgtaatctgtgtatttcctccaacggagttccaggatttacgctcattttaaaatataagggtacgaacattttctgtggcagtgtatgtcatctccccaatgaccactacatgtcagaacagttcaagattactctcttggcagtaagaatacatgtatttcctttaaacttcttcttttgttttcctttatcttctactaaattaaatttagtcaacaaatacttatcataaaagggttgggaaatgctgactaaataaaatggaatatgtttatgaatatatgtaatatacatagtcatacatatgtacatatacatatgtagatttacagattttctcagtgccctcttgcactaatttacactgtggatttctaagagggaaaccttttaacaaggaccatttcaagggactaatgatttgtggtacaccctttaaggtcaacatcctagttggactccatattggagtctttaagagttcatatgctgggtgaactacatgatctctctctcttttttttttttttttttctgagacaagatctcactgtccccctggcaggactgcagtggtacagtcatagctcaccacagcctcgaactcctgggctcaagtgatcctcccatctcagcctcccaagtagctgggactgcaggcatatgccaccatacccagctggtttttatttatttttttgtagagacggggtcttgctatatttaccaggctggtcttgaactcctggcctcaagtgatcctcccacctcagcctcccaaagctctgggattataggtgtgagccactgcacccagctacctacatgatctcctaattcccactaaatcctgagactacaaggtactgatcatttcagatgttccctcaaagtcatctgaaaaactgctttctaggaacactcttattttgttatatgagatccagccatgcaataggttccaatttgtgtttcaggatggctgacttcaggctgcggaaactgaaggcaataatgttggcttttggaaggggcaagacgagaaactctgaagaaagctctgactctcaggaagttatctggaaagatacctggatgtttactgccttgggacactgtgggatctccatgtttggactatgggacagagaattgaccctaactaactaactatgaactatttatttcctcctcccctacccctagttaagtgccacaaagactgtgttatgtagtcagtacttttttctcatgtatctttctctagaccatttatatacgggtgaaatgaaagcttttttgcatgtacttgatactcagtctgtaaactcagacttcgctttttttgtgagactatcctttcaatatttttataaacttttgtgtgtgctgtggcagggaacagttaacaaggagtttatttagaggggtttttttcattttttgtttttcttgttttgttttgttttgttttgttcttcttggtgtgctttttggatgggaccagaacttaacattttcctgaggactaggaagctcatcagacactggaatgcagtgattcttctaatgatggtcaactgcaaggagaaactgtttacatccttcccactacacagttgctatgatatgtaacaagtcacacatgtatatatcacacaagtcttaccaattctgcgtcactaggaagctatagcatggtcgtgaaagctctcctaatacttacttaaatagccatggaagaaaattatgcttgtcccttctgactgggttaagccatctttcttaagattcctgaagtagaaatagcaattaagaaattaattcaagttttgacggttaacatttagcagaaaaacaaaccattgaataagctactaggtgaaatgcaaaacaaccatcaatttttttaaactcaataattttgtgaaaaaaaaaaccaccaccaaacttttggttgtaaaagagaacccttgttcccttcctaagaaactgccttccacaattaaagaatactcatagaaagaaaataatcataaatcatatttgattaacatttcatttaagcttttaaaatatcaattttttaaatagctcccatttacccaaaataactagttatgggtctatttcttccatgattagaggagagagaacttgattcaagatactgaaaaatagagctgggactgagcctgtgaatgacaggaatgatctattaccaggtgactagtcggaaactacacagacgtgcactggtctgcatttgggggctaaagtgtatatattccatttaaaatggaatttgtttgtatttggggcagtcttcagtaaagcctttctcctttcttttctccattgaggacagttctgctcagcaaaattgttgagtacctgttctgggcaggtcccacgctatatgcacaaagttaagaaaaacttggtcttagcccttgggagctgacagcccatgggcattaaggcaaagtagttccagtgatttaaaatacggttccaaatacgctaaaaccaacttgtgccaaccagatttacagattggaaatactgcagatgatgtgaagttatcagttggaggagctgtgattaagctggataataagagaacgtgccatctgtaaagcactcagaaggcagccatccctagatgttggtttcatgtatattacactatctactactatccataaatgcaataatatgcatgttaacaacattaaaaacagcaaacagcaatctaagtacagaaaagctttttgtgtgtttaaaaaaattgaagaaaattcaggaagaaacgtgttaataaacattgtactgttcttttgcttctcaaaggaattattcacttgccactttggttatttttgagttttcgtacataggaagttttatattgccagccttcctgtgataaagatattaaatgtaacttgagtaaaaaataaaaaagaataactatgtatatacatatataaattaca

SEQ ID NO: 605 - DNA, 20810 bp, Homo sapiens
tttcccggcgtccatttagtggcgggaaaagcgaccttttctgagcgcgtttgcctgttgagtggtagcctttcccctcaaccagcaatggaggagcagccccagatgcaagacgccgacgagcccgcggactccggaggggaaggccgggcaggcgggccaccgcaggtcgccggcgcccaggcggcgtgcagcgaggaccgcatgaccctgctcctcaggttgttccctttggcctcctcagccggggccaagtgggcgttgtggcccggaactccgcccttgctcagaagggctagggttcgaattcacgctcggtcacgtcaggtctccgtgattgcctcattcacttaaactgttgaagctctttcttcatcagcgaaaaggagagaaaaatgaccccctggagagaggttacaagggttaaatgagatagtctaggaaagtgttgagcacagtgccccgggcccttagaagctgtaatttctcctcctgtttccccgccctccccctacctctctggtttacagacaaattgaatgccagagctaaactggaaggaaggtgcccctaccatttcttttagaactacgaccctttgtaacccagaagctttatatgttataaattctactaagcggacggtgtttatacttttccactaagcggttgctggggaagattcgatgagaagggacattcgtcttctaaactagtgagcaggagaaggtcctgggccaaatctgcctaactgcctatttttgtgtgaccactcaagctaagaatagtttttatgtttaagtgttgcagggaaaagatcataaaaatatttcataacacgtgaactctattagaaattcaagtttcagtttccataaacagttttattggagtacaactttcctgccacaagggtggaattgagtagctaaaacagagaccgtgtgactcacaaaccctaaaaaatttactatcaggtcctttacagaaaaaaatttgcggtcctctgttctatatcataacagaggtagttttaaaaaaatcattattggctgagcgcggtggctcacgcctgtaatcccaacactttgggatgccgaggcagacggatcaccttaagtcaggagttcaagaccagcctggccaaccatggccaacatggtgaaaccccgtctctactaaaaatacaaaaattagctgggcgtggtggcgggcgcctgtaatcccagctactcaggaggctgaggcaagagaattgattgaacccgggaggcagaggttgcagtgagcagaagattgtgccattgcactccagcctgggcaatagagcaagactcttgactcaaaaaaaaaaaattaattaccatttttttctttcttaaatgttttgaaaaatgaaaagatgtctatttcttttttattgttttttcctcctcacccttgctgtcatcttaaattaccatttgctcatagtttttctacttatgtatgatttttggatttatagaacaactgaaaaactatatgaattagtaatccaaggattagtatctttgttatttttctgtatctcctgataaaaatctgtgtttgtaaatacagtggtttggggtttaatcattttggtctattctttgtatagcatcctcagttcagtctggcctattaaaaataatcttaagcggccgggtgcggtggctcacgcctgtaatcccagcactttgggaggccgaggcgggtggatcacgaggtcaggagatcaagaccatcctggctaacacggtgaaaccccatctctactaaaaatacaaaaaattagccgggcatggtggcaggcgcctgtagtcccagctgcttgggagcctgaggcaggagaatggcgtgaacccgggaggcggagcttgtggtgagccgagattgcgccactgcactccagcctgggcaagagtgcaagactccgtctcaaaaaaagaaaaaaatcttaaacaccaattttttaacttttcctgacagatgctgttttcccagtgtattccattttgtgtcttcctctgaggccttaaagttctttatacccattttaaataaaatgaggccaaattagaagtttgtaattaggagtttaattatttatatttattttgttgtatcagcttccgaaaaagaatgagttggttcgtcatgtggtaatgagtaaaaccttaatcaataaatatgtgactttatattctctttatctgttttcaggctgagagcacagacaaaacaacaactcttagaatataaatcaatggttgatgcaagtaagtattttcattttcaaattagggttttgttgtttgtttgtttgtttttttgagacagggtcttgctatcacccaggctgtaatgtagtggcgcagtctctggtttactgcagcctcagcctcctgggctccagcaatcctcccacctcagcctcccaagtaactgggaccacaggcacatgctactgcgcccgtctaattttctgtattttttttgtagacacagggttttgccaccacacctggcctcaaataagattttgtgagtttgatgattaacagtactcgagtgaaaataaaattaactttaccaaaaattgtttatatatgttatagtgtggcaaaactggtaaacatgcaagatatttatgaagtatgctaagtgtgctgaaggaaacaaaggcatgataagagggaggggcttcttttcatagggatggcttctctaagaagatgattttagagctcagatccaaatgagaagaaagtttacgttccaatagtctttttgttctctatatagctagtaccatttttaagggattgtgacatccaaaaactagatttagttaacactgtagaatttctatacctaggagacgacagatgtaaggcaggccacaggaagtttagttgtagcctttgaaagaagatgtttatctaaaattgactatctgctcttttagaggccaagacaagaagatcacttgaagctaagagtttgagattagcctgggaaacaaagtgagacctcgtccctacaaaaataaaaaaaacgtagccagatatggtgatacatacctatagtcccagctgggactcactacaacatccaactcctgggctcaagtgattgagtgattgtactgtactccactccactgggcaacagagtgagactgtcaggcaatcaacagagaaataagtattgattcttttaccatttaaaaaatatatatatggctgggcttggtagctcacacctgtaatcccggcactttgggaggccgaggtgggcggatcacctgaggtcaggagttcgagaccagcctgaccaacgtagagaaaccccgtctctactaaaaatacaaaattagctgggcgtggtggtgcatgcctataagctcagctactcggggaggctgaggcaggagaatcgcttgaacctgggaggtggaggttgcagtgacgcgagatcacgccattgcactctggcctgggcaacaagagcaaaactccgtctcaaaaacaaaaacaaacaaaatatatatatatatacacacacacatatacgtatatgtatatatatgtatatatatgtgtgtgtatgtgtatatatgtatatatatgtatatgtatatatatgtgactgagactttattggttaaaggattgttttttacaataaaggcatctattttaagggtacaatttgatgagttttgacaaatttctaaatctgtataatcactaccacaatcaagatacagaacattttcggctgagcatggtggatcaatctgtaatcccagcactttgaggggccaaggcgagaggattgcttgagcccagggcaaccagcctgggaaacatagcgagacccccacctctaaaaaaaacaattggccagatgtggtaccatgtgcctgtagtcccacccagctgaggtgggaggattacttaagcctgggatatcaaggctgcagtgagccgagatcacaccactacactacagcctgggtgacagtgacaggagaccctgtctcccccaaaaaaagatacagaacattttctttttttgttttttctgttttttttttttttttgagacggggtcttgttctgtcgcccaggctagagtgcagcggcgcaatcttagctcactgcaacctccgcctcccggattcactgcctcagcctctcaagtagccaggattacaggcacctgccaccatggccggctaatttttgtatttttagtagagacgggtttcaccatgttggccaggctggtctcttaactcctgacctcaggtgatccacctgcctcggcctcccaaagtactgggattacaggcatgagccatcacacccctggccacacgtggctttttaaagctaattaaaatgaaataaaatttaaaatcaagtacatatcaaatgctcagttgccacatgtggccagtggctatcctatgggatagcatagataggaaacatttccatcatcacaggaagttctaggcttttttctgtaccattgaggtatttgttgatccctacacaagtgccacattgtctttgttggttgatgtttttttttttgagatgatctcactcagccacccaggctggagtgcagtagcaagattttggctcactgcaaccccaacctcgtgggctcaagcgatcctcccacctcagcctcccgagtagctgggactacaggcatgcactattgtgcctggctaattttcagtagagacagtttcactatgttgcccaggctggtctcaaaaggttaatcatcattgagatgggctgtaaatgtaaaatacagacagaataatgtgaaatatgtcattagtaatgttaaactgactgcacattgaaataatatttttgatctattgggttaaataagtatattaaaattaaatttcactgtttcttttctgtaatgtgaaaacgacattttaaatgatgtcttttgcccttgtggcttacattatattccttttggacagcacctctctaaaatgttagtaacttcaaaaaattatttatttgcaggtgaagaaaaaactccagaacaaattatgcaagaaaagcaaatcgaagcgtatgttatatttaaaaattttgtttatggtctttactaagatttaatcatattttctattattttgttgttagatggagtctcactatcatgcaggctagagtgcagtggtgtgatcatagttcattgaagccacaacctcctgggctcaagggatccactggcctcagcctcctgagtagctggaactacaggctcattgtaccacacctgactttctttcttttttttttttttttttaaatattttagggccaggcacggtgactcatgcctgtaatcccagcactttgagaagccaaggtgggtggatcacccgaggtcgggagttcgaaaccagcctgaccaacatggagaaaccccatctctactgaaaatacaaaattagccgggcgtgatggcacatgcctgtaatcccagctactcgggaggctgaggcaggagaattgcttgaacccgggaggcggaggttgcggtgagccaagattgcgccattgcactccaacctgggcaatgagcgaaactccgcctcaaaaatatatatatattttgtagagatggggcctcattttgttgcccaggctgttctcaaactcctggcctcaagtaatcctccaccttggcctcctaaagttctgggattgtaggcaagagccactgagcctggtcataatctcatttttctatgctatagcattgtttttatttttcctttcctttatttttccaaataacttgtgatgcatatattgggaagttgttaatttgggatggagatttatatgtacacaagtgatcacattagaactttctggcctccctttttataagatactaagtgaagtagctgaggggcattagtttaccaaatgtgtaaatacacattggtatattgagcctgtagaatacttgtatttagatagaggtgttttacttttttaagggcttattttatacatttatttcaataatgtctttttctgatattgctgaaattcttttgctcatgtttctttgatagtaaaattgaagacctggaaaatgaaattgaagaggtaaaagttgcttttgagataaaaaagcttgcattagacaggtaattattacattttaaatataagcattgtgaactgactgcaaaatgggtatgaggggaaagtggagggaatcttttaactgggctgagtgaattagtcaagcacagtgatgattagataatggtcacacaaaatttttattttattattgttataattttttaatttgacaaggtctcactcttgcccacgctggagtacagcgacatgatcactgctcactgtagcctcaacctcccaagctcaagcaatcctcctgcctcagcctctggagcagctgggactacaggcatgcaaaaccacgcttggctaattttttttattttttatggagatggggtctcactgtgcccaggctggtcttgaactcctaggctcaggcgatcttctcacctcagcctccccaaaatgctgggattacacaagcccagcctggtcacacagattttgagccctgagagaaaatttgcattacagatgctcctcaatttgcagtgggtttaggtcctgataaacccattgtaagttgaaaatatggtaagtgaaaaatgcatttaatacacctaacctggctgggcgcggtggctcgcgcctgtaatcccagcacttcgggaggccaaggtgggtggatcacctgaggtcaggagttcaagaccagcctgaccaacaatgcaaaaccctgtctctactaaaaatacaaaaattagccaggtgtggtggtgtgtgcctgtaatcccagctactagggaggctgaggcaggagaatcacttaaacccaggaggcagaggttgcagtgagccgagatgacgccactgtgcactccattgtgggtgacagagcaagattccctctcaaaaaacaaaaaaaaagttttaaagtttatagtcatatatggttttgtattccctaagtccttcatttcaggcccatcctgatctttgtagtgccttaatccttccagtggctttgcacaaaagtagatggttcagagaactcattcagctcaggccaggtttcagattcacctggcccctcattctggcagtgtatacccacacgcaacagccctatccatcttggtgttatttcatatttttgtgttttatttctcaaagtatttctcttataataatattttaaaacctacttctgttttatgtatatttgaagggaaatcaatctttttcatgttttgaatttttttaatgtaccacaaatgttatccatgttttataatgcaagctttttccctctcataggatgagactttcaactgcacttaaaaaaaacctggagaaaattagcagacagtctaggtatgattttttttttctctggattcggtaaggatgggatctgcatagtgactttagttttgtgaattttaaaaaattattactgccaactacctttgtctggggaataaggaaagtgatgaaatttttgtaggtcctccccagaattacagcaacttttatagttctaattatattttgttccgtatggattgtaactgtaagaagcagaagagtttatccagaagattggaaaattttaagggaaagctttaaaagttcattttcttcagtatttactataaatcaggaacagggctatctcatttaatccatccaaaacacagtgagataggaaatatactcctcattttttattggtagaaatgagcttattcggatccaacaattttccaagggatataatataaagactagcaggtctcagcaaactgtcacaaggacaaaaaaccaaacaccgcatgttctcactcataggtgggaattgaacaatgagaaaacatggacacaggaaggggaacatcacacactggggactgttgtggggttgggggagtggggagggatagcattaggagatatacctaatgctaaatgacgagttaatgggtgcagcacaccaacatggcacatgtatacatatgtaacaaacctgcacgttgtgcacatgtaccttaaaacttaaagtataataataataaaattttttaaaaaataaaaattattatgagcaaaaaaaaaaaagactagcaggtcaggtcctctgtatcctggtgtctggcctcagaggtcttacctatgatctttttttttttttttttttttttttttgagacagtcttgctctgtcgcccaggccggagtgcagtggcacgatctcggctcactgcaacctctgcctcccgggttcacgccattctcctgcctcagcctcccgagcagctgggactacaggcgcccaccaccacgcctagctaattttttgtatttttagtagagacgggctttcactgtgttagccaggatggtctcgatctcctgacctcgtgatccacccgcctcggcctcccaaagtcctgggattacaggtgtgagccaccgcacccggcctcttacctatgatcttatctcccaaagttcttgtgataaaatatccccttcccttgagcaccagaaaaattcctgcatgggtataagcactttttttttttggagacggaatcttgctctgtcactcagactggagtgcagctcactccaacctccatctctgcggttcaagcaattctcgtgcctcagcctcctgaatagctgggattacaggcacctgctacaactcccaggtaatttttgtatttttagtagagacggggtttcactatgttggccaggctggtctgacctaggcacttctatcttgagtatcttagcccacactgctacacattttcccatattccagctaaatccaggattacataaatccaaaaatctgaatttgaacactcataactttttctctcccataaaaggagagtttagcttgggtacagaggctcatgcctgtaatcccagcactttgggagcctgaggcaggaggatagcttgagcccaggcatttgagatcagcctgggcaacatagggaggcctcatctctacaaaaaatttttaaaaattagccaggcatggtggagccaccagtagtccttgctactccagaggctgaggggagaggatcagcctcctgccttgattctaggaggtcatggggctgcagtaagctgtgatcttgccacagcaccttagcctgggcaatagtaagaccccatctcaaaaacaaaaaaaaaaaagacattcttgagttaaaggtgtggggtgcaggagagcaggacagattcatcacattgttactgaaatgtcagggctttggtctaggtcctgttgcttgctgcacagaaatgtaatcactgacatgagtgttgtcaggaagaaggctttgagtactgtagccaaagagaggggagatcagtctcatctcctagatggactaaaattaaggaggtgttttgttttgttttgtttttttgagacagggcctcactctgttgctcaggctggagtgcagtggcgtgatcctagctcactaccaccttcacctcccaggttcaagtgatccacctcagcctcccaggtagctgggactacaggtgcccaccaccgtgcctggctaatttttgtattttttgtagagatggggttttgccatgttgcccaggctggtcgcgaactgctgagctcaaagggatccacctgcgttggccttccaaagtgctgagattacaggtgtgaaccaccacaccctgccaaattaagggtttatatagcagggaagatatgtacccatgtatgggaagacaggaattagggaggggtaaggaagaggagttagtcaataggaagcaggttaggcaatcatgatgggtgaggggtctgatgtcttattgtctagagggtgtgatcttataagtttcagttccttgatactatctgggagtcctgatggtttcctgagaagggaactcaggtaagacagttgtaactttctcaagctttaagactgggagggtcagtttctatgtttattcaaaagaaatcataaacatcagttctgtgggacaattgggccagtttcactgttgacaccaaaaaacagaagggtcaggccggtgcggtggctcacgcctgtaatcccagcactttgggaggccgaggcaggcggatcgtctgagatcagaagttcaagaccagcctggccaacatggtaaaaccctatctctactaaaaatgcaaaaattagccgggcgtggtggcaggtacctgtaatcccagctactcgggaggctgaggcaggaaaatcgcttgaacccaggaggcgaaggttgcagtgagctgagattgtgccactacactccagcctgggcaacagagtgagactctgtctcaaaaaaaaaaaaaaaaaaaaacagaaaggtcaaataggctgaggcagtgttttattagcacattttaaagtttataactgttaaaaaaaattaattgggatgcaactggaatgccattaggcagaaccatctttagccttgagctccatcaccttgggattcctatgtaagcctgatgtaaacagtaaaatggaacttaagcttacccaatgagaaactgccaactaacttctaactagagatgatccactttaaccaaccaattacattttgtcttctatgaacaccttataaaagcttcctcactcaactcccacagtagagcacttaacagcttataatcctgtgctgccagatgcatgaattgtcttctcaaataaacttgttagattttaatatgcctaaatttatcttttaagacaaccaaatatagctgtaaatagtagaaaaatgagttcagctctcccaggtttgtgcatattccccttttgaccttctcagttagttgcttctacagtgtttttcacacctggctgattatcagaataatgtctattatagtgatcacattgttggtcctatcccaaactttctgaatcagcgtatcttttttttttttttttttttttttttttttttttgagacggaatcttgctctgtcacccaggctggagtgcagtggcacgatctgcttggctcactgcaacctctgcctccaggttcaagcgattctcctgcctcggcctcctgagtagctgggattacagacacacaccatcacacctggctaatttttgtatttttagtagagatggggttttgccatgttggccaggctagtctcgagcttctgacttcaagggatccactgtacctgaccttttttttttttttaaatagagatgtggtcttgctatattgcccaggtctcaaaactcctgagctcaagcaatcctcctgcctcagcctccaaaagtgctgggattacaggcatgagccactgaaccaggccccgaatcagcatatctgaaggtcaggaactaggaatccttacttaacgaacctcccagatgactgtggcactctgaagtatgagagccactgctctgcgcagtcttattccatactgttttgctccagccataccaaactacttgatctaggcaattacttcatatccttattccaccctgtgcataactctggttcatatttgttactgcgctatagtatgattgtggatttatttttctccactagattctttcctctttgaaaacagatactgtgttttattttattttacattcctggcacctggcatagttcttgaaagcatgtagtaagtactcaaaaatatttgttaaagaagtaaaaaagcagtttgttccttgaaactattctgtatgctgcaataatggtggatgcatgtaattatacatatgtcaaaacccaaagaatgggtggggcctcagtagctcatgtctataatcctaccattttgggaggctgaagagggaggattgcttcaaccctggagttccagaccagtctgggcaacatagggagaccccgtctctacaaaaaatgtaaaaattagtgggacatggtagtgtatgcctataatcccagctgcttctgaggctgaggcaggatgatcgcttgagcccaggaggtgaggttgcaggaagctgtgattgtgccagtgcactccagcctgggtggcagagcgagaccctgtcacagaaaacaaacccgtaggctatacacaagcaagagtgaaccttgatgtaaaatccggactttgggtaacaatgatgtgtcgatataggtttgttgattgtaacaaatgtgccactttggtgtaggggatgttgataatgggagaggctatgcatgtgtcaggggtagggtgtatatgagaaatctctgtaccttccactcggttttgctgtgaaactaaaattgctctaaaaaatacattcaaaacaaaagcagcttgttaaaattgctctaaaaaatacattcaaaataaaaactaaaattgctctaaaaaataaattcaaaacaaaagcagcttgttaggaagttattagggtgtttcctctctaaatatgaaatttttagaaatgttcccacatttttaaatttggtattcttcaatgtctgtgaccaaacatttttctagggaaatgcatatctagttttaacagaaatttagtttacatcaaacttttccagatttattttgttaaactgactttttatccaagtgtacggtggatttaatgaaagtaagttttcactcattgattccttcattaatgacagctattatttttaattaagttacaaataaccttaataaatcatctttttgtttccttttcagtgtgctcatggataacatgaaacacctattagagctaaataaattaataatgaaatcacagcaggtaaacttacacattaggctgattatgcattctcatgattttactctcaacttcttgctggtaactgtattgtatatgattaaatagattgtccaaagggaatgctatgattggaattcgctgtccttgagttctctctttttttcaaaattctattatttctgactaatgttgaacattatctacttataatttaagttactgtcttccttttgctgtctggaaatagaggaattgaaaactggaactttagataactaaggctagtagataaactcagtgatttaagtattacaggtttgtccttacatacagtaatgtgctttaacttttttatttttaataacaggaatcttgggatttagaggaaaaactgcttgatattagaaagaagagattgcgtatgtagaacactttttttttggcagaacacattttgcttactttatagattgataaggccagatctcttagccactgagaaatttcctaatttccgacttccaaaattccttaaaatttttgacatggcaacttaaaaagtgatataaagtacattttgttctgtttattctcattgttttagaactttattttcgttttttgtttgctttttctgagacagtcttgctctatcacccaggtggaatgcagtgacttgatcttggctcactgcaacctctgcctcccaaattcaagtgattctcctgcatcagcctcctgaatagctggaactacaggcacccaccaccatgcctggctaatttttgtatttttatgttaaaaaaaattttttaatatggtatttttttttggagacagaatctcactctgtcgcccatgctggagtgcagtggcacgatctcggctcactgcatcctccgcctcctgggtttgagcaattcttgtgcctcagcctccagagtagctgagattacaggcatgtcctatcacacctggctagttttcgtatttttttagtagagatgggatttcaccatgttggccaggctggtcttgaactcccgacctcagatgatccacctgcctcggcctctcaaagtgctggttataggcatgagccactgcacctggccaaattgttgtatttttagtagggacgggatttcaccttgttggtcaggctggtctcaaactcctgacctcaagtgatccgtctgccttggcctcccaaagtgctgggattacaggcgtgagccacagtgctgtgcctcattagtttagaactttaaatcacaaaattaatacattctcagaaggggaaaaataaaaggatgtagtaaattataatgcaaaagtcatgcctcttttctgtgtgaccacagtttggtatttatcagtctagacttttccatatccatataaacatttatatggacatggaaatttctatatatatatatagagagagaatttctatatatatataaattatatatataattatatatatttatatattatatatataaatatatataatatataaatatatataatttctaaatgatcaaatgatatgtatggatctacagccttatcacttaatttatcatgacatgagatggttttttgtattgaaactgttggaatgtttatttcaaaggcaatacacactgtagaacatttggaaataaaggtatacaaaggaaaagttaaattttttttattttccatcaaaagataatcagtcttcaaagcttttttcagataagggtcttgttctgtcacccaggctggagtgcagtggcgtgatcatagttctttgcagttcagtgcagctttgaactcctgggctcaagccatcctcccacctcagctcccaagtagctgggaatacaagtgcactccaccatgcccagctaacttttttgttttttgttgacatcgaatcttgctgtgttacccaggtttgtcttgaacttctgccctcaacgatcctcctgccttggactcccaaaagtgctaggattacaggcatgagctaccacacctggcttgtatttcttttttttttttttttttttttttgtgagatgctgtcttgctctgtcacccaggctggagtgcagtgctgcaatctcggctcactgcaacttctgcttcccgggttgaagaaattctctgcctcagcttcccgggtagctgggattacatgcgccaaccagcatgcctggctaattttttgtatttttagtagagacagggtttcactgtcttggccaggctggtcttgaactcctgatctcgtgattcatccacctctgcctcccaaagtgttgggattacaggtatgagccatcgcacccagccattttttttctttttctttttttttttttttttgagatggagtctccctctgtcgcccaggctggagtgcagtggtgcgatctcagctcatggcaatctccacctcctggattcaagtgattctccggtctcagccttctgagtagctgggactacaggcacccgccaccacgcccagctaattttttgtatttttagtagagacggtgtttcaccatgttagccaggatggtcttgatctcctgacctcgtgatccacccacctcagcctcccaaagtgctgggattacaggcatgagccacctcgcctggccaacctttttttgtttgtttgtttttgttttgaaatagtttcgctctgttgtccaagctggagtgcagtggcgcgatcttggctctctgcaacctctgtctcctggattcaagccattcttctgcgtcagcctctcgagtagctgggattacaggcgtgccaccacgcctggctaatttttgtatttttagtagatacagggtttcaccatgttgtccaggctggtctcgaactcctcacctcaaagtgttctccccgcctctgcctcccaaagtgctgggattataggcgtaagccactgtgaccggcctttttgttttttgagacagggtcttgttctgttactcaggctggaggcacactcatggctcactacagcctcaacttcctggactcgagcaatcctttcacctcagcatccctgatagttgggactacaggtgcatgccaccatgcctggctaattgttttttttctgtagatatcttttttttttttttttttttttttgagacggagtctcgctctgtcgcccaggctggagtgcagtggcactatctcagctcactgcaagctccacctcccgggttcacaccattcttctgcctcagcctcctgagtagctgggactacaggcacccgccaccacgcccggctaatttttttgtatttttagtagagaccggatttcaccatattagctaggatggtctccatctcctgacctcgtgatccgccctcctcgaccacccaaagtgctgggattacaggcatgagccaccatgcccggcctttttttctgtagatttcttaaatttatttttctatagagacaggattcattcaccatgttacacaggctggtatagaactcctgggctcaagtgatctgcccaccttggcctcccaaagtgctaagattacagacgggatcctgtgatccactgtgcctggccagatttgttggttgggttttttttttttatacggaatttctctcttgttgcccaggctggagtgcaatggcgtgatctcggctcactgcacctccgcctctcaggttcaagcgattctcctgcctcagcctcccgagtagctgggattacaagcgcccgccaccactcccagctaattttgtctttttagtagagacggggtttctccacattggtccggctggtctcgaactccctacctcaggttatccacccacctcggcctcccaaagtgctgggattatacgcatgagccaccgtgcccagccggtgttttgtttgtttgtttttattgagatggagtttcgctcttgtcacccaggctggagtgcaatggcgtgatctcggctcactacaacccctgtctcccaggttcaagcagttctcctacctcagcctcttgagtagctgggattacatgggattacaggcgcctgccaccatgccccactgatttatatttttagtagagacgggtttcatcatgttggccaggttggtctccaactcctgacctcaggtgatccaccctcctcagcctcccacagtgctgataacaggcatgagtcactgcaccctgctcagatttgtcatttgtaaacattatatagatttgcctgttagcaaataatctcagggtcattagtagtattggtcatcttgtctattcccccatgtttttttaagtagaatcagggtcttgctatgtttcccagggtggtctcgaacttctggcaatcttcctgcctcagccttccaaagtgttggaattataagaatgagccacccatgctcaggctatacccttttgatgattcattttctccactgcattccaacctcctttaatatacattaatgttgaagaacaggcccctgaaatacatccatttatatttccaagtagtttaattcttagactatttccagtaatacaaaaaatgattgatgatgtttatccctggagaggggaatcttacttttttttttttcctgagacagagtttcactcttgttgcccaggctggagtgcaatggtgcaatctcagcttactgcaacctctgcctctgggttcaagtgattctcctgcctcagcctcctgagtagctgggattataggcacatgtcaccatgcccagctaatttttgtatttttcatagagatggggtttcgccatgttggcggggctggtctcgaactcctgacctcaggtgatccgcccacctcggcctcccaaagtgctgggattacaggtgtgagccaccgtgcctggccaaataagattaattttaaatgaaaagtaagattccttggccgggcgcggtggctcacgcctgtaatctcagcactttgggaggccgaggcgggtggatcactggaggtcaggagttggagactagcccagccaacgtggcaaaacccctatctatactaaaaatgcaaacattagccaggtgtggtggtgggcgcctgtaatcccagctattcaggacgctgaggcaggagaatcacttgaacccctgggaggcggaggctgcagtgagccgagattgtaccactgcactccagcctaggcaacagtgagactccatctcaaaaaataataataaaataaatgtttatatgtttcatttttgtaatttaagagggaaaaatatatgtatttcctacctattttggcaacccaaaataagccctcattacatgatgccacttgaaacatctgtagacagctgttattgtcatacagaaatacctggaacatttcactaagggcattgctaagtacgaaattaaaatattgttattttgcaccagggaagtcattttcagatcgtaataaagttgcaacctaaaatgctgcttattaaaatttttctcttgactaaaataaccaagaagtgatctgcttcataatttttcaagatccttgtttatagaggtattatatatggtatattattttatttttaacctaacagaattaaaacaagcttcagaaagtaagcttttagaaatacagactgaaaagaacaaacagaagattgatttggacagtatggaaaactcagagaggataaagatcatacgacaaaacctacagatggagataaaaattactactgttattcaacatgtgttccaggtaacatttatataaactagcaagagttttaatcttgttgcccaggctggagtgaagtggctcgatctcagctcattgcaaactccgcctcctggttcaagcaattctcctgtctcagcctcctgagtagctgggattacaggcgtccaccaccatgcccggctaattttttaatttttagtagagacggggtttcaccatgttggctaggctggtctcaaacccctcaccttaggtgatccgtctgcctcagcctcccaaagtgctgggattacaggcatgagccactgcgcctggccaactatttgatgatgctatcatacagtattgacttaactttcagctagtttttgatcttgatgaaataattcaatgtttaatattggtctgtttgtatatatctggaatgtgtgtatacttaatgtttaaggtcttgatttttcttttttcttttttcagacgcagtcttgctctgtagcccaggctggagtgcagtggcatgatctcggtccattgcaacctcctcctgggttcaagcgattctcctgcctcagcctcctgagtagctgggattataggcatctgccaccacacctggctaatttttgtgttttttggtagagatggggtttcgccatgttggccaggctggtctcgaactccgatgtcaggtgatccacctgcctcagcctcccaaagtgccgggattacaggcttgagccaccgcacccagcacgctgcaagtatttttaacaagtaaaacctatccatggaaactgacgaggcataaaaaattattgtaaacattgtaaatattccctaacattatggagatcaaggctaaagccttactaaaagtggaaatgaaagtagaagaatgctgctgggtgtggtggcttatgcctgtaatcccagcagtttgggaggccaaggcgggtggatcatgaggtcaggagtttgaggccagcctggccaagagaccagctgagccaatacgttgaaaccctgtctctactaaaaatacaaaaattagccgggtgtggtggtgggcgcctgtaatcccagctactcgggaggctgaggcaggagagttgcttgaacccgggaggcggaggttgcagtgagctgaagaccgcaccattgcactccagcctgggtgacacagagcaagactccgactcaaaaaaaaaaaatagaagaatgtattatcatttttttcttatgatcacagagctacacatgtagtaaatgttaattacttgataagattcatgaaaaatgatattctaaaatcttgttaaatttttaaagtacttgtaactttaaaacaattttttttctttacagaaccttattttggggagtaaagtcaattgggcagaggatcctgcccttaaggaaattgttctgcagcttgagaagaatgttgacatgatgtaataagaattcatttctgacatattttacatttctggcaatctcaactcttatttggaatacttctgtgcatttgtctgtccaccgtaattttagaaaagcatatccataacgtttacagttgtagtacagttgtggttagttatttgtagtgggattgaaagtaatttttttctttttatatttctatatttagtttgtttttttgttgttgttgttttttgagatggagtctcgctttgttgcccagactggagggcagtggcgcgatctcggctcactgcaacctctgcctcccgggttcaagcagttctgcctcagcctcccaagtagctgtgactaaaggtgcacgccgccatgcccagctaattttttgtattttagtagagacggggtttcaccgtgttgcccaggctgctctcagaactcctgagctcaggcagtccaccgcctcggcctaccgaagtgctaggattacagacgtaagccaccgagcctggtctagtttgcattttttttctatcagttttataagttaagaaataaaaggaattaatgtta

SEQ ID NO: 606 - DNA, 16068 bp, Homo sapiens
ctcagtcggagcgaagcggctggcggagcagaacggattgcagggtagggagctcttctcggggaccccaggataggcgcccctggcccgcggccccgggagccgcaggggtggggcctcggcctcctctgcctccatcgtcccccatcctgcagggtcttctagctcggcagaggagggctccgggctgggtttctcggggcctgtttggggaacgcgggttgctcctccccaggggaaggggtgggtgtggcaacagcggcaaggattctaggcggacgtcgggtagtacttcccgcctggccacctgttctctgcgtgcaggggaagctcttcccgccctccccgctgcttttgcctttgggcgggagccctggacgggggactcgccgggcggtggggcgaggcgcggggggcgtcgcacgcgggaagcagagccaccccccgccgggcctggccgcgccagctgtggctcgaggttgggacggcggccaggcccggcgggggaggtggggagccgtcctggcgccgcgcgattagccgcatctgggggaggaggagccgccgggcgcgctgggcccgggtgtttgcgcccggatgggggtgggggtgccttaggcgctggagaaaaacttcacccgcgcccacaggccccctttccgcaggctgcgctggcggttcaggtttgcaggccggaagtgaaatgttcttttttgatttttaaaaaggaagcctccggccctatggttttctggggttggagtggatgtgtgtgctgggggaggcggagacgtcccgctccaggcagggccttgggtcttaataggtggggaaatctctgccaaataggaggcctctcggagcctcagtttccccatctgcagactgggctctgacttcttctggcatgagagggtgtgtgagagtaaaaggaggcagctagccccgtgccgggagacacgtaagctactgttttttaacttgctgttttgatatttctcagtctctctgtgcccagtcttgcttgcccctgtcatttgctgccactctgaagccagagggaacttagaaaaacaatccgcttagatctaccccacgctgaaaatcgtccaccgaagtcccattgtcgtctaagtccccaacttctcagcagggcttcctgttatcttccgccactaccttctccagcctctctctgcctctgttctccctcccttcgggcctttggccctcctctgggctcggggtcctccttggagaccccaccgccctctgcactccctgggtggcctcggtgatgaccgtgagttctcgatgctggtcccttcagggcaagaaagaggcgcagagcccggctgggagtagatgttttcaatgagctgagctaggcctggcgtggggccatggggtggggttgagggtggttgacggtgggtcccctaggtaggggatcggtctttgttccaccgagtggcaaagccagcgcatttggtttgtgttccatcagcaggggcaggaatgggagggaaggtgatttcagatgggcccgtgcctgacacttccaccatcagccgcactattgtggactgagcccgccgtgcgcttggcattttcgcggcaccatctgcacagcgtccgagccctgcgacgcagcaccgctcctgtcccctttgacagatgaggaaactcgggtggggcggtgaaatcgcctggcaggggtcacagagggagtggggaccagtcagggctcaatctcaggtctgagccaaagccccccgagaatggagggaaggatggagggattgagtgggggaggcgtgtagagtagggttcttgttgagaaggagggcttgggcttcccgcaggaggggcagtccaggctgagaactggggcgggcgcagggtcccaggtgggtggtggcggtggggtgaccgtctccctgctgggtggggtcgcccgtccggtcgaggccgtccaggggtgctaatgggggcacaggcaatggcaatgttggaggcccccttgggttcccggtacactcctcgggtttccggcctcttcccagcactcaggggctcctgagggcggaagagctattcccagcttggcggggcctgggagggggctctgggcagacgtaggcgccgggctgcaccttccctgcccgcctgtttgcacttctctgtgactgttggcttcaggtccttagccagcggagggctgactccggcctggctgccccctcccctttgcctcccgtccctccccctggacactccaacccccatcccttcgtgtccctccccctcctctctctctgctcctccctcgccagaccccccgctctccccggaacaatggaggggaatgtggctaggccagcctgacgctgctgcgtcaacctctggctcgttctcggcctctatcgcttccagggacccttctatctgggctcagctgacccgccccgcctctcggcccacgtgccggcagttctcccaggctggggctcagctgcgctggagactgggatgggtcagctcagtgtctctgtctgtttacaaaggaggaacccaggtgcactaaggtaacttcgctactctgctagagtctcaccccgatccctgcgccatttcccttccacctcctgcactgttaagccttgggctgtgagatgggccagtgtagcccggctactgccgtgttccctgggtcagggacagctgcctcactgggagcgccttagaaatgtagaatcttggccaggaatctggagcctgtaatcccagcactttgggaggccggggtgggagaatctcttgagcctgggaggtcgagaccagcctggacaacacagtgagaccttgtctctacaaaaaataaaaaaattagctgggtgtggtagcacacgcctgtagtcccagctacttgggaggctgaagtgagaggatcccttgagcccaggaggttgaggctgcagtgagccatgattgtgccaccaaactccagcctgggtaacaaagcaagaccctgtctcaaaaaaaataaaaaagaaatgaagaatctcaggccccaccccacacctgctgaatggcaatctgcatttgaacaagatccccagagattcctgactgcattaaagtaggaagtagaatcactggcttaactctgtgccttagtttcctcatctgtaaaacagggctgctaaaagtgcctcccctgttgggtcgatgtttacgtgcatgtagttgatgtttgtaatcccccaacagggcctgacgcagaagtctgtggacagtggctgtagggtgtatgaaagcactacagcctgccccatccccatagtgcgggccactacccaccacacctgccagcagtgggctggctccgggctggaagctgccccaacaccatgcccaaccctggccttccccagccagcatcccatggaaggctcaagacaccctcattttgcagagcaggcttggagaggttctcgctttgccaagagtgaggtgtctgacttgaactcttatccccctgccttctatcatcctgtcttcaataaaggggctgaagctattaagaatggaatctctggctgggcacggtggctcatgcctgtaatccgaggactttgggaggctgaagcgggtaaatcatgagaggtcaggagtccgagaccagattggctaaaatggtgaaaccccgtctctactaaaaatacaacaattggctgggtgtggtggtacatgcctgtagtcccagctactcgggaggctaaggcaggagaatcgcttgaacctggggggcgggggtctgcagtgagctgagattgtgccactgcactccatcctgggcaacagagggagattctgtctcacaaaaacaaaaatgaatggagtctccttcaatgagctccctcttactagagtgtaaatggctgatagcactgctaaagccctccttgcagtaagcacagggctgcttggctcccattgatgtgggtggtgggttttcaggccaggagggcaggaagttggggagtgggtaatgggggctgcatgattgggccgtaagtctccagacatgcgggcaggctgagcaggggctgggaaagccagagtcttggtacccagctgaactccagaaccttccaggaggagctgcagagcctacggaaaattcccaggctattttcggccgaggcccccttctcccagccgacacacccatccctggggcagtcagggtgggcgtggcttcctgcccccaccaccctgggctccctcccttggccgggcactcatcagagcctgggggctgactggggaagggggtgcatggccagctgggcacctcctggtgcagcctctcccccttaccctgctggctttttctccgtagcatttctgctgtctgacttactccgtatttcaccagggtctttgttagccgggcgaccctgggcaagttacttgactctttgtgtctccgttctcccattagtgaaatggggatagaatgagctgggctgtgtgaagtgttgtaaagtagtaagcagaatggccccaggacactgctgtggtggtggtagtcatggtctgtcccactcccttatctgttggttcaataggaagtggcagagttcatcaaggtcccctgtggcagcacaggtgcccagcgtgctgtgcggtgaggtgaggctccccgctccatggacgtgtgcatacagacggcaacaagttcacgcatgcatacacgtgtatgcgctcagatgcagagacagccatgtgtgggcacatatgtatgtgtacacatgcgtatatacacagcacacacatacacatgtgcatacacctacatacctgtgcacaaacgagcacacatgtacatgcagcctggcagtcatgacaccttggtcgtgacatttggtcgaagtttgttgcaggccagaagctcatctgagtggcggatctgtttgcagccttcctccctcccccagctgtggggagctgaaggctagtcacagagggcaggccctgtcttctgctggggacactccaaggccatgcctggtattgctgggagagcagtggctggctggaagctgggactgtgctggtgggcggggctgctgtgtggccccatccttgtgtatgtgtgtattgtggaggggacacagcagaggctggccagggcctcagagctggcttctgggtgcctggttacccgccccccagttgttttctttccagctggactttgcccggccctcccccgcactgaggccattcactcctctctgctgggcctactggggagtgagtggcccttggccaggcctactctggccaccccagcttggcttcagcccagatgggccatgagaggctggataaagctcctgggtctcccagttggcactgcccccgcccctagtcacgtctgctccgtgcctcagtttcttccactatcaggtgagcaggaatgtagccacctcctgctgggctgggcatggtgctgagtgcacaccaatgcagtggcagccagctggggctttgggtcctaatgctggcaaagaatgaggcttggaagctgggtgtggtggctcacgcctgtaatcccagcactttgggaagccaaggtgcgccgatcgcttgagcccaggagtttaagaccagcctgggcaacatattgaaaccctgtctctacaaaaaatgagctggttgtggtggcacgtggccgtagtcccacaacccaggaggctggggtgggcggatcacctgagcccaggaggttgagaggcttcagtgagccatgatcgcgccactgcattccagcctaggtgaccaagtgagatcctatctgaaaaaaaaaaaaaaaaaaaaaaaaagccatccttgtggccattcctggaccgtctggagaccctgctctgtgccagtgcctgtgctgggcccttgggacacagaggggccctgtgctgccctcagactcctcacccctacaggccatgagcttccagtggcatctctgaaggattgggtgcacttggggtgttgagggggcttgggtggagaaagaagggggcccccattttgggtctgtgccattcacccaggggaaaatgggtgtgacaaatggaagatgcaaggaggacgacgatggtgacaatgacagtgatgatgatgatgacgcggcatgattcctgagcgggccctaccctttccaccgcctttcctgcctcccattcctagtcccccacccatcacatggtttccccactggcctcagtcccacccgggccctcagggcctttgcacaggctgttccctatacctggaacagcctccctccgttttgcaaatggctacccctttcttgctgttcagggtcctgcaggcaccctgattagcgtgtgtattcccacccttctccccctatccccttctgtctgtttctttacagcccttttgggatctgtaatgatctggtttatgtttatttaactgtttattctctggcttcaagttcagccctttgtctctggggccttgaacagggctcggtattgggcacgtgtctgttgagtgcctttatgatgacaattataacaacagtcgtagctgacaattactgctcactggacctgggcggacagtgtgcccagtgcttagtgtgtattattttgttttcagttcagcctgatggtgtgaaatcgggactattataattcccattttccagatgtggaaactgaggcccagagagattaagtaacttgtacaagaccacacagcaggcaaggggtaggattagaagtcagctatgcttcattagccgggcgtgatggcgggcacctgtaacccctgctacttgggaggctgaggcaggagaatcacttgaacccagaaggtggaggttgcagtgagccgagattgtgccattgcactccagcctgggcgacagcaggactccatctcaaattaaaaaaaaaaaaaaaaaaaaaaaaaaaagtcagctatgcttgactccaggagaaaggagggagggagactttggatagaacaaggcagggcagtgtctctaactgtggagttgcgaggccactgctcccatctgctgtcctgggaggcctggacagggccctcccctcccagggccagcctctttcctggaactctgggcgttgaacattctaggactctatgacctgtgctggtaggtcatgcgggggccctggcccccaggccagcagctggggcctttttgaggtgggggctccccggactcaggagttcctccttggccgcggctgtagctgagagaagggacaggaggtaggatgccacctcctccagaaggcaagccagccaccagcttcccagcccgacagaactgaggcccaacgggagagtgcagcaatgtctggggaggggttctgacatttcagggatggggcatcccttctcctctgagcagtcgggcctggttcttgggtggctatgcttgaaggcggttcggggggtgcggtgggatttttgggtgatgtaggttgaagactcctataaatgaggggactgggggggcaaactgaggttgaaggttgtgagagcttcatttctttccatgagcagctggaaacctggattttgaggaaaccccctgggatgtttaagatagttcaggccgggcatggtggttcatgcctgtaatcctagcactttgagaggaagaggtgggagaatccgttgagcccaggagtttgagatcagcctgggcaacatagtgataccctgtctctataaaaaaaaaaaaaaaaaaaaaaaaaaaaaaaaaaaaaaaaattaggcatggaggtcaaggctacagtgaactgtgattatgccactgccctccagcctgggtgacagtgagacactgtctcaaaaaaataaaagttatttatttttttttgagacggagtctcactctgtcacccaggctggagtgctgtggtgtgatctcggctcattgcaacccacagctccctggttcaagcaattctccagctttggcctcccgagtagctgggattacaggcacccaccaccacgcccagctaattttgtatttttagtagagactggttttcaccatgttggccaggctggtctccaactcctgacctcaggtgatccacctgcctctgcctctcaaagtgctgggattacaggtgtgagccaccgcacctggcccatgcttcaaatctaaatttgaaaaccccatgggacctgagtcaaaccgatccagggctgctgctgtccctcccggctgtgtggtgttgagtggcgtcctgagttagttaggcttctccctacttcatctcgtacccccatcaccagccctgcgcaggtgccaagtgatgcccacccagctgccccactttgcagattcggaaactgagcccagagatgggaaaggacttacccaagggcctctgactgctggactgtttctctttcccctgaacctcgagctgaggccacgttagagccgacaccttcatattcaatgttcagtgattattgtgtacagcgagtgtcctgctcttgaaaaattgtcaaaagcacagcagcagctagggaattcccgccctccagctggatttaccggtacatactaggggtcacagaaggaatttgatttcataacagcgtggtgacccgggctgtgtggaaattcactgggcctgatggagctggatgcagccttggaaattctccctttccctttgggctctcgcagcaggccccccagtcctgggtgcaggcttgtgacagctgctcagggatccaaacgtggcgcttgagctctctgcgacgtgttccacagttccctggaggcggacactgcgtgagggtcagtttttgcccctgcttccctgtggtgtctggctcccagcagcgtcagggagggtccgtggagtggctgagtttggatctaggtggttggcattaaaatctccctggctttgggttttcttttttgagacagagtcttgctctgtagcccaggctggagtgcagtggtgcgatctcagctcactggaacctccgcctcccaggttcaagcaattctcatgcctcagccttcaagtagatgggattacaggtgcctgccaccatgcccagctaatttttgtattcgtattagagactgggtttccccatgttggccaggctagtctcgaactcctgacattaagtgatccgcctgcctcggcctcccagagtgctgggattgcaggtgtgagccactgcgcccggcccctggctttgggttttctgctcaccttcctccttccctcccacaaatactatgtgtcccaaatgtgccgggatccatgccttgtgctggggacacagaggggaccgatgccatcctggtcatgggggaggatgtggcattttcatgaagagctatgatcgagggggccccacggttgcttcaggagcccagagtaggcatctgaccctgccaggcgtgctcccagacaaggtgacaatggtgctgaggtgcccgagaggaatgagcctcagatactggactgtcagacgtggacatgggggtaagcacagggtccctaccttgcaaggcacgagcccctgacagcctcttctctttccaggtcagccatgtcatctgagcctcccccaccaccacagccccccacccatcaagcttcagtcgggctgctggacacccctcggagccgtgagcgctcaccatcccctctgcggggcaacgtggtcccaagcccactgcccactcgccggacgaggaccttctcggcgtgagtctggagcaggctggggacgcgttctcagatggatctcttgcctgaggccagagattcactgtgtctctggccatttttgggcctatgtcccggactgccaaataggcagacctggggctgggccgtgggctgagggtgagaaactaggaaggcgccttgtaaattcagggtactgcccagcccagaagaacctgttaccagctgggagtggcaatgggtgggcagttgctggggtcagaatcgctgggctttaaccacacatgagagtctggttccctgtgagactgtgaattctgcagctgcaaaatgggcacagcaccagggctgcaaaggacccacataatgcctggcagatgcaggtctcaggccttgcgagtggaggatgcttgtgttattaatagtaaatcattagtttctggagggatgttcagtgatgttttagttcaactccctctttccaggagggaaaacaggcccgagaaaattggccagggtcatccaaagagtcctttcccccagcgtctttgtgagcggctcccagggttgagggttgtgcagtcctcagcctgtgtgactgtacatggcggtcctggccagggcttgatggggcacagctgtgggcaggggctggaatgagctttgtgtgcccaggagcgctgatggggcccctgacatttccccctctctgtcaggacggtgcgggcttcacagggccccgtctacaaaggagtctgcaaatgcttctgccggtccaagggccatggcttcattactccagctgatggcggccccgacatcttcctgcacatctctgagtgagtcagcggcaggtctgggtggcctggctggggtgggcgcttccttggccctgtggaggtggggatggtgtgtgactctgatgggcgctgggtgtgaggacgaatggctgggcctgtgtgactctgcctgtggctggtgctccagctgtgctcctgtgtgtgtgttgggttggggttgtgagactctacggagctgtgttgggggatgtgaggctgggggcgacacggtacttgtgattgtccctgggtgtgtctttgtgaatgggtgtgtaaggttttgtgtgtgctgggcgtggtggctcacgcctgtaatcccagcactttgggaggccgaggtgggtggatcacgaggtcaggagatccagaccattctggctaatggtgaaatcccgtctctactaaaaaaacacaaaaaaaattagccgggcatggtggcgggcacctgtagtcccagctactcgggaggctgaggcaggagaatggtgtgaacctgggaggcggagtttgcaatgagccgagattgcgccactgcactccagcctgggcaacaagagcaagactccatctcaaaaaaaaaaaaaaaaaaataatgagcagggcgtggtgacaggtgcatgtaatcccggctcctcggaaggctgaggcaggagaatcacttgaatccaggaggtagaggttgcagtgagccgacatctcgccattgcactccagcctgagtgacaagggtgaaagtccatttcaaaaaaaaaaaaaaggatcgggcatggtggctcacacctgtagtcccagcactttgggaggcggaggcaggcggatcacctgaggtcaggacttcaagaccagcctggtgaaatcctgtcatcacaaaaatacaaaaaaatagaaaaaaaaaaaaaaaaagcggggaatgatggcgggtgcctgtaatcccagctacttcggaggctaaggcaggagaatcacttgaacccaggaggtggaggttatggtgagccgagatcgcgccattgcactgcagcctgggcaacaagagcaaaactccatctcaaaaaaaaaaaaaaaaaaaaaaaaaaaaaaaaaaaacagatctgcccaagatcacatagccagaaagtgatggaaatggatctgggggtgcccgactatgcttgtgggagacagggtggtgtcagctgtgcatggtgcatgtgtgtgagcagcagggactgctggggtgagtccgagtgcccattatatctggccaaggacaccccatgaggctggggagccctgtttggcctggggaccagtccagcttcctgccctcctttgggggaggtggactggtgaggctgggggctgtcctgcccctttgctccaggaaggaagtttggggtgggtctttctcctcctgcatgcttactgacgtccttccttcctgagtgtctgaaaacccttggggagccgggggtggggcgcacacatcctagggctgggctggaaggcacccagccccccatgcttcacctctgatcctctgggcagcctttagacaggggaggaccctcgatctgcacccttgtccctacctgcttctttggcctaagcacccccaagtcttttacttcaggcaggggcagacagagtcctactctgcacagcatacccgctaacacggaaaccacatttctgaaaagaggagcccactgcaatgggggagttacccctcctttgcccacccccgccccatgcttacctatcagatcggcaggcaggagaataccaaggtgacgcatttcacatatgcatgcatacatggatgtgtaagggtatttccatactgccttgtcccagaaaggattttgaatcagtaaggaaaacatagaggttggggcaaagaaatatttaggaagatggaaatattgtgatgtctggttctgctgctggaagtaggctgcagatttatttctgagctccctcgtgaccagatcaaagagggaaacactcttcaccatacgattctccaatcaaaacaaaccagttactaggggagctggctggcccttgcatttagcatctgaagggggttttcctctgggggggtttcatcaaggggacatcaagatgccagtctcatgtgagagggtgactcatgtcccctagaaagtaagggaaccttcctgggggtggtcacagggagaggcccctccaggaactagcttcatgcaccaaagggaccttcttgaaggctcaccgggagtccaggcgtggtggctcacgcttgtaatcccagcactttcggaggctgaggcaggtggctcacttaaggtcaggagtttgagaccagcctggctaacatggtgaaaccctgactttgctaaaaatacaaaaattagctggctgtggtgcctatagtcccagatacttggctgaggcaggagaatcacttgaactcgggaggtggatgcagtaagctgagatcacaccactgcactccagcctgggcaacagaacaagactctgtctcaaaaaaaggcaggctgggaaactggggaatttgagaacaaagacacggtgcggtttctgagactcctggaaccaggggctgcagtgctgaggacctcaggaaagccctgcccaggccacccctcaactcggattctcactccatgatggccttgtttctctctggctctctggcttggactggctgtctttactcttcagtcacaagcccaggctccctcccacatttcatgtcaccatgtgagcacccacaggtggctgaactctttcagttccagcatcaaaagtcccagggaaggagctgattgggccagggcctccttgcctaggacagaggctgggggcagtgtggcagctccctctggtggaggggcagttctttggaaagaggttcccggtggttggtcagatggtgcctgctttggtggctgtgtgaccagaagggtggctggtgtcttggggaagggagctgtgtcccggtgtgagccctgactgctttatttatgcccccgtagtgtggaaggggagtatgtcccagtggaaggcgacgaggtcacctataaaatgtgctccatcccacccaagaatgagaagctgcaggccgtggaggtcgtcatcactcacctggcaccaggcaccaagcatgagacctggtctggacatgtcatcagctcctaggagatggtggaagcaccccttgtcctgtgcttgtgggagactttgcagggaggaggcagcagacactggagatgacattcttccacacgagacggggcttcagccgggcatggtccctctcaagtatctcctggaggaaggggtatggggggcaggtgtggggtgtggggtgttcccggccatcagcacagcctatgaccattgcaacaacctctcaccatctgaagagcattaaaagcatttaaaaaggagaggtgcccactggtggctgagtggaggttccaaccccatcccagggagtggatcaagggtggtatttctccagctgctcagacacatgggctcaacccacagaatccctcttcctcctggagctggaggccccagattcccagatctggccccctggcagcctgacagggaccttgcgtgacttctccaaggcaaatttccacctaagtgccccttgcgcctctcctggggcctgggcaaagcagttttctaattcttggcttggttggttctaggggagctggcttgaagtgggtggggaaaggcgggggtggcggtctttggattggacggatgttgccttttggtgcctttgcagtgggaggcggcatagctgcctgtctggggaagacagttctcccagcactcccacccctgggcacagcaggctggtactgggaggctgaacccctcttagagcctgaccttttcatctgccttctggttgtgtgaccatcactcaacagccatttcacagcccctgtaattatggcggcggggggctggggtggtggtggtgggaagggcttgtggagaggacacagtctttgtttaaaaactttgtcccgatccatccagaaaagagtaggtagcttgcatcctgacagcctggcaaagtcaagaaagttgaaggagaaacatacctttggagagggggttttctttaaaactagtgttaagaaatgcttagggattttttttttcttatttttcataactaaagctttcacccagagccggctctgtttgcactttgctgccgacattgcaaactttttggcagggtgggagactgagtctcattctgtcacccaggctggagtgcagtggcccgatctcagcttactgcaacctctgccctccagggttctggcaattccgcctcagtctcctgagtagctgggattacaggcatgcgccaccacacccggttaatttttgtatttttagtagagaccaggtttcatcatgttgggcaggatggtcttgaacccctgacctcagatgatctgcccatctcggcctctcaaagtgctgggattacaagtgtgagccatcgcgcccggcctgcaaacttttttgtaggtatttctggtaaacaaatccttaggttatctttgctgtggttgtggtttggctttagtcatgatttcaaagtagaaatagctaggcattattttttgaaatatatgacctatatgtagtcaagaatccactgaacagaggcaagcaaaccttttggaaactggcttttgggcagacagtaaacgtccagtttgatgctggaagcatgaacagcttcatcaggtaggtactcctcaactctgatgagtttgtcctttcagcctaagggggtggaagggagttgtttgagaatagcaaatacgcatgttgattgcgagtgtgtggagacaaaggcagttcccaccacagttaggtcctggccattgtttcctcgcctgcgatgctccttgtacatcctcaccctcctctcccgcctctgccttctgctgggtcaaaggtggccttttctctccagccttgaattgttccctgttggcttcccaagggcccatctgctggtacagtccacacttccacagccaagacccgagagggctttcactgccccaagcctctctcctgtgaccctgggattctgtcttggcagaatcctttgtcagcggctcttactctgtccttcctgtttggccacagctctttcaatcaatgggtattctagaaccgcaggatgtcagagctggaagggacgcgataccggtttacacaaggggaaactcctcgaggctctgggagggacggagggttttggtgacagagcgagagctaaaattgaggattcctgaatccagatcttgcctcccatcagccatctttctcccaataaatttttgttttgtgcaaggcta
